United States Patent 7,365,185 (GENOMIC PLANT SEQUENCES AND USES THEREOF) - sequence listing, part 44

SEQ ID NO: 64718 - DNA, 14681 bp, Oryza sativa
  unsure (1)..(14681): unsure at all n locations
caccaccttagttcacaccaaaattgaaagtttggttggaattggaacgacgtgacagaaaagttgtaagttgtgtgtgtaggaaagttttgatatgatgaaaaagttggaagtttgaagaattattttggaactaaacacggcgatggtgagatagatctggtgacgaagttgccagctagctcgatcgagcacttgcagattatcagcccatctcctgccatttttctcggccataaatctgatttttattttcaaaatttagcctaagtccacgatataaggatctgaaccactgcatgaagcctaagggtgcattcttttcagcctatagatttcgggtgattatacactaaacaagaaacatgattagcatatacttcctctatcttataactataatataagggattgtttctttttttttaaggttaaacatagtggtcaagtgggtagttaggggttaaaataggtagaaatttgaattggagttaacatgtgcgacaaatagtacaccaaaatttcttttactgtgagacaactagaagggatgaattcccttatattataaaatgaagaaatgaagagagtaattaattggttaattattaaaaccttttaaaataaatttatttaattctttaaaagcatgttctatgtagaaaactttagtacggaacaaacattttagtgatttaaaaagcatgtttacgaaagcaaagagtagctaacttcaattagctttttagaacatgccgtaagacatgtgaatttttttttattcaccggaggggagagtttcccacctaaatttcgttaccaaacttagggaagtaatacaaagttttacactgggtttagggattggagaggggatgaaaatatttggttccacactgggagtactattgtgtcctttctaacaaccttttggctcaaaggttggcatcctcgatacatcttctaaggacactcggtatcgatgttggcgcgtttctgaagacaatatcgtgacaatggtttcaaaattcccagaagcacaacagaaaaaagatttggtgatgcagcttaggcggtcttagaacttgccctaagagtgtaagacatgagaaaaagtttttattcaccggaggggagagatccccacctaaattttacaggaatgctagggaacggtataccgtccctccaacaagatgctcctcttttccacaacttgctcgttcgatgtagcaagatatcgcaacgtggtgatggaagcagtgccgacgatgagctccggcgtggaggacgcggccgccggcgagctctggcgtgggacatggtcgcatggacggcggaggatcctgcgtggtgatagagacggcgctgacgacgagctccggcgtggggcgtggataacggaggatcctgcgtggtgatggtgacggcactggtgatgagctccggcgtggaggacgctgccaccggctgaggtgtggacgacggacgcggccgccggtgatgagctcctgacggaggacgtggtcgccggcgacgagcttcgatgtggaccgtggacgagagaggaccgtggacgggggaggatgcggctgccagcgacgaggttcaggttcggtgtggagcgtggacgggggaggacacggggccgccgccgccgacgccttgatgcccagctcctgatatctagcaggtatcatctgatacctcgtaagtatcacccgatacgtcgtagaaatcgcgctatatctgagaggtatcatatgatacctcgcgaatatcacctgatacatgataggaatcgtctgcatgatacctggtaggtatcacccgatatcggctatctatcaggacctgataccttgcaaaagtatcacctgttacgtggtaagaatcgcatgatacctgatagatatcatctgatacctcgtaaatatcatctgatacgtggtaaaaatgcatgataccggttaggtatcaggacctgatacctaaccggtatcatcccgtttttgaacggaattccggtatatagcagccctcaaattttattaccaaacttaaggaagtaatacaaagttttacactggatttagtgactggagaggggaagaaaatatttggttccacactgagagtactactgtgtcctttctacacacacaacctttcggcctaaaggctggcatcctcgatacatcttctaaggatactcggtatcgatgttggtgcgtttctgaagacaatatcatgacgatggttccaaaattcccagaagcacaccaggaaaaaagatttggtgatgcagcttaggcagtcctgacggaggctgtaagtgtgcaaatgttgctcatctcctgaatgattggttggaagccgatcgcctcctagaatggttttgcgaatgggcagtgtaggcatagatggctagctgtttccgttgtatatatcttcgcacagatcacataccgcagtggggactatcactttttttattcaggttttgtttcgttggtagctgttccttgagatgcgtccttttcttccagacaaactcccagttggggcattgatctagttgcggacttgcggtgccctggcattgtaaacttgcgtggatgttagttcgtttgattgtgacagctctctgtttcttcggtcatctactgatttgatcggaacgatcgtatttgtagttgcgcttgtgctgttgaggacagccgcggggagatgattttaatctcggatggacgttcacccgcttcttatatatcatttaaatagttatgaaaaaaaaattaaaaaataataatatagattaatgcaaaatataccactgcacaaacatataagtttaaattcgacttaaaaaataaaaaattaaattgtaactagtttacatatatttgcagataaatttattatttttgttacaacttatagaagatgattttgaacttgcatgtttatagaatgatatatttcatattaatctatcttattattttttaaagatttttcatgactatttaggttgacatgcaagaaacgagtggatgtccgtccgagtgtttaaaaaagttttcccggccgcagagttagtggcacacccccttggaacacagacttcactatgacgtcttgatccgttgcatgggaaaatagggcttcgaacttttggtacaacgtcgggttgatggcccaggtgtcattccagaacagaatagcagttctatatatggaactcaattgttctatctgtaatggattactagtttttttctgttgacagaaaatagggagaaaaactttagaattttttactgtcagatttgcctcaagattcgtgctgtccttacagaacggagtagtagttctatttgtggaactcagtaggtctatctacatgtaacagatttactagttttctgtcgacggaaaatagggagaaaaactttcaaatttttcaccgtcggatttgcctcaagattcatgctggcgtgtgtagggaaaaaaatctgcgcacctggaagggtaacccaggacctcactttgtctcaagattcgtgctggcgtgtgtagggaaaaatccagtgtgagaataaatctgtgcacttggaggggttctaaccgaggacctcactccggcaggctgtgtgtgctagtcactagggccttgtttagaacccaaaaaatttggccaaaaatatcatatcaaatttttaacacatgcatgggacattaaatatgaaaaaaaaaaccagttgcacagtttgcatgtaaattgcgagacgaatcttttaaggctaattacgccatgatttgacaatgtgatgctagagtaaacatttgctaatgatggattaattaggcttaataaattcgtctcgcggtttacaggcggaatctgtaatttgttttgttattagtctatgtttaatacttcaaatatatgtatgtatactttaaaaactttacacccaatgaactaaacacaccctagctagatctgttgcaagtttttgaaaaataaacaagttacatgttagttgtactccatttacacttccgttacaatgcaattacgctatagttatatttgaaagattttatagaatttttctttcgacagttttataggtagtcccatgtgtaaacattgttagctggatgcgggcatgcggccaagtcagctcaccaaactggcagaatcgccggtcgtcacctgcgcacacaacacaagccatgatcattgatcagcgatgtgatcagcttcgatcggggaacgtgaccaagttggttggtgcctttggtcagagtgcgccggcgaaaccgatccatcgatccacacaccccaccccatcatcatcatctatcgcccacgatccgatgcccgtttaatgcagcagcatcgagaggcgcaaaccgcaaagggtgcaagggattgcgtcccggtcaagagactattcctacttgagtctgctgctcaccctctgatcgatcatcaggcgcagttcgttcgcgcgcgccgtacgtgttggttggtcgacgacgctagctgtcgtcgcacgctacagcagcgtggactctcttgtcgcgagtgaaagcgtcgacggccggggtggccaccgccggtggacaggcacggcggaccggccggtgagagtgagttagtagtagctagctgggcatctgcgaagattgcgattcttatacgtacatgtcggagatctatgtgtgcataatgcctctgccttacgttcgtgtgtacgctcgccgccattgattgatcaccgcgagtagcggcgccgttaaccgtgtagaagttactgctcgatctccggatgtcggatggccccgacacaggtacaaaactctgaccgtgtacaactatcagctgtacatgcatatggcctcataaagttggcacttggcagtaaatttggtagctaggctagattactgatgtcaacgggttagatttggtaattggtactgccaatttatactaattaattaatagaagcgtacgtgaatgcagctacacgcccatggcaacttgctctgcatatggaagctgtcattgaccgtacaacgttattttctgagttactccatttcgttaattagcacttctgcacgagagaaatggattgtctcgttaacacgggggcttccatagcacttctgttttgttggcatgcatatacatggatgcgagatagaacagataaaaaaaatgagttgtctcgttacacggggacttatagagacaattgttgcctcaacctgcacatacgtacctgagtttcatgatcatgatggtatgtgttttgttgtggaatatatatggatgaatatataagttagtacggagtatattttaggacggatggagtaagcattatacaaatgatgagtaaatatgttaaaatactatgaaaacgatatgagagatcaccggtggaggagaaaccatcttaggtcggtcgaccaaattacacaataatccggttgcaaaaaaaaagactaaagatcatttttagttccggttaaaaaaattttgatctttagtcccggttggtaacagatcatttttagtcccagttcaaagaagttggtgggtcgagtcaggctccaattatctttaatcccggttggtataaacaactgggactaaagatctatttttagtctcgattgtttataccaaccgggaccaaaataaactgccaagccacgcgctgaacttatctcctcggtatcccctccccttttttctctcttcattaagactcggtatcccctccccattccttctctcgaagtctcgatcagagagaggccctctccccttcccccccccccccttcccctctcctccgatccccctcccggcctcctcctcctccttcccctctctgttgcggccaggcggcggcgatggagcgagccgaccgcgcggcaggtggccgtgcggcgaacgggtggcggcagccgggtggtggcggagcgaggcggacgcgcgacaggcggccatgcggtggacaggtggcggcggcggccggtggggccgcgcctggcggctgtcggggccgcaggcggtggccgtggcgggcagcggcagcggcagcccgcattgttttcttttttttattaatttgtgattatctgagatgtacttttgtatgcataattttgtgattcattgcacatttgtatggatctgtgatgtatttgatttgtttgtaatttttataggatttgtgatgtatttgatttgtgtgtataagtaactttaagatttgtgatgttgatttgggatgttactttgatttggggatttggggtttgatttggggatatgtatcccacttgattcgggagaaaataaaaaagaaaaaaagaaaaggagacctctcactgccgctaccctctctttagtcccggttggtaacaccaaccaggactaaagataccaaccggaactaaagatcgatctttagtcccgggtatttgaactgggactaaaaatagcgatctttagtcccggattcttactctcggttggaaaaccgagactatagagggttaccaaccgggagtaaaaagggtttttgcaccagtggatggtgattagatatgtttgcatgttgatatgtataattcattaatttgtgatatatgcatgtataagttttgacatgtaataataattgatagggcatgatgacgtggtatgtttgtatgttatgctttttaagtttagtgggttgtaggtatatagaatttatagatacgttatggtccgaaatccccgctagggatggtaattttgcccatgggtccgggtatccgcggatacccgacccaatgggcacgggtgtgggtgtgattttttacccgtgggcacgcccgcccgaaacccgtagacatcatgggcaacagccgagtttcatttttttcctgtgggtaatacatgcccgacccgatacatatgtattagctaatttcaacttatctgttaattcttataccctttcttttggtttatttgtgatactaactaatataagttgtgatgtaatttaaattattattgataactgataatttggtaaattgtcgattttatttctctttgttaaattatatatctttcgagttattattcatatgagatccatgggtacccgccgggtatatccgtgcccgtcgggcatgggtacggacacagagttttacccgctaaccctagtgggtagggtttgggcgggcgacggcgggcatgggttcgggcatggttttgctctacccgtgcccgacccgacccgctgccatccctgatccccgctacaaggacctcatctttatggactactgctgatagcctaaaaatgtccatctttgcattcaagttcaatcataactgtggacgttgacatccacatgatggttgatgtgtaccagttgattgattccgcatgagaaaacaagaaaaggattcggtcattccattttgtaggcaaaaaaagaatcatttcgccatgaccaaccattaaaactagaattatttacagcgctagattggtaccggacagacaaaatctctgaatttatttcatcatctaaaaccaattatcttatctggataagacatcacagacgagattaatttttattgttttaacaaagaaaacaaaaagaaattgcagaggagatgagaaaattgagcatgttgccatgttcatgcatcttgatgtgctgatatcttaactaattcgccatgcttaactagcaaggaatgcttagtcaggtagagagatgaccaccgttcatagctttctttttcactccagtgacctgatcactacaccagagcttcagaattagaccaccggacacataaacacgtgaactgtcagttccattcgccatcgacaaaacgcattttccacaatccaatcaccggcattttaaaggcaaggcagaagaacaaacgttccagccagagataaaacgtcaacccatcgatgatatgcttgtgtgtgtgtgtgtgtgtgtgtgtgtgtgtgtgtgtgtgtccagccatccaggcacctagcagcagccacacaatacggcacaaccaaaaaaacgaatcatgcaaatccatacacttaatattgagaatttcttatatgttgtacattatcaggacacagcagcagacactggatcgaacagctagctaattaccaatgcacacaaatacgtgacaggaacgatcgatgtcgtgtacaccaatctttctatagtaggttaatttaaggaggcccaaccactgcatgtgacgcatgatggagtacgtctgtgtacgtggacgacggtgtacgtgcatttctgttactgttacacttactaccgacgccgacttgtcgccggctcgccggcggcgaccggcctacgcccagccgtgcgtagcccagctgctgccggtgtcgaccctcctgatgctctggacgccgcagagctgcaccatccacgggctcggccggaccccgaggcagaggaggcctccctgcttcgtcgacgccggcgaaatcgccggcggctgcggctcgtcgctggtctcgacgctgccggagccggagaagagccagcgggtggacggcgagggctgcacggccgacgaggaagacgacgcgcgggatggcttgccgagcgcgaggcggcggaagacggcggcgatgaagccgatcttgatccacttgagcctgcagtagccgcagtacttgccgcgaccattaacaacattcctgcggccgctacggccgtgcggctgcggcgacgacgacatggcggcggcggcgcggaggtggtaggacggcggcggggtgatggccgggacgccgccggcctcggcgaagggggaggaggcgtcgaccttgggcgtgcccgggtgggactcccagacgaaggggacggcgccggtgccggcgccgtagtagcggaacgacgggttgccctgggagctctccttggtgagcagccgcgcgtagaactcgccgtcgtgcgtgatgcgcagcgggctctgcggcttgctcgccatctctccctctctcactctcactgtctcggtctcacacacgaactgccactattgtgtgaagtggaggagtggatcggtcagtgtagggggtgagagagagagtgcggtgtggcgcgaacgaacgatccgagaagacgagagatccgatggcgcgtttttatacttggcctccagatcgatcggcgcggtcacttgcgactcaaggtacttagaggcacttttctcacccacttgatgacatgctggcgtcttaatttcagaggagtggacaagttagcgggataatctttgctcttttttactaagttgttttactagttcttgtagcttagcaaaccatatgttccaaaatataaagatttctaggttatttagtaactatataaaaaaaaattagtcacttcagttgctaattttggattactcagatttagagcatatgtgatttattttggaattattgacatgatggaatcatcagaattagtgtattttgatacaaaatttgaatcatgcaaatttttatatttcaatagcctaagagcccgtgcattacaacggaaaacaaattaagttactagcttattaaatcaattaataaacacttattcagtctaagtagtactatgattttttttattgaacaactaaataattttgaaatttggtgagccaattgtgaaatggggcgacttattgaaaagtggtgtaataatacagattgtaaatctagatgttagtggtagaggtggtgtgagtatgaacatcaccaccaacaacattttaagcatatagaaaacgttgatatatatgaaatgttgagagggatagagcggacaaggtcgtgagttctctgcctgagcctaacatgcttgatcgaacatgcctgctgtctgtttgagtgtaatataggtgcagtgaaacatgcatgaagcctgcctgccgattcagtgacatactggcgtgcagaaacatgcatatgcatgctccacacacttgcttacaaaaccattcggcgtcaccacaaaaatgtgttggtgggactcaattcaggttcaagtgtctgattaggcaaaaggaatttttgacacgcgaaattaatgccagttggaatctgacacaggtttgtcgaaatctggcattctggctgtcaaacttgggccaagaaaaatagatggaaaaaaacaagtaaaaaacagttttcgtgatatacagcagagtacaagtttttttaagaggaatacttatacaggcaacatagtacatgtaaaatagaaagtgaggtgaccactgaccaagcatggtccgacctggcccatgtacagcccatagcaaggcccagtcctcgtaggaatcctctgaaatggaccgttagtaccctactgggctaattaatttgtaaagcccaaccaatatccaggtcacgggctaatttcctatgtaggcccaacccactgtaatgggcctcttaggcccatctgtaatgcgttcagttcacggcgaacgtgagaggacgactcccttattcatggcaccgttccttgtgacaaaattacagatttacaggaacgaatgcagcgcagctgctctcactaaaacagcatgaccaacaaagacacaaacatgcatcatgcattcgaacactgcactagttattacttcgtccctacacagagagaagcgtgcgtgtatgtgtatttatttaggctccgtttacttcccacacaaaaaaatttcaccatgtctcatcgaacgttggaacacctgcatgaagtattaaatataggttaaaaataactaactacacatattgcaactaatttgcgagacgaatcttttaaacttaattgctttatgatttcaaaatgtgttgctacagtaatcatttgctaatgatagattaattagacttaataaattcatttcactgtttactgatggattctgcaattagttttttttattagtgtccgaataccccacacgacactctatataatacctaatttaatgttgaaaatttaaaatttgggtgataaacataagcgaaaaaatgaaatgaggtcctgtaattaagcatgcttactaaatcaaaccaatcacccttttccagttcagtgatgaggttttttctttttacagcggtcaatgtatgctccagtactccgtacaaaggggcgatggcaagaagagggtactctacaactgtacaaagacagtagtgagacatccatcatcacggtgacggcttcacgggcaggtgggaccgatgcactaccatgatcagcctcatactggtcatatgccccttcctgtctcctgcaggcgcagcgagacgtacgtacgagaatatggaacctcgaggggtttccgatgcgccgcagtgaactttttaccacacagccttctactgtagttctcgcgaacagagtgcagagacagtcttgcacttgcagtgcagcattgaggctagaacacgctcattacttctgtttttaccttgttgcttagtaccgtagtacgtgtctacaggataaaaataataatttaaaaccatgtcattataatttttcaaagtttaagatatgacatcgatatctcaataacatgtagaacccatatgagtcaatgatatgtgggtcaggatgacatatctcaaatnttacaaaattataatggcatggttccaattttccaaaaaaaaaaaggatcagatctaagagcaaaaggtcaatagtgcagcccactactagctccaaatcatataaagccaatgtaatagctaattcacacaatagttgcttactatactatttatacctggttctacctgtcatacacacattatatctatctgtagcccactgcccttctcttttttttaatctctttaaaatatgtttatagccggtttatagcctgctattgtacatgctataagtgcccgggaggataggttaaaaaaaacaaccataaaaagcgagatactccaattaaccattgcatgatgattcaggactcgtattagaaactgacaaagccctggtgccaccgactgcatccatgaggtaagccagattccaaacaagggcccacatttgacccctcctctcatgtgatgcggtctggcaggtgggcccggcgctttctgggcaccggggcccactgtcagggtctggtctctttagcagtgcagcttttggtttggattagtgtaagcgcgcaccgagtctgagtaggacaaaggcgtacaggacacgtcgttctcacgagtgcgcgcgtgcagcgcagggaaggaccgaagaggacgagtctaagattcaaaaaaaaaaaaaaaaggacgagtgtgaaattggtggatttcgccaactcaagattaaacattcagggattgtcctatgactttgctgggatttaaattctaaaagcttaattttaaaattaacaagcatagtggcccgagcagattacgtggctagtatcattatattttctctcatataatagcatatagtatcattatattttctctcatataatagcatatatgttttctcattatattattcaaatatattaaaatgacaatataattttaaattctgcaataactttacaaaactactaatgtgtaatattcatattatattttatatatgtgttagttattaattatttttaatatcaaattttagttatttgtaaattatatatatatattcctatatggactctagagtcatcttttaatatttcttttttaaaattctgaattttctgtaaattgtatttctatatagactatatgttcttcttccaatattatttatttttatttctgaatttttattatttctaattgtatttctatgtggactctaaacttaactttcaatatttttaaatttttaatttcgaatttatgttacttctaaattgtattcctatagatgtattcctttattgaccttaaactcttcttcctatgtttttcttaatttcgaattttagtttttttgtaaattgtatttttatacggactctaaactctacttttaattttattaaattttagttagttttaaattcctatatggactctatactctacttctaatattccttattttttaattccgaatttctatttttttttcttaattgtatttctatatgaactctatactctattatttcctaattgtatttctatatggactctatattctacttctaatatttctaatttttaattctgaatttcagttatttcctaattgtatttctatatagactctataccctacttctagtattctttatttttgattccgaatttcagttatttcctaattgtatttctatatggactctatactccacttctaatattccttatttttaattccgaatttcaattatttcctaattgtatttctatatggactctagtctcctcttctaatatttcttatttttttaattctgaattttaactatttctaaactggatttctatatggactctagtctcctcttctagtattacttattttttaattccgaatttcagctatttctaaattgtatttctatatggactctgctttttctttttctccgattgatgtgagaatttctaggccatgaaagcgaacatggaggctcctttttctattcctttaataatataatagattttgacattaacgtagttctttttaatattgacttttaaattgctaaaaacacgtatgtaaaagttttatgcatatattattttttattattaataaatcgcatgatttataatctgccataggtaaccgacgatggagactttataatgcaattttgacagcagtacgtgctgtacttcgtagtattaatgtggagtactatttatggagtaccctgcactgtttccgatttcgtttttatctcgccgacatttcatgttgcgtaacgtgtctcggtatgataatcacacaatatttggagtgctcgatttaagattggcatttcagcagtgccaacttaattgtgaacgagagaaataccaaattattaacattttagtcctcatataaaacttgttttgaaacataaacccttgcaaaaaaaaattaacacataaatagaccatcctcgaagaaagttgaggtattgtctgagatgacatgaattttcgttgtcacaatagtactctattgtacgagtagttgaaaatgtgtacgggcggggtctgtttgggaaggagggacttattccaagttcttgtcacatcagatgtttggatactaatttgaaatattaaacatacactaattacaaaactcattccataaccttggactaattcacgagacttttgagtctaattacgccatgatttgacaatgtgatgctacaataaacttttcataattatggattaattaggcttaaaaaattcgtctcgcagattactctcatttatgaaattagtttttttattagtctatgtataatactccaaattagcgtccaaacatccgatgtgacatggactaaaaatttagccccatctaaacaccccctagctagcaag

SEQ ID NO: 64719 - DNA, 8424 bp, Oryza sativa
tggttttttcccatatttaatgtcccatatatgtgtctaaacatttgatatgatgtttttgaccaaaattttttgagatctaaacaaggcctataactattggccgtgtacatccatcttgctgtagtggtcgggttttatataaatcttttatctataaaaaaaatgatactcattgctagcacatgtatttaaagagttctacacaacaatggatgtagaacatattgtgataattagttgaccacgcaatgaatcttttgccagaagcaaatcagaatattaagatgatatgggtctcgtgactcatttctcaaagctgttccatggaaactgaattgaaaattacacatcaacctatatgaacatcattaaagatcgctttctttgttaactttaccaacatctgaaagccattttttcaatatccaattgatttgaagccatttctagatagagattagaggaacgctcggcagagtccagcggaactcatgatacaaaaatcaagaagccaccaagtcgtttgttttcatagttcatgcatcatagcacagctatctggattcgagtcccagaaagtaaaccggtgtggatgtatggctaccaggaactccacagtgactggtcgatgataagcaggtactccatccgtcctaaaatataagcatttttaaatctcgccacaatcttcgagatgttactttgactaacaatatctataaaaataaaatattttaaataaaaagagttgtatattataatagtttgattaatgataaatctagtaacatcaattttacatgattgatcttttttattttattgctattaacaggcaaagttaaaaatagttgacttgacactatgctaaaaatgtttatattttgggacggagggagtacaaaatacaaatccacgcagtgaacggagctaatagctgaaccatcgaggctcaaactgtcaaacacaggtaccaaaacaaagcattggtgcaaactcagcatagtagtactttgccagatgaaaaatctgataacaagacatagttttataaacacaatcgtaagttacaacaatacaaagagtgcactctaaaccatagcaaggaacaatccttcttaagcatctaaagctagcatagtgtctattttctagtttttttaatagataatggataaaagccagcctttgcttctattttctagttgcttgccaaccaaaatgtaacaacaatctaaagacatcatgttcacctccttgatagaggaaggtgagacacaccagacaccttgacaactttgaattggacaccaagaatatctcccacagcatgacccttgcgaccaaatccagcaatctaataccttgtcctggataatgacaaaataaataagggatggagcaggcatttaagaaaatacaggatgaaaaatgtacattatcctcgatgaagttgaggcaacaatcattggacacaaaggcaacaatcttctccacactcatggatggcagaattagtccacttagcttcaataccactgcaacagatccatcaaaatctcattagattaagctcacagaggtattgaagtggtattgaaggggtgattcattgaataatataaataataattgtttgtatgctaccaagcataacctcccagatcaaaatattttgattacacagcaacaacagattggtatcagtgataattgaactcatgcaaaacgtactcattaatgtggtgaaaaggatgcagaaaatacacaattgaaaacatggaacacaatttcattactgccacaaaagagagtaagttgattatgaactgctatagtgaaccaggatagaataaatgatcaataactacagggagcagagtatggtaatcaagcaacagtagtccaattatggtatgttttcactcacaagcgggtgtagtaagcttttcagtgtgaagaagcagatttcacagagcttcattgtcaaggaccatgcaccatcagcattctcaacgagctgatgaatagattgtgtggcattgtagggtccaccacaacgtcagaaaccttcggtgagggaaaaactaagtgtcaacatcactatctgggtactccttcctgagtacggtgccaataccagaatggcagaatcatttcatcctcccagatgaaatgaaatcctttggtaaataaaatacatacattgcacactgtttgtatccagttgttagtcaacccaggaattagaacaggaaaaaaagattatgcacacagctcttttcaaaattttaagggtagccgatacatatatactaccaaacagaacacatcaggttgaatcgtgccactttgcttgacacgaagtgaaccacttaaccactgatgtgacaacaatttactcaacagttatatatcagtacacaacatatttttttttctaatgtatcctagcaaatactatcaaagggttgcagtagaacaaacgataagttgacttcaaagccaaacttgaattacaccaattaaccaacaagtttccatatccatagaacagtagtaccattccagctctagctagcattattaagtgtaaccaacaaccaacaaagacctccaagtaaggcagcgcaaagtatatcaaagtagagctccacatttgctggtaagcaagacaacaagccaatcatatcagcaagcaaactcagaaatgacaaactaaatgcacattttccatcggcagttgtaacccggcataaaatagcaggtcaaacatcatctcacacaatgaacgctaacgctaaaccaaagataaaaatagggtgtggaacaaaaagatctacatgtttaggaggacacgctatctcctacaggtaaaaaatgcccagatctacgagtaaagaaccctacaattgcaccaaagacccaaattctcaccattcccaagaagatgggagcataccttggaggcaatcgcagttttcgacctccttgcggacgacgtgcatggaatcgatgagctcggcgccctcgttgtagacgtgtagtgctcagacagcccagttgattccacccgcaacagattggtggaagacgaagttgtcggggttgaaccgtggaagccggaagatctggctgtaggccgcccagccgccgatcaatgacaccgtcgagaaatcgtagaacctactgaggttcctagtcgctgcgcagcggcggctgctgaggtcaagcgcgctgacgaaacggaagaagtcggagacgcccgtctccgccacggaatcggcgatgagctcctggaactcctgcctcgtttctgaccccggctcgatgacgtcttcaatcaaagacgttggacatcaggttcatcacggagccgaaaacggcgagcctgacgcggactgggcgcccagagagcgcaccgatcgaggtggtcgacgagctcctagatgccgcggctagcgccgagccgccggcaagtaaagagcagtctgcttgtcaaggtgcgccatgtgcatcactgcttccacagcaggctagagatcggcagccacgccattgagatggtcttggtggcggaggacgtcggcttttgtccgccacccaccgggaggagatttcgccgtccttcttctggaacgcctcgttccttcgtgccccgcatccggagacaacaggtcgtcgtgccgagccgcagcgacatgatggtttccgagcctcaacaacttggccccgatctggttcttgcattggcctctcccggccatggatgtgcaggatctcccttgcatttgctcattcaggttgcgtgccctgggccaggatgcgcagcggcgaagggagatctcaaccggaggaggaggagggggggtgtggaagcgccggggttcatggggattggggaggccaggtggaaggaagattccggataaggggaagtggacgaaggtggggacggcgacgacacatggagtactactacagtactatgttactactactctactagtactaccaatcaccgtgtacaagaatgtgcacatgttgaactgtagtaaagtacttcatttggtactgatactgtacgtgtcaacgagttgagacccgctcggatgaacgcggtacacggttatgtgcaggcccgaacaaattcactacacgttagaacctgattatttttaacccgatcgggccagcagcaggttaaaatctcccagggcagactggtttcttcgaccgcacgacaccgccacgtcgacaaccacctcagcatctgtgggggcaggctttcttcccccacacggcacagccacgtggacaggagaacggaaatccatttaaatcccacagatccccacgcagacgcacgcctcgctatccctcgccgtagtcctcgccgtcgccgccgctccgaaaccctccccaccgcttccgctccgcccccatccgacaaatcatccaaaattcctcctccaactctaagcctcgggacgcatcgaccgctacagcgctatcggagccccggatggcgccgccccctccttctccgccgcccccgtctccccccccggcgccggcgccgccatcttcacggtgggacacgccggtgccgcagtgggtgatactgtggagggtcccacgagtatatccggccgacgtgccctccaagggatcggagttctccctcgctctcgcggctccgccacggatcagctccctctccctcgcggcgccacctcatctatccagtgcctacctcacggcggcgccaccgcagatctccgcccatggacgcttcctctccggcgacctcggcccgttcgcccccttcgtcctagcggcggacgcttctggggtcatcctcgtgcacgcctactccgcccgtgtcctgttcgaccacagcggcagcggcagcaacagcggcagcggcagcggcagcgggggcccgttcgtcgccggcgacaagggtggttcccgcataggtccctgcctctacgtgattgacacgttctctgcggcggcggatttcctgcccgaccgcaacaccaaccccgggctgaccaacttcgctcttgtcgtgcacaatcacgaaggggtcgtcgcgcgtagttactcagtcatggaactggttctcgaggctgacagtaataaggcacagctttgggaattcagttctgcttccggagtatggtctatgaagacactcacatgccccatccacttaccatggaacagtaacatttcattcgttttttgagggcaagatttggtgggtcgacttgtgccgcgggttgctgtcttgtgatttcagtgctgagggagaagaagagctcagtatgacgctacttccagatggcttgcatgcagaggaggttgaaactctttctagtgtttgcgtcagcgagggcaagatcacatacgtggctgtatctggacatcctgggggattaccttctgagggcaatgttctcgtctggatttgtacagtgactcctatgtcagtcatttgggacacgatatgccatgctcttggtctgcagaggggagctccaccagtgatcagtgtgcttgaccggcaagatgccagcgtgctctacttctttatgcagcaacacctagtgggattccacctcacaagaagactggtaaaacattcttgcatctgtggccatcaggggggcacttctcgaatggttctctccatgggaaccccttccaattgctccaacacaaggtgatacgaatttcgaaattctacgttgttcttgttgtttattattttgcacttcttgtttattgcttggaagtgcgttttgctgcattgcgtacacctcgtgctcatgttgtgtttgttgcagtgtactagcgtcattctctgcaactgcaactgcaataggactcgtatgcaacattatttgtactaggcactaggactgagatggcataatggatattatctcgtgcattttttttgtttttctaaagaagcttccgttatgttaaatgttcacacaaattgagaagtcactgtatgtctgtataatactgaaactcctgcgcaaagttgtggcatgtcgtattagtagtggcactcaacttgcctttactcaaaactgtgctaaattggagtacacagtatgtgattagttcttgtttgctccttgtttggtttgtgattattaggattcaatagatttttattactagtacgcaacattatcataagtcatcttagcaacattaatttggggggtatggaaaccaatcaccagttctaattatgacttcacctccagccactgcaggggaagaagataaggaacagcatattgtatatgctgggattacaacagcggccgaagcagccctggagctgtttgaggctcgaatggattcgatccaagatggaccaccggctcatgttgtggttccaccggttcatgttgtggtttgtcaagtgaagaacgcggactcagggagcggacccccgtccaacacagaagactgacagccttgtcgtcgaacagtaccgaagagttgtttgactcctctcctcttagagtagtggcacattgagcgattgccaatctcatgaagtttggtttgtgatgctagtcggttcgaagtactcaaaacattgaagcatgcattatggatggaaaaccttctaaattctcatcttgtcgactgagtaggtaaattttgattgactcgatggtaactttagttagggcgtgccttcggatgattgatcataccgtgcctcattggttcgcagccaatcttaaccaagccaaaaactccgttttgtttggtttgtaccaaaaaaattgtcttgccaaattactttttttattcgtcttgccaaattacctagtttaatgttaagatgcaacttggatagcaaaccaaacaaatgctagtcatttgcgaaaaattttggcaatggccaattcttgccattatattcaactcgttgcattaaatgtggagaccacggtgttatggtcttgtggaaggggtacacggtatagacggatagaccggcttgtctagttgtctccccgatgaacggtactaggtcggcagctttccccggctacgtccgcatgtagatgtagtacagccgaggccgccgacgagaagagcaccgcgcgcgtacgtcggtcagtggcatcacgattcacaaaccaacacgacttcacgcgcgcgtgaaatgggaccgtcgtatcgctgaggcttgcaattggcattgcggccacactcgatcgtgctctcgtccccagacgcggtgcgcgccgtctccgttcgggacaaacgccgacgctatggagtgtggaagtacctgcacactactgcgcaatgcgcaccgtggtgagcatcctgtgcatgttagactctaaaaactgattgtgaacttagccaacatgatcacctcttctaggagcaagtttaatattatagccaactactcgtttcaaatcatctataatcaatttagtagctaactcatataatctttatctataaacatgcactacataatttatacttggtcccacatgttatacacacatatatcttggagtctgtaccgcaattagctataaatatataacccgctacttttctctcttctcttttatcttctcgacagttggctttagcttagattaactatatagctgcctagattttagcttaaattgttacatgggttaactaacaaaagttatacgtggttgcaaacctcaaattaaaatgatgaaatgatgtgatactgaatcatccatatactaaatatattgttgtatttatatttaggaaaaagtacgaattacctccggactatcgtagtcgtccgaattactccctgaaccacaaaaccaaacattattcacccccaactacgtaaaccggacaaattaccctcctcgacccaatccgcggtggttttggtctacgtggcagtcaagtcaacaatttatttattaaaaaataggtggcccgtctgtcagtctctctctcttttatctctcactctctctctccacctgaggacggtatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaatagactttttgtagctgtacatatgtcaca

SEQ ID NO: 64720 - DNA, 2717 bp, Oryza sativa
gtctatttttactcccctattttttgtgtattgggccgagctgccggcccatcgtgccgggccggcccaacgtgccggtggaggggcccaggcacggctcggtggtcaggccgggctagcacggctcgacctccgtcgggccgtgccgtgcttgggccgggccaaaatgccgtgccatgggttgggccatcgggcctcgggccttttggccatttatagcctgacggcaacaattttttttttttttgagaaactgacggcaacaatatgaatgagtgaggagagtggattctaatctcgagggaatatcctctcgttatttgcatatcattcaaatgggttatgatttttgttaaaaaaaatcaaaaaatagattaatatatgataaatcactcaacggcaatgtatttaacctaacatatttgatcggtccaaaatcaaatctgtacggcaaaagccaaaggtgaaaaaatcgtttttaaaaaatcacaagatagatatgtagcaaatttgtgctctaaataggtgtttggatcgttagttttcataataaaattcattggggattggataaaaaaaagaaaataaaagtcctccacaacccacacaaaaaaaaaaaatcgacacaattaacagtaaattcgggctagagtgtttttgatgacacgataggatctctaacgataaacgtgacggttatttataccctgttaaatcttaacagaaaacacagacatacattcatctgttacgatcttttatataactccgataactagagccaaccgcaaggcgcaagcaactaatcaccggcgacgttgatggccaccgccggcggcggcagttacccgcggtgggtgatgcttgagcacaaaggtcacaacgtgaggagcttgaggaagcactccgccgccggctacaccggcgaccccaagacggcggcgagcgcctgcaccttctccggcggcccgtgcgtccgcgtctcgttctgcctcgagccgccaccggcggcgtcgcggatgttcttcgacttggagcaaaaagatctagatgcctccatgtttgtcgccgctgcccacggcgactccgtgctcatcaagatggaatactacgacgagcataacgccgacgacgcgctcgattacttgattacttcgtctacaacgccggcgacgccgcgcggccgccgtcgttgacgctgctgcctcacaactatgtcgatgcgacagagcaggacgagccaaatccagacatggatgtacgtgccaccggcatcctgcgccgtggcgacgacgagctcgtggtggcggagctcatcaccaaggggagcgacgacgacatgccgccgaacgaggccaaactcctcctcctccgctccggcgagtggagcctcaagcgggcaccgatcatccaccgcgacgacagcggcggctagggcgctgagctgtcagcgtgggaaaccgacatggtcgtccccgtcggcgaccggcggctgtgctgggtcgacctgcaccgtggcatcatgctctgcaacccgttcgacgagagcccccgactgcagtacgtgtcgctccccgtcgagccccccaagagcttcgacgacggccgcagggactcgccggcgaccaaacgaagtgtgtgcgccgccgccaccaccaccggcggcggccacgcagatgctagggaaatcattttgctgcttacataattttgtgatgcaacaggcatactgattcgataagtgttccatggattagcctaacaaacatctgttgatacattggcgcattgctagcctgtggcttacttactgctactcctagacaacaatgtaatgccgtgatacgcatatacatatgctgagaaatactccgtataaaaatgttacccccaaacagcccatggcggccaagccatgcggccagcgtccatggagcaaacactggacgccgcgtcatcgtggcggaggatttgattgattcttgtcgccgcgttcgggcgtcacgctagtgctggctgtgctgctgctaccggttcgttggagagaggagacgagccaccgagacggagcccgaggaggaggaggctccctggcgcgttcgcgggttcggtagagatgatgatggcggaggacggcgtgccgttggccgagtccgagtggctgcgtcggtggtggcggcgggactctggcccgctcgaacaccggccggctggtcttgtaggcagatggcctcctatgcacgtatagcaaaggaggaaaatgatgtaatcttgcgcatttgtcacatgtttttcattcagtttgttagctttggattctgcggaatcatcttgggcagactggatctggagagaatttgatgggcaatctttgatgaaaaccttacctctgggccagcactggaactctatgcaaaaactcttacctgcccttcaaaatctgacgagagtaaaggttggagatgggcagatggctcgaggacttctttctggcatgaccgttggctaggtattcagcaacttgcaaacctattcccggcactctactcgcactcaacaagcggtcatgcaaatgtcaaagaagtgcttagcaggggaatcttatcgtttttggtaccaagactatcgcaagcagcccaagctgatcttcataatttagagaatatgcttgcagcttgctttctgaatgaggaacctgacatcaggcaaaatgaggg

SEQ ID NO: 64721 - DNA, 33014 bp, Oryza sativa
cgctctctctccccggatgccgcccagccacagcgagccgcccccgtcgttccgggcaagcgcgtagtccgcgccgcggaacatagtcgcctcactctccgcgacgaccctcgccgcccccatgggcctctcccccgccgaggggaagccggcctggacagacgaacggtccgcggcaggcaggcggcaggcggcgcgagacaaggggaaggaggagcccgtcaccctgcctccgctccctccggctgccgtcctcggatcctcgcctgccgcccgcacccgcctccgccctcgccggcggccgtcgtcggctcctcacccgccgcctgcggccgcctccacgtccgccctccgccctcggccgcatactcagaactcggaactcaccagtgcatgcacttgttcgatctgcttgattcacatgctccttgctcaatttgggttccattagttgatcaaacacctgagaaatttatggatttactaacgaattcgtatgatcttttgtgaattgtgataatgttctttcgatcaggaagctggcaatgcattaaggttcgtaatccatttcataatattgtttcgtacgatgatcgtgttgttcttgctgagaaatcgagatggatgaagctgacatgggccattcttggtggcgtgcagatgccggcgttcatgggatgcgagagcgtcgagatcgaggtcggcttctcgacagcgccggcggagaactacggcggcggcggcggcggcttgcaggcgagcgtggagcaggtcttctccgaggacttcttccagcccggccgacggcgcctccacgtcgctgctccgcacgctgacgcccatgatggcctcgtcgtccgccacgccatcgcctcgagaactcgcggcgcaagtggcgacgacgacgacgtcgtcgtcctggctccatccgcgcccgccggcgccgcaccacttgtcgccgttctctcgccacggcggcgtcggcggcctccacttcccgagcgccgaggcccgccgattgctagagagagagagaggcagagaaggagagaaaaaaaaaagatgacaggtgggcccaccggttttatttgtttttgctgactgtatcgccacgtgtgtgccacgtaggctgaaaaccgcttagaatcgagttagggtgataatttatctggttttaagagtttgggtgttaaatgtccggtattgtagtttatgagggtaaatcgtactaccgcaatagttcagggggtaattcgtactaatagtctaatgatctaatttaaaattagtgatcgtccatatattagtagacagatacgtctaaaaccacatcaacaatcataatttctataattataaaagaagtgattagacatatcttacgtaattgcgcatatataatataaacaagagacgattgggtatatcttcctcttccactaattgctatgatatgcatgatgctgaccacacatttcactctacagcattatccatcgagccgcaagtgagctctctcatctgatagatggcacccctaatccctaatcttggcttcgcccttggctggcttatacggagtagtttcatgaagccattgaattcacattgatctggtattatttttatttcttttcattattctttagagcaggtaccataatagactataagtcagctagaagcttatgtgtggaggagataagagaggagagagaagataagcggactgcagatttgtaaccagttacagcacgaactctaaaaaaccatatatgtatgggggtgtttgggagagagtagggacttattgttttgtgagagggattaaagtttagtccctagtttccaaacaccccctatgacatgtgggaccaatgattaggcacaagaaccaagaaaatttatgagagagacatgtggaccatatatttatagttaagagctaacctctatatgagttggctaaaaattagactgtaaagatctatgcagtcaacggttggctatattagcccttactagcgtctgacaactgacatcgatcaggctctcatcttagtgttttctgggtttaccaacagataattcaacggcatatgctgatatccagccccgaaatcaaatactcccagcccaggtgcccaacgcgattgaaaaaagggttgattgaatccatgtcattataattttataggtattagagatatgccattgcatacctcttcagtgcattttttatttctttgggaccaaaatgccctttcgtcttcttctctcgctagcaccgctgtctttccgccggcgacgtcgccgccgagcgtggaccccggccggctcccgtggggttgtatcggtagatggggaggaggagggacgccatcgcgccggcggcaaagctgcggaggttgtcgggctagccgcggctatcggggacaatggagctcggcgaggaagcacggggacgatggagctccgccggcattcctgccgccgcgccactcactcccccgctcctgttgctcgcgccgctggctgcgcagctgctgtcgctcgccgcgtcgcgttgctgctgctgctgccaccgcggctgccgccgccgccgggccgcgccgctgctgcggccgccgctcgccgtcgggcctgctcctgctgctgccgcacgccgcgtcgcgttgctgctgctgctgccaccgcggccgccgccgccgccgggccacgccacgcctctgctgctgccgccgctctccaccgcgtcgcgcagggccgcgctgctcgtgctgctgctcgtgttgccgccgccgccgggccacgccgcgcggctgctgccgccgttatgctcgccgccgctgccgccgacgcaccgttgcgacctgagaaggaagagaggaggaaggagaaaggggaagaaggaagaagagggaaaaggggcattttggtccaattatttttaaaaatgcatccaagggataaggagtgacatcttttcaatgtgtgaaattataatggcatattttcaaatagtaaatagtaatggtatattttaaaaccgacaaatttttaatgacatgtatctaattaatccttgaaaaaattagacactcctgtccaacaggcactctctcccttctctctctgtgtttctcttcctctccacttcgtccgtttccaaggacgggatctggagcggcggcggcggcggcggggggcaagctaaggcccggagcggcgacggcggtggggagcgcgtccggagcacctccggcggcggcacggcgtacgagcccggcattgtgacagacgacatcatggtggcgatgtggatcaggcgacatcagaggcgtggaacctgcgcgcgtcggtgatcgaggcgcatgacctgcgggtgccggcgccgtcgcctgggctgccgttcgatgtgcgtgtcaagataaagatcgggttccagtcggcgaggacgcagcggtcggtggcgagcacgagcagcggctcggcgttcgcctgggagtgggaggaggacctcatgttcgtcgtgtccgagccgctcgacgagagcctaatcgtgctcgtcaaggaccgcaccatgatcaaggagccagctcgtcggggggcacgtccgacatcggcattgctcccggcggtccgggcggtggcccgccggggttctactccggccggcttcacctccgacactgcctagaaggaggcggcgcacgtgtgcagcgagtaccggccgacggcgaagcagcagtggaagccgccggtgggcgtgctggagctcggcatcatcggggcgtgtgggctgctgtcgacgaagacgaagggcggcgccaaatactcgacggacgcctactgcgtggccaagtacggcaagaagtgggtgcggaagcgcaccgtcaccgacagtccgacagcctcaacccgcggtggaacgagcagtgcacgtggcaggtgtacgacccgtgcacggtgctcacggtggcgggtgttcgccgacgacggagatgagcggcaggactaccgcatccggaaggtgcgggtgcacgtgtgcagagttacgagacggcgttgacgggggtgcagatacacggcgtcgtacccgctgctcgtaatcctcgatgtaaagtgccttgatgatgtgattaaactcttgtactagtatctggaatagaaatttgattctgttgattaagcatactatgtgccatgcgcaatgtgttgtttagccagacagcttgattatttctgtgcgtctaattgaattcactagatcagaatgaaaaggaattttatttctgcgcgtcgtacccgctgctcgtgctgctccgctcgccgctcggggctcaagaagatggaggaggtgcagctcgccgtgcggttctcgtcgccggcgcacctacacctcgtcgctgctgccgcagatgcactacctccgcccgatcggcgtcgcgcagcaggagacgctccgggccgccaccgtgcgcctcgtcgccgcgaggctggagcgctccgagacgccgctggggcgggaggtggtgcgccacatgctagacgtcgacgctcacacgtggagcgtgcgccgcgccaaggggaattggttccgcatcttgggggtgctcacctgggccgtcgggcttgcccggtggcgcagctcgtccaccaccgtgctcgtacacgtcctctaccagtctacctcgtcctcgtctggtatccggagctggtcgtgcccacggcgtcgctgtacgcctgtacgtcttcctcatcggcatatggtagtacaggttccggtcgcgtgaccccgccggcatggacacagagcccaacgggagaatttaactatttgctactgttaggtttgtcaattatctaaatacccctcttagatttacacttaattttttgccattgaagagagacaactttttttttgccacttttgcatgtggcataccaacgaggatgtcctgtcatcttcttcctccttcacctactctctatcttctcttccccttctctctcacctccggccatcttcgtcagtggtgagaggatgattagttggggggggggggaggggatcgatgcgatggtggggacatcggtggcgaagcaattagcgaggggttgatgaggagaccgctagagaaggccgtggtggcggggtcacgacgatggtgttcgccgcggcgggggtggtacttctcgtgtgcggcacgtcgctatgctgctcagcgctggcagcggccaagaaactcctcagcggcagggtctccatcgaggagctgtgcggtggcgatgacgaggagtgagacctgttcgacggggagtgggtgtgggaggcatgccccttcctcaaagtcggcttttgctgctccaagaacggccgccccgacgactccatagcgctggcgcccctcccgctgcgatctccccaggttggttgcttcctcttcttcgatcaatttctacttcttcctctcatctactatcatgcttgcattaattccattgttggattggggtggcttagtttggaggtttagatagaaatcgattctaaatgtctactttctgcgagcttgaggaagacctatgcagaaacatcttcactgagatctcttggtgcaatccaaacatctagaacattgcagagatggtgattgatgacggggcagcctcgttggcgtgccacgtatgcaaaagtggcaaaaaattaagaaattgtttctctctaatggaaaaaaaattaagtgcaaatttaagaggggtatttgaataattgacaaacctaaaagtggcaaatagttaaattccccgagcccggcgacctagaggaggagttcaacaccgtgccgccgttgtcgcttgggccctcgcccctccgccgctgccgcagctctagatcctgccccctggagatggctagagagaagagaaacagagagggaaggtagagagagggaggaggaagaaggatagagaggggatgacatattggcccatatgttaatgggcgcacaatttttttaatgatgaatggggtcatatatgtttttgattctagtgccacataagcgtcacatcaacaccatagaccagatcaatgctgtcacgtaggcgaaaccactcttcaaaaccacgaatggagtaaaattacaccggttttaatagttgggggggtcgagatatccgttattgcggtttaagaacacagattcagtcactagttaagggagtcaaagtggacttattgcaatatctgcagaggtccactagagcatgtgtgtgcatgcatgcaagggcccatgcttaaactatttcttttgttataaagtatttatttttatctgattataatattatatttaccacaattaattttttaataaaatgttacatgattatattctgacaaaaaatatgtgctgcaattaaacctttgtgttgcattcaattttttttcaactagcaaaatgcccgtatattacaacgggtaaatacaattttaattatacatatgtatattctgagtattcctcattaataagtagtcaacacaacaacatttcaaacacggtgaatgtgtatggagcataaagtcccttcagatcgattgatgtatgctagaaaattgaatcatctattgtgcaacgaagatgctcgatgtatagccgggtctctttcaaccaccttcctcaccaagctatcaatcacaaggaagtctaggtttccaagcaaccacctaggattagcaagtctccaagcgaccccaatgtccaagcttagacgacgagccccggtccaccagtgaagcttgttctaccatgcaacctcctagaagatagctcggattccactaaattacctctttccttgtggaggtgaggaaaaccttcacaaacttcccgcaactcaccacacacttgggggctcaccgggcgacgccttgccgtctaggaggcttaacctccaagagtaacaaacacaatgaaaacttgcttgctatgaactcaagtgctcaaagatttgagtaaagctcactagctctcaacttatgttcttaaactctctctcaaccccaaatcccttctcttctcaaatcctcttctctaatctcactcacaaagagttctaccacaaaggtaggatattggggagtggctctttggttttggatggttctaatcttgcccaaagtcagcaaccatggatagagggggtggagggatttaaatacccgagctcttcaaaaactagtcgttacatacaactttgcacagtcctagagtatccgggtcccatgcccggagtctcctggacgccctaaaacctagccgttaggctcaggttagtataggcccggagtctcctggatttggcccgagtctccaggaagccctttcgggtgcccgaggttcaattttggagcctcctggaagcctcggcatgaacaggcctggagtctcctggccacctaacaacaccagaggaaaaaaccataacttcttacttcggagcccgatttcaacaaacttaggctttatggaaagcttattgaaagggctacccgaccccaccaagaacaaattctaaaaccactcataggataggctaaaacttgggtctctctcaagtagcacttgcataggttactttaagcaccgagacataaacaaacacatcaacgttgcattcctcataatagtacgagattcatatacccaattgcaaatagaaaagctataccaataggaataccttcacaccattctctttcttcacttcgagggttgtcaacatcaaagtcgtttcaccattgggacattctcatacaactcaacaagcacattagtcccagatcaattatacctttgccttgatcaatgcccttcttgattatcaacgaatcaaatattcttgatctttggctttgcatcttccatttctcaaatgattgatacagataatccatagtttcaaatggcctcgcacgatccgtcacgacaatgtcttcactcgcccttctccaccggatttggttcatcggtgccaagtcccttgcttgcccttcaccaatgcatggtccatcgtagccgagcttcccttgcgcttcaccgtcttgccatagttagccacttcatacctagatcttcaatctcttctctttggttctcatcaaccgataaactccatcttctagcttctcacaccattttcattttcatctcaatcttcaatcatggtatttatcttcttcaacatgtccatcaactcatgatgggatctcaccaagcattctcatcatcggcatttgactcttgttgattcccgatatgtgaggtatcatctttcttgtcatcaatccacaatccgatcacttgatcctcgcatatgagtcgtcaacctttttgcttgatgccggaacataactatcatcacaaactcatacaaaggttagttccaacaaccattgtcattaatcaccaaaacaccaacacaatgttaggagcacggggttggcgagagcttgggcggatcgggtgaggagaaaggagaagagaggaaggagataatgaggatgacatgtgggccttcaaggatgattttgtaatttggtgacaaggtgagggacctcttttgtactttttccttttacttacgagctgtcgagctgcctataattacgtgggcctaaacgagacttgggctcacgtgaggcccataagtgggtgggccggaatgggactgcgattcgtgtgcgagccatattcaggtggaccgaaaaggtaggccgggttgtcggacgacagtacgacactcacgtaatttcttcttcttctactcggtttctcttactcttgtgaagaaaagggaaaaaaaatcccaatctcgattgctattcgcgcaacgcaaccacgcgagggaccctcctccgtcgctcagccaagccaccctcgccggcgggatccacttccgccggcgccgaagtacagccggtgagttctctgaaaccagtgaagtttttctgtatggctctcgctgataattttgggtcagtttcatctctgcatcaacatggttatattttctgaatttgttggtagctttaaggttaggtttcgctgcagatcttgcccgaaagagagaaaaagtttattttttgtgaaagaaaaccgccgccacctgacaagttcgaaccgaatttagtttctcatcactttactagcccgagtagaattttaagttcaggtgtacataatccgatttgcacagagaattctcctgttatatatgttgctgcagtctgcagaggcagacccccataactaaactaataaccaatcatcttgacgctctcatctcctgcagtttcagggattcttgtcatggagatgatgaaaagatgctcagacattcaggtatcatctactcggccgcgaaaggcgatgcgcattgctatcaactcctggtcgacgatcttgctccgttacatccctgaagatgtgctgttcaaaatcctctcatggctgccatccaaatctctcatccgattcaggtcggtgtgcaaggcttggcacgccacgatatccagctcccgtttcgtcaatgctcatctcgagtgctccaagcagaggccatcactgctcgtgatccctggctctttcgagatgaagaagaacggtgagaatattgccttcctgatgagcctgtataaataccaggatcctaatataatgcatctgcaggattttcctcgaggtatccgtaaatggattcgaccggtgcactgcgatggtttgctcctcatttctaccaggaagcacaagatgatgatctgcaatccatcgacaagagagattgtttccctgccagaagggagccatagcctatgtggcggcatggggctcggatttgggtttgatcctcacagcaacaagtacaaggtggctagagctttctaccaaagggattatccgacaacaagacaggtctgcaagtttgaagtgcttactctgggcactgatgcatggaggcaaactgaagatccaccatacccaattgacaggttaactccagttcatgtgaaaggagccatctactggaaggtttgtcgtacgccgctttgcccgtatccacccaaaacatttctcagattctgtttgactgatgagaagttcagtctgtttccatgtcctccatgcagtgcaaagccttactgtttcacagaagtagagggtgaattgtgttgtgcttgtttttacagttggacactggaactggagatttggacctgtagtgttgggcaaaaccctgaatggactctatgctgtactgtacagattacacctgatcttgttatgaatcactttgtagaaatacctcctttggttgttttccatagaagaaagctgctgctggcatccaacaaggtctaccggtatgacatcgaaacatgtaaactggagaaaatagcttcaacatttgaagacttcacgtgctgaaaatagcttcaacacccgaggaatggtgtgtaccaaacatttttgaagaaggcagtgatggatcttcacctgtttaattatgctgatagtctagttgcggttagtaaattttgagaagctacttctttgtgtaacaattagtttgcatctataaatctagttaattatactgaataggatctacgctactatttaagaattaagcgtaacggttaatttggcattccagtcataaatctcaggtttgcagaaatggaggctcattctgcaatctgcagcagcaccagcagcagctctcgtcacagcccttcttgctgttgctacacttatgagctgcaactttaaaggtgcagacagttagatatactgtgttgtcttgatacatagtaagtgatttttttctctgaagatgtactctaatttgcaatgttgttctgattacgaagatgacattctgtacacacaaaaggctggcatggaagaagttcaatgatgtgatgcgcagagctgggattcgatccttatcaactcttagttcttttcattaattaaactgcatttatgtgtgctccttttccttccttggatcagaaatatttgaccgttagggcaaggtttaatcaaacatttaaaactttgaccattaattttatattagaaataaatttataaaagctaataagcttatgatattataatagtaatttcaagacatataccatttttcttgtttttaaactaaagcatttgagaaactgttggtgataaaaaaaagtttgaccaaatcttagtagtgtcacaaaaaattgaccggagggaatacttgcactgacactatcctaatttgcctgcagaaatgtttgctacaaacaatctggccggcgctgtcggatcaactgtattcagagttatctgaatttataattgcggcttcgatatattaacttttgttttctttctttggtacatgcacagatgtgatggtttgtggttaactgcaagtattatttgcgaaattggcacttctgactgaaaacttaagccgtccttgcagactcagcagatggagaagttataagagcagaccttgcattgcctacctggagcaatgatgctcaagtaggaggtggtcgtcgtgattcctagtgcattttgaagctttcatggcttgtatataaaattggggcgcttactgcaacaaaaaggagaacccttttcatttcagggtaagtatatatggttcagaagaaggcaagttcaaccatagaaaactgtcatgctacatcaatctctctttgtcaacttgctcaaaataaatgtacaacctacaacttgtgcaaatatacaattcatcaatgtttgatgatcgaaccttccaaacaagtaacgtgcgattctgcaaatatatataactccggtgtataacttggatagcaaaaccgtacatgacaagatcaaaacacattcttggatcttgtgtgagactattagtagagtcccagcaggggtcttctgtaggattcaatctacaccttaaattgatattatcctttgttctgattatcataccagtataaacttctcaatctaaatttaaatattttagtttttcaatgatgaccatgctttgatatcaagattattttacttcttgttttatcttagagaaatacttccttcgtccctaaaagacagtagttgtagcaagtaaaagacatattatgtaggaggttaaaagaatattatgtccttcatttatcgatgagaaaacgaggagaatgagggaatgctactagctcaatgattaaaatgagaaggaaaaaagatgaagggagtactattggttcaattgttaaaatgagaagaaaaggatgaagtagtattaaaggacatttagtggacctgctctaaagaaatgaaaaaaaaggctaaactatacgcttttaggaatggaaggagtactagtaaatagtgagataattcaagagttaccgttagaaattactgttcattctacctcctccattcaaaaatgcgtattagctttcaaaaaacttcttttactattcattctgcttcctccattcaaaatgtgtattagcttacaaaaaatttcttttaccgttcattctacttcctccaatcaaatatatgtatttgctttcaaaatgcttctttgtctaatttagaagggagttccactaccaacatgtgtaattaactcaattgttagaatagcttccattgagtatttgcacctattgtttactttgttttctagtttgaaaaccatttgttttctcaaaacacgggaatggctaggattggccttttctaagttataggtttatttgaatttggaagttaccactcatgtttccataccaaggctcaatacagtcaagtttgtagtgtctaccgagttcgccatccactgactatcaacttaacctttttagcactgtggccatgtcctacatggtgaccaagtacgaggaccattgtatgatcttgaagcttaatgccaagcacatcgtgagttacacgttggcacacgaggttcatttcatggagaacaacatatcacgatgctcatctattggtttggcggcccaaactgagagatgtacttcactctactagtttggtggcccaaactcagagacgtacttcaccttcacccagtatagtcaaggagaggaagaactgccggtgtagcggctgacatataatgtcatcgatctccatcatgaggtggtcgctaaacccgctgctttttataaattatgtttataactagaaaaagtgcttgtgcgttacaacgtggtgaagtctcacatgtaccggtgtgctgcgttcgccatctactcacgagcctagctagttggaggggtcgaaatcgccgccgatcagggtacgtacatgtgtttccatctgttctacgaacatggagttgggtacgtaaacagaagatgcgaaatgcacgtacggtgaggctgggggttggtgttggtaatgtagattagatgggcctagagggcttcagaacaccatcaacgatcaacagccgtgattaatcgatttacttaatgaatagtcagatctttctgattaacgtgataattcctagaaagtgcttctagccggattagtataggtatagatcctaatgaaagcaaacatccgtttcgcctgaataaaaaatcacgtagcatgtgaatgatgacgacagatgaaaattttttcggaagtcttacgtatttttaattaggtatagatattgtaataataacttattaattaaacacttgataggttcgaatgcaaattatattaagatcatagggaaatctatggagttgtaaaaggtttaagcgaaatagttgcttcagtgaggcaaaagggggccatggcccccctctagaggtcctttaattttgctactttagtattaaccaaatatcaaaatagcacatactaattttttacattggtcccctcaaagctatagatcaagcctctcaatttaagattcaagccatatatcctaggatgtcatgcctacagcaaaaaaaaacaatgctaataaattcctgcaccattccctatttttatcatgtttgtgtattttccaaggttatacataaaaagctcatacattgtccatgccaccaaactacaaatctgctttttatcttaaccacataagtatgaattatatagtagacaaatctgctttttgaagaagaactttgtaactagctacccaatcaaaaccaattaaactatagacaatcagtccatgcatatcaatctgaagggagatgtgtgagatcttaataagaacatatgcaactagaatatcatttttttaaaaaaaaattcgatcgaagcaagggggtgtaatattttatcgcttaaatttttcagtaatgaacattcatctacgcaatagcatagggtagagttgagtacattccaacaaccttttcttggtagaacattatacacttagtgtttataattggggcactgattgacattctacatttcataaaaaaattatagctacatacattcaacccaaagaattgggcagatcgtgtcacttgtttatgaaaacgatagatgaactaaaattaatatcaacttctcatattcggcaacacttaaattagtgaaatctcagttggaattgttagttgaataacattcattttctggcctagattaaagaaaatggtgatgaagataagtgcaacaactatcgacagtcctgaagaagattttagagcaaggtcttcttatttttcaaggggcagagcttcacgtagatttagttgggccttccgctcgacaaaatttcttaagctcataagataaaacaattatgaggctgtattctaaactcccctttcccaaattatatctcctcattttccatgcacatgactgctaaacggtgtgtgttttgcaaaaagaaattctgtaggaaagttgctttaaaaattatattaatccatttttaaagtttgttttagctaatacttaattaatcatgcgctaatccgtcgcttcgttttgcgtgccaggggtgaaggttcccaaccctcactcatgaacccaggagtgattttcatatttttccgttaagaaaaaaacaattatttaggggcatttttttgtaaggtgggagcatgtttttataatatatttatttggtgttgaaaatatcgttatacttttccacatacttgatcaaaattgaagtgtttgacttaggacgaaatgaaacaccttatattttgaaacagaccgaatagtgcacttatgcaactattgggtgaaatctattttcaaaattaattaatgatcattcccctatcacttttattacattttgaagcttttgtgatgtcgacgagctgtacccgtctactgtatttatatagtatgtgagacatcggtactaaggtatacgcgagattgcagtaaagtaagtgggagacatggatttttatacatattcggacccccctactaacaagtaatagctctactcctgttggccgaagccagtgttgctattatataatcaatctcccacaaatacaatggggaggagacctaatctagtctatgtcagtgtagcggcataaggctcaaataggtggtctacgggtatctattgtcaacttcctcgaacaggccagaacatcagcgagattggaggttgcaataaatccctcttgttgacttttgcggtgctcattcgattgtattggcctcgtctgggttcgtcttagcgtttgttgatgtatctttgcttgtcccctctctcctgggagtcatgtatttataccctctgatgccccttatccaagtagaactacgaaggcaggtatggatattgtcagggttatggataccacatacctaatagtagttgactaaatctcggcaagacccaccacataccatgtcttatacgaaaacaaccttcggatataggaggagttccgcataaggaaggatgaccagagttctacatggaaacgactaggactactcggattgtatccatactggtttccctagttctacttggacaaggagacacctatgggtatagatacaaggtcccctaggaagagaagggacacacccaccatagaagacacgaaacaatagatcaagacagaagatcaacatacaagccaatatacgccaagacaagacgccagatatcgacttcagagataggcatggctagtcccctacggtgcctatggctaccgtcaggagagatatagcgctgtctctgacctcgctgggcacggattcgaggaggaaggctgccatgttgtcgactacaagtcagcacttcagaccgccaagtctacaacagatagatagtctaccccaaatattgtactggtgtaattatggtgaataagagcaacgaccggcttcggccaacaggatgtagggctattacctgacaattcaggggcccgaacctttataaaaatcatcgtctccatctcttttactacaatctcgcatatattctagtatcaaagatccccatactatgcaaataccggaatcgcgacatcaaacgtcgacgtcgacagatacgatcccgagtagaccttttagggactgaatctgaataggactttgtttatcttttcttatctaagactttttctatacataagaggatttattctgtataggacttgatattatggtgggccccaccaagtttagtacacatgtattgggtatcccatatatagaacactgacacatgatttatatatactccctccatcaacaaatataagggaatatgtatttcttttagagatcaaagacaaaaataaaagattatgatgcacctcactggatgaagagtggttggggatggaagggtgttggcgctaagatgtgatgaaaattgaatgagtgatgatcgatggtacaagtagaactccaaagtcccttagagcatcttcagcaattctccaatatcctccccatcccaaaatactgccactgctgagaatttgtgtgctctaccagtcccccaataacccccccacaaatttccaataattattggcaataaccagtaatccaccctagttctcctaaaatagaggggtgaaggatatccctaaataatccacccccaatcccaattaccatgcgaggtgtccgattccatgctcatcccgagctctaccaccttgccactgcccctcacaccaacactcgaaggagctccgctacgctaccccgccatcaccgccacgatggagccgtcgtgtgcccacaacatttccccaacatcgtcatggttgcaaggcctgctctagcattggagagtcgactctgccgcgtttccaccgcagagctccgtttgctttgagtacgtgcatgcatgtgttttcctcccgcctggagtagctctgccgccaccatcctagcttcgccgattggaggagctttgtcggtcggcccaccaccaccacctcaccaccatcgtcccaatgtctactagatctggccgtgaaggagagatagaaaagagtgatagatcatatggtattgggtcactaacaaatgaggccatatgtctggtggtatattggggatggggtattgtggaagtgcaaaagcaacttccgccaataatcctgaagtaatattaaggaggctctggggatggactattaggagactactgaatatgttcttacattagttaataaatggtgagatgtaaatctcttatatttatggatgaagcgagtcaaatactagcgagtaagagtgagcgagagggagggggcaacacatttcggaagtatgagtggctgggcatgatcaagttgaaccatagagaactgccatcctgcatctgcatcaatctctctcagactttctcaagttactcaaaacaaatgactacttgcaacttttgcaaatatacaattcagtgtttgacgatcgaaccttgcagaacaagtagcaacaggctacataacaagaccgaaattcgttctcagatctttgtgtgcactaatggagttgacgacgatctcgccagtgttcctgatctcacttcttggcgttccattgctgtacctgctatggagcaaggcaagcaagtccccctccggcgcgcctgctgcaccgccgcctccgccgggcccgacgccgttcccggtcatcggcaacatccccgacctcctccgtggcggcgagctgcaccgcgcgctcaccggcttagcggcgtcgtacggccccgtcatgtcgctgaggctcggcatggcgagcaccgtcgtgctctcgtccccggacgtggcgcacgaggcgctccacaagaaggacggcgccatctcctcccggtgggtgccggacaacgccaacgtgctcggccaccaggacgtctccatggcgtggctgccgagctccagcccgctgtggaagcacatgcgcaccttggcgagcaccctgctgttcacctcccggcgtctcggcgccagccgcggcatccgggagcgcaaggcccgggagctcgtcgactacctcggcgcgcgctcggggcgccccgtccgcgtcggcctcgccgtgttcggctccgtgctcaacttcatgtccaacgtcttcttctccgaggacgtcgtcgagctggggtcggagaccgggcaggagttccagcagctcatcgccgactccgtggcggagacggccaagcccaacatctccgacttcttcccattcctcagcgcgctcgacctcagccgtcgccgccgcgcggcggccaagaacctcaagaagttctacgatttcttcgacgatgtcattgaccggcggctgagcagcggcgagaaacccggcgacctgctcgactcgcttctggagctccacgccaagtcacagctcgagcgcccactgattcgagctctcatgacggtatctcatattctttaattaggccccgtttagtacccaaaagttttttccaaaaatatcatatcgaatttttaaatacatgcatggagcattaaatatagattaaaagaaaaaaaaatatacagttagaggaaaatcgcgagacgaatcttttgagcttaattagtctatgattagctataagtgctacaataatcaatatatgctaatgatggattaattagtctcaaaagatttgtctcgcggttttccaggtgagttatgaaattagttttttcatttttgtccaaaaactccatccgacatctgatcaaacatatgatatgatacttaaaaattttcatttcgcggcccttagttaaaataatttgactcgatgtgagaattaaaaatgctcatgattagacttgatgtgaataatttaatcaggatttgttcatcgctgggagccacacgacgacgaccacggtggagtgggcgatggccgagctgctccgcaacccgagcaagatggcgaaggcgcgcgccgagctcggggaggcgttcgggcgcggcgccgtcgaggaaggcgagctcgcgaggctcccctacctcaacgccgtgatcaaggagacgctgcggctgcacccgccggcgccgctgctgctgccgcaccgggtgtcgtcggactcggagccggccggcggcgtgacgctcggcggctactcggtgcccagcggcgcccgcgtgctgatcaacgcgtgggcgatcgggagggaccccgcggcgtggtcgccggagccggatgcgttctcgccggagaggttcttgggcagggaggcggactactgggggaggacgctcgagttcatcccgttcgggtccggccggagggcgtgccccgggataccgctggccgtggcggtggtgcccatggtggtggcggcgatggtgcactcgctggagtggaggctgccggaggggatggcgcctggcgacgtcgacgtcggcgaccggttcggcgccgtgcttgagctcgctacccctctttgggccgtgccggttaaggtttaggaaggcccaaggcctacaaaatttgatgggcctgaataccggcccatctatatgagtgggctgggatttaggcccatccgaacaaggccgttagggtatttcatttctgttcatctatcgtgtttatatttgttagtttcctttgttagtcgatcgtttatgtctgttcggtattttaggatggataatgatatcaaccaaggtgtaaaatgttcatgtaaacgagccggcctgccagcccactgcccacaacccatgagcccaactcctctcgaactgaaaatcattggttgttgactactactaataaacaaatgagtaccaagatttgtgcatatctgcaaggtgcttgtacactcgataccaatttatccactaatcacggagagatcatggtgggttgcattatactaagagacgagatgtgtatgtttcatcttaaaagataacagaatgatcaggttttcacattggtcatatatcacaaactcagcctctcaaatggtgctttgtgcactagacactcatcccataattaactaacaaacaccatccaaatctcctaatcttttattcacctcaaagtggtttatcctgtagggtcgcactcctatttatccacttaccctctatacacaatttactgtctctttctgacttctgattcctgaaacggcctgaatatttttgcaccactgattgagacatcaaagcagccgcccttccatttgtctactgcaactggcatcatcaccgaatctgatcggcgaaggcgtcagagattgctcgcaaacgcgcaaatctgggaacgaacaccacattcagggcggcgatcgagctcatattatattgtgatctctgaatttttgctacgaggagtcaaacaaagttgttgcattggacggcgtcagcagatgagggccaatccgttcgatcattcggccatcatatccaatcacaagcacacaactaggaaacacactgatgggcagttggagagaaacaatattcttgagcttttttttttctttagaacaatattcttgagctgaaaggtcaaaagctagccttcatgaaagatgaagaagcactagattggagtagttttaaactcaaagcatgcatgccatctgcatcagatattgtatagtttaggatagcatggatctcgaggattatatgttagtgggggaaaaaaactttgtttattatttgtgtgaaatgtggcaaattattcgcgtaatttggtgcaaagagtttatgaaaatggcgtaattgtagttctagaataccaatcatgttactactatttgttaggacaaggaaacaaaatccagtaaatggataaaaaaaaaggaacgacaaggaaactcatttgtttggtgtacgtttacattcttccatgtgcaaagatatagtgtgtgtgctcgtacttatgctacttagataagggcaggggcgaagccatgatttgagattaggggtgtcgggagatatgggtccgggggtatgcgaagtgtggggaatctaccttcccatcctgccgtgtgtccctacagcccggtcctacccccgcagtccgtgaaccgcaggagcggccgggggggtcagggcctcggggtgccacgtcatgcccctcgggcccttgcgccgctttgtcccgaggccctcgcccagccgccatttggcgggggagcgagcgaggagggggcccaggctgagcctcctttaatgtgcgcaacgccccaactgccccctgtcgcatttaatgcagtgagacagacgtgcggcgtgctaagctgatgcgccataatcaagaatgaccggtctgtaaccggtctgacgccggtcacatctgattggaccgacaaccgtgctcccacgtcgcgtctgcttccggcggagtggaggtaggtatgacctgtcccatcggagggtcattcggacggcggccaccacaagtcttcacccattaatgagggaatgacagggctatcccccgtgtcatgcgagggacggcgctgggccccactcaaggacaagctgttgcttagcttccaggcgaaggcacgggtcgagttccggtcaagatagggtgggtccccacccgaaagaagagtaggtagagacggtgcatgtggtatccccttgagatataaaaggaggaccttacccaccgagaagggggacgagactcagtaggcctgaactctaggagaagaagagcgagagtgctctccagactttaggatctctcgtaacactccaccataatcccaaacacaagagtagggtattacgcttctcagcggcccgaacctgtataattcgattgtgtgcgagctagctaggggccttagggacggatacgtggtttctagaggcgagtttcttcccccggccgaactcacgaaaggggggtctcacgatctcccgctatagagggccatccctcgacaagggggtgtaaggtgaagataaactataagaccgaataactaatattgatagcaaaggaggtcaaatagtcaccatcaataacaagcaatgtataaagtagtcctttaagaaaaacttgaattttagctctttaataatatcattgaaagtttaaaactagtctttattgctaaattcttttaatgtaaactattgaataatctcacaaataagtatcatctattttactttgaaaaagatgagaaatcacaaactaattttgtagatcatgtttcttgctaatatttttagacttgctaactaactaaattgataatactttcaagctacacaaaacaaactagataaatacttaccctagctaaccttaatatagagtaaaaacatgggggtgtagtgtttgtagtgtttggataggggggtgttggcaccctttggcacccccctagctgcaccactggataagggcagtcccagtacaagatactaccgacagtgtatatattcttcatgacacctagaaactagtataaggtccaacttttcccatatatatactggtacaatatgcaaatttaataccactactcttaagcaagatattatgtagaaactaagtcttatacaagatctaaaagatataaaagaacttccagttgaaaacttacctacttgtccaatattcataagctgtaggatttaagcacaaatggatggagtgcatgaacctatatataacttcatcaccacaccttcggttcttctccgatgcactgtcttttggatccttagggctagggggaaaaactgcgtcatgtaaaaaaatatagtttatattatgaagataataacttatgatttagtaaggctggttgggtaacggatatataaaatgcaaccgggtgaaaatggtacgataatttctgatcagtaccaagactgtttcataaaaataatactgtttccaaccattttcgtttctaatcatatataaatttagtttttccaatttctcttagcattgtattaaagttatcactaaatagttaaatttgtaaaaatgaaaattttcagaacatagcaagacagtttctataacagtactataaaactgatatcttttccgactgttttcatctcttgctatagttgtatacataatattatccttatgagctgaagtagtgagtgatctcagtatgtccacacaccacaaataaaatctctcccaaagatcgtgctccctatcatgaatccacggcagatcccataaggtccatcagagattctctagagtttagaaacataagcttcgataccagtttttataacccaataatctccatattgcatatatatattggactgtatggaccctcgtatcatggcctacgtaacctaaagacttactcccttcatccaaaaaaaaaaatcgaatctagtattagatgtgacatatttcagtacgtacaacgaatctggacaaaggcatgtccagattcgttgtactaggatgtgtcacattcggtactagattggttttttaggacggagggagtatctgatgggcaccaatcaagccaggactcgggaacattgtaaaatttaggtagtgtaagacaatacactggatattagctattcttatagcgaattttaatagacgaccatggcaaactccaatgcgaagctgccaacctagcatgcagggtggaggctccgcaactgctgatgggtgatactttttaatgttgtgttactgtatcaacaatatcttagagcaggtacaatagcatgctattagtcagctataaacatattttaatgagataaacgatgagaaagaagagcagcgggctacagatctgtagccagctgcagtacagactccaacaatacacactatatgtatgacgggtgggaccatatattaatagtatagtaaacaagtattatataaattggctattagattagttatagatggattgaagctaatagtgggctgtactattagactcgctcttatgtgagacaccttgttttaatctaatgctctcaaacgaaactgattccacaaactttggcaaagtgtactgttatgctgcaaacgagatcctctgtggactgtgccactactgacaggcgtacatgtcggcgactcctatatgctgctcctctaatcctcttagtggttgaagcttggcacacgttagctgtaacagtcttgttaattggttgtacccctagaagagttctcttcaatctggggatggattattgtctctggagggaacatccttccattttgtgcatgccatccaaaaaatcattaaaaaaatagtaaaatagattaatatgtgatatgtcatctaccgacatataagtttaaattcaaccaatacaattaggaaaaaaaacaacaaattaaactaaaaataacatattctatttaaagtcaatttcgttattttcgtctcttctcatataagttgaacatgaatttgtatgctcgtgcaatgttatatcacatattgatcgatcttattattatttttaaatttttttatggctttttaggtgacatgcaagaacgaccttgtcttctctcttccttactcttcatggaacgtaggccagtgtttgtcgctggccccgcagaaaagagcgtttcacgccattatatatacaaggccatacggctttgtctgcttaacgagcagcaatatcatccgaagagaacgaaaaaatggaagcttcaaccatcctatggctcctctacgtctcgctcgcctcttgcctcctctacaaagtcttcgtttccactaagaacggccaccccaagatcgccgcgcggcggccgccgggcccgacccccgtcctcctcctcggcaacgtgttcgacctccggggcgagctgcacctcgcgctggcgaggctcgccgaggagcacggccccgtgatgtcgctcaagctcggcacggccaccgccgtggtcgcctcctccgccgcggcggcgcgcgacgccctgcagaggtacgaccacgtcctcgcggcgcgggcggtgtgcgacgccgcccgcgcgctcggcacccacgagcggtccatcgtatggctccccgggagcagcgcgctgtggaagcgcctccgcgctgtgtgcaccaaccacctcttctccgcgcgcgggctcgacgcgacgcgcgccgtgcgggaggcgaaggtgagggagctggtcgagcacctccgagggcacgccgccggcgccggcgaggaggaggcggcggccgtggacgtcgggcgcgtcgtgttctcggcggtcatcaacctcgtctccaacgtgctcttctccgaggacgtcgccgacctgagctccgaccgggcgcaggagctggagatgctcgtcagggacacggtcgaggaggccaccaagccgaacctgtccgacctcttccccgtgctcgccgcgctggacctgcagggccgccgccggcgaaccgccgtgcatatcaggaagttccatgacttcttcgacgagatcatcagccgccgtcagaacgccggcggcgaaggcgaaaggaaggaggatttcttggacgtgctacttcagcttcactcagctgatcagctcagccttgacactatcaagacctttcttggggtaagcgtataagcttaatccattagagcgagcgtcctcacagtagtgctcactgacatatgggccccacagaccctcgggtccatatgtcagtgagcagtactgatctggattgaatcccattagctcactgaatactgaatactagtgcaacgtcattgaaaattttatccattcaaaattctacatcttcagacttttggactagttagaactattgctatccaaatttccggttctgaaatttcttagcagcgatcaaatcttctgtctacatcttcagacttttggactagttagaactattactatccaaacttccggttctgaaatttcttagcagcgatcaaatcttctatagatctattgaccttgacagcagtatggaggagctgatcaattttgaccgaactggcgttgtttacttttcgaacagtacaaagtatgatccacaaattgcaaaaccacttgttaatttattcaacggatgcatgcatgcatatgtacaatttgcttattccagtcaacctaaaaaagcctcaacctgagtaaggataaaacatcacctaatacaacgaatttagataagtgtattcattgtcaccctagatgatgtcttattcttgtcgatgttagagtttttttttaacagtgatgttttgtttggcaaatgagattgggaaataatatccgacccttcaaagagcagtattacattctagccattcattcttcacacctcatttaatcctagctatttatccatttccttttcccaatcccacctttcatatatcatttgtcaaacacacccatatcccatttgccaatcacaccctgagagtatgtatatgttcctaagtcaaagctgtcagatttttatttttttttaataaaaatttgaagttggcaagcagtagtaactagtaacacgttttggtacgtggcctgcaggatctgttcaccgccgggacagacacgaactcgatcacggtggagtgggcgatggcggagctgctccggcacccggcggcgatgtcgagggcgcgcgccgagctgcgcgacgcgctgggcgcgaagccgcacccggacgagtcggacatcggcaggctgccgtacctgagcgccgtggtgatggagaccatgcggctgcacccgccgagcccgctgctgatgccgcacgaggccgtcgccgacggcgccgcggtcggcggctacgcggtgcccaggggcactaaggtgatcgtcaacgtgtggtccatcatgcgcgacccggcgtcgtggcctcgcccggaggagttcgagccggagcgcttcgtcgcggccggcgggtcgttccgcggcggcgagatgctggagttcatgccgttcggggcggggaggagggcgtgcccggggacgccgatggcgacgagggtggtgacgctggtgttggcgtcgctgctccacgcgttcgagtggcggctccccggcgggatgcggccgtgcgacgtcgacgtcaggggccggttcggcacgtcgctcaacatggtcacgccgctcaaggccgtgccggtgccggtgccagcgcgcccgtgatgcgattctgcccgtgtcggttaagaggcagatcgatcgatccagctgggggtgatttagaattgcttcgtccacctcaaaatataaatgattttagatgaatgaaatatactacctccgttttaggttataaaactttttaatattgtccacattcatatagatgttaatgaatctaggcacctatatatgaatgtagacaatgctagaaaatcttataatataaaacagataaagtattttagtactacgtacaaatctcaaatcagaccagtagtttatccattcaaagtttgatgaatgatggtgatagagtgggtgacaaagttacaaggctaaaatggaacctgtgtcctgtcacaaatggaacaaaacttgtcgggccacatgaagttgaagcctatggtgattgattgggtatgtatgttgtgtttatatggttaaataaacaaacttaagccaaaaagggtgatgtcgatcgatattgcgaaatttgtttgtgcgtaccagactcaggggtccatttgacaaagtacaccttttggacttcaatccattttattggaccattttaactccatcagcaaatgttgaaaacaaatttaagtcctgattttttttaacaaaacattatttgactcaacaattaggaaaaaaaatttctacataatataataaaacaaacaatggtagttgtcacaataatagtagagcactactacaagatgctcgatccaaagcaaaagaaaatcaaggatgtttcatcatttgttaaaatttttcaactcatatcaaacatttgaaatacgtacaacattcagaaaatattaattgcaacactaacaatccgttacatagggtcccaatggctaaacatcgaagggaaaaatcaatttgaaatatcaatagagtcaaatagtagttgaaacaatttgtttcttgcacatgtttaagaattgaaacattttttataagaatatggaaacgagaagagtgagcaagatatatgatgtagtatggctaaccaatgatagccatcctagcagtttcatatcattatgtagtatatgattgccatttacacctaatatgaagacaacatttaatccatcatttcctcactcgtctagtgatgtgcctttagttagaaaaattacatgtgtgcttctatgtttttatcgatctcatagattgctatgttttaaaactctattaaggagattttttttcttgtttatgctgaattgaagactatttgagtttcctagaatataattacatgcatgattttaggttcaacatatgacaacgctaaattatttccttttagtagcgaaaggaaggattgtcattcagtggatattccaacaaagctgtaaattggaggtaactttgcagatgttcaactcacataaatatgtgaagggctctagatcgattgcattgaaatttgtcattttgttttattgttgaaaacttgttgttacttttgttctggtttttccactatttgtcgaatgactgtaataacatgacagttgggttttgtgcatctttgacacaacaaccaagttttacattatcctaaaaaaatgtataagatggtgcctcgacatatcaattatgacaattctataaatagtttgattttggattcaagatacaagaaattggtgttttaggtcatacacaacatctgcagtgttctatcaagggtagcaagtaagattatctatttggaattttagatttgtagcacaattgtgtataatggagagtattattttatacaaatagttttttcttgttacatagtactgatattttccttgtatgcttagttttcattatttcctccatctgaatcgttatcaccgtcttcttcatcatctgtctccatgtcgaggtcaacattatattcttcccaactcccaagggtcatacaacatttttctcggccttgcatttgctcgagcatatttgttgtaattttctggtacgtttgttctttcttcttgcaaagctcgaatacttcaatgacgctcagtattttcttcattaggttgctatcgaacttgttatccaacttaacaatatgaagacatatataagaaaaatgcataagcttttgaagtggtcaatcttcacaaatcaaaagtgcaccctgcaattttgcaagaaatttgtgttgtgaacacatatagttaatctaatgtccaatcaaggataaacttctaattataattttgagttcatagcagaagtgtatatatagtacatagatactccttctagttataaatatatatttgacgtttacaacaagatttagtcaagcttttgaaacctcaactattgttgtttattaaaataaacttatgaaactaaataagttcatgatgccatgatagtactttttaagccaattatatgcatactatatctttttcattttaaattaagcatgttcagttgtcatcactatttccttctcgttaccctccatatcctccttgttgtcttcataattaattttgtgtgtatgcactaaaattgttctggcatttgacattatttcacgatacatctgtgagcgattttttataaggacactactcctgtcagtaaattgttgtccataaacttctattaattaactgcataatgtgtggccaccacaagtatgataaggtttataaaaaaatatggacgacatgtggtcataaggagtaaagtgaccaacaacgtaaagtttaatgtttgacatgacaaccttttgatagcaaatcaaatatggttttattgtcagcgttgtttggaagtaaaaatatatattaatttgactgcaaaatagataatactatgtagtaagagcatcaccaacagtctaactatatgattcccaaaactaattttgaaggattttagtccaaaaatcagctccaacagatcccctactctcctacccgagttttggagttccgttcccccggttcctcgctccgtttatatgcgggcgtgaaagtcgctcccaatcacgcaatcccgcctctctccttcgttcccgcgcgtgggagatagcgatctttctgcatgtgaaagaaaaaaaacggaattttctcttggtagtttaacagaagggcccacttttaagttttggggattgaatttaggctatctgttggagggaggagttttttcacttcctattttcagtttaggaaactcaaaaacaattttttaggagaaaattatagataatctgttagtgatgctctaatccattccgaaaaatcaaataaaatattttctatagaataaaaaccgaaagtttacaggaaagaaaatcaaaacatagtaatcatcgatggaatcgaaagttcaaaacccataagataaacgtccaagcactgctggccaatgtcctcagctgccgtcgctagtcaccacgtactcactagctacctgcttcagttggcaagtagctcgacgagacgaacaaactatactcctacggcgccagcgccggtgccggtgccggcgacgatgagttagtactgctctcaccgcccgatgacgatcctccggttgcatcctcaccggaggttggcacggccatcctcttcttcttcgtcgcaccgttcaggattggcctactactactagccgatgcagaagccatcgccgtggaggccacctgatctttccggcctcctcctcctgccaccgtcttggtcgacacgacggcggtctcggactcggcggcgctagctttgagcagtttcttcttcagctgccgccaccttcgcaagcattcgcggctctcggtgatgtgcttcaggcacatgcggtagccgggtgtgcgtcctccctacaacgccgtctggtcgtcgatgaaccgcgtctgtatcttgtgcacttccgacgttcctctgtcggcagcaagacgaccgccggctgttcttcatcggcagcactaccagatcaaagatttgcataagagcatggacattagtaggggtaaaaattaatcaaccatatattagtacgagaagtatgtgtgtgtagcggagttctcggtaccagcaactgtgatcattgatatactcaaattaaacaatttggctctagcaaatgattactgatatatatatatgtataatcaaatactagtacactttttttagaacatataatcaaatgcatgatcagattattggtgagagatcatatatacattgttgtgttgtgcatgtgccttgtagagatatatatatatatatatatatatatatatgtaacgtaattatgaactagatagctttgtcgaatattcataacattttctccaagttcgttgtattattctaaaatacatcaatcgtgagaacataatataagtatataactagtagcgttattaactaaacaatgtattttttcgctggtagtactttttctctgggctaataaatttgcaactagtagctagtactgtaaaaattgaacaacacatgtataggcacaagaccgtgtatatgaaaaagagttgaaatcttctaataatttaagacacgtaatcatgcatgatcggtgcacttgccgaagtgaaatatattctaggtttaccttgacaatgtactgtacgtaagtctctgtgtctacgaaatggacattgctagctagtgcaaaaaaattaaaacaaaacatacatgtataatgcaagatcatagaaaacaggacagatagatatactcacataaccaaatatatatgtattatccacaaaaaaacataatcaaaatatgtttggttaaatgcgtgaagtgtgtctgccacacttgtctagctgtgcatctttttttacgttacacaaagttaaccatgaaccaattaatataatatctactaatcgtgtctttatttcctatatatttccttcatctaatctaaaaatatagttattcatgccttcaaaagtttaaaaaagaggcatccttacctcttctctaccaaggcattgtcagcctgcttgattacattcttgccctcagcctccttccccgcgtttacaggtacctgcatttaagattcaatttccacatgagagagatgtatatataaaaaccaaatttaacatatgaactaacgtaaagatcaaataattaatttgagtgtgggctaatctacatgaacttcaaattcatttaaacaagataaatgtgtcttctacacaatttcagatctatatttatatctgttctttttctaag

SEQ ID NO: 64722 - DNA, 2320 bp, Oryza sativa
tagcttagtttttcagttctgttttcgtagaaaactagtaaggtgcccgtgcattgcaacgggtaattttattaagtgaaaagaaattgagtgaaaatttgttaaactatcagaagcaatctgtcagcacgtacatttgtaatatctccaagcggggctgctcatatccaaacagattagaacgtatttggtacgaaacacctaacaaatttctacatgttaccatattacacatcaacctgaaacagttgaggacacaggagtagccattttggtcgtggaatcttgagatcaatgatctgaaagagttgaattaattcaataataataaggtgttgtgttcaaaaagtccaaattttgataacaatagatgtgttaatttataaaaacctattgattcatccttcctccgctttctggaatcacgtctcttcttgtttccatcttcctttagctcttttgtcaatgatgcgtacctctctctagcacgcttcctttttagttcagccgtactgagattagtaacatcttcatgcatgttgggtgtaccgtacgacaattcggctttgtctgtacatggtagccgcacatgcctaatgacagaagcgttattttcattgcctgcaccacaaaatcagaatgctgatgttagcctaaaacaaatatctcatatattaaaaaaaaaagaaagccaatataagtatgataccaaatccaatagttgaggctctctgaatcttagatgtagagttcttgttgatctgttgatagttctcacggtcttttggaacattgatttcactttggataaccgcggcatgcttatttgtcaacttggcattaatcacattagttatatccacaaaaagacctaaaggaagagtgtacgtaaaattaggaagcaaaaatatatcaattgagcaatggatattaccatggctggatggatgaaacaatgacatgatcttttggacgatattggtgctgaaccgccaccattgttatccattgcagaactaacttgtttagaagttaaccgcaactgtggaaaatcattgttcggtttcaatttagttcttcacaccaaaactggcacctaaaactgaaaatcatacatcatgatgtggggataatgacatgcaaaagctaccagcaaagtagatgagtagactgtactgcagaaaatgaagaaaaaaacacatggtgcatgtactgaaataggtaagatacattgcaagaatgcggatttctgaacttgaactaatgttcagaatgtggttttcaatactacaaaatattcaagataccattcttataatagtattcaaatttaatgtccatggtgttgtgcagcaaattataatgttgtttgagtgtccttaggcaaattagtgcaagatttgcagatccaaaaatgtagaggttaagaagtgcaggccttcaagttagtagtagtagattgcattctgtatctttgctacctaactaaattgtacagataaaccctattcagggtaataggttatttcagaaatacttgccgcaaccaaaattgtagttactcaatccatgatgctaggatgcctagtgatgaaagcaacacagcatgcatggattggggatataacatcagaacttcaaacttattacatttttttttttaaaaaaaagaagagcagagtccagatttgagctgttatctgaacaactccacaaaccataccaaatgtcaagaatggattaaaaaaattaaaaaaaccagagttattcagataaagggatgatggtctggataaaggaaatgtccttcattttgtcatcattttatcaattttaggtcatgttctccaggcaactacacaacattgtagtgcttctatcccgttagaatggctaacggagtaacagtctgaaacccctctaacaaccaaaccacgataaattctgaaccatgatatcttaatagataaagatttgtgatgaacgagagcaattgtttttattctaaattccagcacatgcaaaaaaaaaacaggaaaaatattatcttctcatatcaaccactcaaggaaaacagggaaaaaagagagaagaaactgcttttaccttcaattgaggtaatgatgaaccaaggatgtcgaccggaaacaacaggatatggacacatgagatctctgatctgcggggttatgcatggcgatctgctgaacttgctcaaattagcgaaatttctgagaatcgaaaagaagctaagacgtctattttcagttatttacttagagggtagaaaaggggaatgtaaataaaaatatattagcct

SEQ ID NO: 64723 - DNA, 5478 bp, Oryza sativa
ctagtaatttgttttctcatccttctccaattcatggcgttagtaaatgaagtttatcttccaaaaaaaatattgatcaatggttaattgggccagcttgttaacatgaaatcaagaataaaatgatatgattggccagccttaatacttaccaagaataaattgttatgatttgtgaaatgatccatttcctatgacatttctcaagaatactaatctacaatatggctgccattccatgaaagattggaagtgaggaagcacctagaaagagaaaaaccaaatcatgggacaaactcttagttccaaaaatgcatggttgtaccttcctgatatattttttttgcaggactcttaataggatttgaacaattgaaaagccatgcgtgtacaacaggaaatgtaaattcagtatgaaccccacaatagatacaaaggaagaatctgtactacagaaacacctctgaactttttgaagatacaaacgaaaatatgaattcagtacgaactcagtaatagatcataggttagctcttgcaaagtacaagtacaaagaaaaatcaaaggaacaaagatccctcttggaattcagaagatctactcctatattcagaatgaccaataataattcaaaaggtagatgtcagaatcagctttttgtacaatttataataggggtaaatttgcaattgcccctttataatatcagtaggtttcaataataaattatgaaaagaacatttttttttcaaactaaacagtagaccaccatatttttatccaaactgaacagtagaccaccatatttttatccaaactgaacagtagaccacaatatttccatttcatctttccccgggacagcatatgtttcttaaagatgaagtgatgaaccgacattcatttacacaaatcgcaggtaaaatctaaccccgacacattaacttgcaaataactacaaaaggtgcatgcatgcatgtagattttactctaatctagactacaaaagtgttgcatctgcattttctttcttaaaatgctctatttttcgctgaaatagtagccactggcagtgaggcatgttatgtacactcagccatcaatttcaaccagaaaattatctttctcacaagtacatggactcaattgttacataaaaaatacacaattgactgtacattaacagaataggatggtacttaatcatgcataggtggtacaatagcaaacaacagaaacagatcaataataacataattctgacccatattcttctaaactgtttaactcccttataaaaggaacaacattgcaggaagaaagtgactcaaactttgagctatcattgtgttgttatattgtgatagtatctgtccagccagatggtttatatcgggaacaagatcttcctattaaactttgaggaaaaaaaatcatatattggtacacagaaagttaaacaatttagaaggcaaacacataatacacagatccatgctcacttcaaatatgaatgaatagaattgcccgcatagcaaaacgattcacagaaaaaggcatccaccacaagctttaattttctatgtggagatatacattcgaatgtggcaaggtttaattttgtaattccacaacaagctacagttagatgatcaccttattgataagcccatcgtcgatcacagaaccattaatgctcttgaacagctcgaacaaagcctccacctcactaacgctaactacacatccaagacaactaattcagaattttcagtacgcccatcgagataatcagaccggcggccggcgggcttcgtaaagctttaggcacattacctgaaagggtttgaggcacattacctgaaatccgtcttcggtgggcagggggcgacgggcggatggctaggggaggttggaaggggaggcggccggtgatggttaggggagggatgagagcgcgcggaggagatttgcgagggcggcagcgagggagcgtctggagagtaggccggcggccgtggctgctgaggaggcgatgcggcggcgaggtgaggaggcgacgcagggaggagggcgaaggtggaggatcaatccgatgcgaggtggaggcgcggaggagattggagagggcggcggcgattgcaggtctggagaggaggccggcgggcatggctggtgaggaggcgacgagacggcggggcaaggaggcgacacagggaggagagcgaaggacgcggcgtgggggaaggaggagtgggcgtggggaggagatcgatccgagagaggagcgagcgcgtgatggggagaggagtgatcgcgtgatggataggagatggacgattgacgccgttggatatggcaattggatggttgagattacgcgtgtctgtcagacgcgtctgctatgtcaggaatcaataccaccactacggattttttaagtagtagagagatggagccagaatcggaacgtgggatggtgcggtcagtagtttgatccaataaaattgtgcatgtaacaacctcctagaacctagatggagagaaataaaaagaagaagaacacagaaaatgctgcaattagttcgcagccaaaaaaaaactctgtttttggcactctgtttgttgctctgcattctgcattcagttaactgtttatcatccgaaatattcagagttcttcatattagccactaaaactgtgagtgaaagagagggagtgatttctctaagcgctttctaataaataagcagctaaccatttacacatgcaaagtattttttaagcataggcaagaaagcgcctcagcatgcaagaaaaaatggttgccaaatttgccagatccgcataacgcagaacacttgtcaggcaaaggggccaacactactgctagagcataaaactcatcggctcgacggcgattgccgcggccgcggcagccacccggcgagtagggaagcggagaccgcggaggtggaggcggagcgaggcgcgggctcgtggaagatggagcgaggtgcggtgccggaggagcaggaggccgcggcggctgctctgaccgcgagctccatggatgactgcgacatggaagaagaagtcgaggcaggggttgccagtttgccacttgccagagtcggcgtaggtggcggagtcgttctcggtgcggccttccatggcttcggcttcgatccagaggtcctcccgctcctccgatgcctattagcctatctgtcaccgccaagaagctcgttgacggttgccacagcgcttgcctccaccttcgcgtccattaccgcggcgcccggctccgcctcctccgccagaatcctaatttgttcgcgcgccggcagcgcgcactcccggtccacatggcccacgtagggcgcgcgcgcaatttttttcgctaacctatcgtcgttttctttttttttttctcgcagtttgatgccgtatgggtaggagaaaaaattgtaattagttttagtagtgattagtttcctatttttactagtgattagtttactagtaattttttaatttgaacttaaaaattgttaaatttggacttgaaagttttcaaatctcgagttgaaagtttttaatgtcgagttaaaaatttttaaatctcaagttaaaagttttcaaatttgaacttgaaagttttcgaatcttgagttgaaatttttcaaatctgggttaaaagttttcaaaatctgagttgaaagtttttaaatctaagttgaaagtttttcaaatttaagatgaaaagttgaaagttttcaaattttgacttaaaaaattcaattttcgagttgaaagttttcaaatttgggtttaaaattttgaaaaatttgactacagatataaatttcattttcaatttgttagttaaaaaatctcacgaaaaaaagaaaatcctaactactaccgtcattatctctaactagattagttaactgccttaagtgtggaaaaaaacgtgcgtccctgacgcgtacgcgccgactaggacccccctcctccgcgcccaccgccgtggtgcccgcctacgcctggctcgctgcccgttctttcctgcctcgccctgtcatttttgaaaacaaggagaaaagtgagaaagagagagataggaggaagtgagagaagaggggagagagatgaactgttgaagagaggggggagagaggaggaagaagaggagggttgagaatgacacatggggcttacgtgggccccaccatttatatattttttttgaagctaatatgtgggtcccatgaggtttattattttttcgaatcaaattaccacgtaatcgacatgtcaatgccacattagatgaagaccaaagtcaaattagccacgtcagccaaaaccgctgtccaaaccaccgagtgatctcatctgcactggttttgacagttgagggacccgttgtatctggttttgaaggacgaaaattggattctttgaaggatgaaaattggattcgttaacaagttaagggaccttagatgaacttattcctctggataatgacaaccttacccttacccgattgcatccggcccgttgttcgtatggcgtaatagtccgaaagaccaggctgcagaaggccgtttgttttaatgggccaaaatatatcggcctttttcattcggcccaagaagagagagagcgcgtctaccggtgggtgcccccccgcaccgcaccgaacagcccactctttttttctcttcttcgtcttcgtcttccccgtgccgcataggcatagagaggcttctcccccccagatccgatccccgcacagagcccagatccaccgaccactcccccagatccaccccccaccggcggccgtgcagcggcggcgtcggcggccatggagaagccatgcaccctcctggtccacttcgacaagggctccccctccatggccaacgagatcaaggccgacctcgagggcagcgacgtcgccgccaaggtcgacgccatgaagcgcgccatcatgctgctcctcaacggcgagaccctcccccacctcttcatcaccgtcgtccgctacgtcctcccctccgaggaccacaccatccagaagctcctcctcctctacctcgagatcgtcgacaagcgcgacgtcgcctccggcaaggtactcccggagatgatcctcatctgccagaacctccgcaacaacctccagcaccccaacgagtacatccgcggggtcacgctgcgcttcctctgccgcctcaacgagcccgagctgctcgagccgctcatcccgtccatcctcgccaacctcgaccaccgccaccacttcatccgcaggcacgcgctctccgcgatctccgccatctaccgcctcccgcacggcgaccagctcctccccgacgcgcccgaggtcgtcgagcgcgcgctcaccggggagcaggacgcgtccgcgcgccggaacgggttcctcatgctctgcgcct

SEQ ID NO: 64724 - DNA, 691 bp, Oryza sativa
cctcctcgttgacgtccatggctgctgctccggagacgggacgcgcgaccggaggggagggagagagagaggagcgggaagccgggaatgggcgggggattgtggcggcgggttcggatttgggggtagaatttggggaggaacagggcacgtcttggcgggaagaggcgcgcggtgtggcgggaagaggtgccctttcccgcgctcgggactctggactatggaccacgtgacgtgaccgcgatccgtgtagtaaaggagtattgaattgtactgggcctccaattgaattcctaatttaaggcccaattcaggaattcaaacagggcctaaaaggactccacattttcatgcatgggctttctgggtctcacggcccacattaaagctacggcccaaatccagtaaatttaacagagcattcatcgccgcggttgaaatttctctcgaaaccgcaagaacagtagatgtttgtacatacttacaacctggagtagctgctgaatttcaactttgtgcatagaactaactaattacacatgctgattattcataagtctgtactattacactgcatagctactactcattgatccagaagaaaaaaaaatgttgctaattaatacacagccttggtgctgaagctgccatgggtgcaagaggaggagtcggcggcggcggcggcggcggg

SEQ ID NO: 64725 - DNA, 15498 bp, Oryza sativa
aacttgtcctttctactgtagtattataattctgggaacagttttatctcattgttttgaaggatagaaaatgcagggcaatctaatgaagttgcatttatcttgcattgcacgttctaaaaactgacgttgaagctgcactgcaagttctgaattttgcaatataccacaaagagttaactgagatggaagagcgtgaacagagagagatggaaatgaaacaacaagctgatcatgatgcaggtgcaagtggtggtaatgcagatgagcatagaaggtgagcatagtgcctgtcttcttaaaaatggtcctttaaaatggaaaagcatttgacactgatttctgcagtcctatttttaatgtaaagcaatgttctcataatgcattctcgttcctttttttcctcaataaatcttgctcgctttgactttgcaaaaaaaaaaaagagccacatttaactgacataatgtttattttgcactaaaatgcatccttctccattgacataaaagaactgtttgtagcatgaaaatgaaaggtcaatttcttttagaaatgaatggcgtgctatggaaaattgtttgtcaccatgcaaacatgtaaaaacatagaataacaactcaacactcaaaactgcagtattttcttaactgcaataagcttattttctgcaaattaaaatgaatgcagttttattctccagattacaatacatcgtgtttagctagttgctttcaatagtctcacatgtttttatcccctttcaactcctgccagttctggaaacgacccaatggatgtggatgtaggaaatgcatcgaatgatcaggatgttcctgcggagaggttactacatgacatgacctcaaattgcaaaatctgaatctttagcttaggtttctttttctcagctaattgtattcttcctgttatgtcatatttctgcagaattgaagcatttgaggcgattcttggtcagcatgtgttggcaaatcatctcgatcaaatatcaattgacgaaattgagcaaactgttaatagagaggcagctgcaccttacaatagacgtcaagtagaattcattttggaggtacaaacaagaaccggctatgctttcagtattgtcccaaaattaactatgagatgccacttatttttggttcagttgtatttagtttcatttccttgttttttcagaggatgcaagatgcaaacaggataatgatacgagatggcatcgttcggataatctaacttcaaaaatcatgtcttgcattgtggacaagctgattactgtgcatcatccttgtctttttcatctgatacttagccagtttggcattgcagaatgtctgcatctgcaccggaggttgatgtacccgtgtatcttaatttttaacagcgagatttatgatgatcatctgtgtctttgtactttaaattcatgtaccgtaacgtaacaattctcctgatctagtgatatgtagtccctgattttatatggtcaccattgtgtgctgatagatagtctggttactgtcttggaatggcttccaattagatgcaactgtttcttcagaccacctgaggttacaaactataaactcgtttcagaagaaagcaccggtcgtaaaattgcatatactacaatcagctttatttccttaacggttataaagctcgttttcgcctttctttctttttctcttttgatgaaaaaaatgctcttttttcacatttgccagactgcagccagacgatggtttctctgagaaacaccaaggcaagttctaggctataccgatttaatgatagtatgtacttagtacggtaccgatcaatcagcttcagtgtaaagtatccgtgttaccgtgtggaccgaggtgcaagcagacatttgcacagtttcacatcaacttcatacaacgagttcatatttatatagcttggcttgttcgattgggaatttgggagacgacttgctccgtggacttgcaaaggtgaagaagtactactactagttggcgtcttggcgatggccagggatcgagccgctgccgctggcatctgatgaggaatctcccggcaaatccgcggtctctgcagcttcccgggtgagtccgtgtacgcccaactccgccttctctagcattatcacctactccctttttttttgcttgctagctagagttcaggctcgcagtcgtcgtgctagtggcctcgccgctcgccggccgatcatacgcacggccgtcggtcggttagttcgctcgccgctctcgatcgggctctgtacgtcttcggatctatacatgctactgcccgtcccgtatgaattgtactgctacgaattttaacgtgccttctggttctggttcaagtcagggttccaaaatgcagccataaactctcggttatcacaggtaaaatttgatgattttaaactattctttttttatttattgtaatggcacttgcgacaatgatacgtgggtcatcattttgacgctgcacaaaataggtttcgattatttggcatcctggtccattgttattggctcatatggctccacatatcgtcgagtgccaatacaatgaaaatggtaacaaataaattgtcaaatcatcaaattttacatagacgcttagaagaaaagagaagccccctccgtacaaaactcgggaggtggctccacagggtctctcggaggaccgacggggaggagcgcggcccttttgagggggctccgaagatgtctgaagcgtggactaactggaccttcggaggccggacaagatcgtggccaacggattctagagggcaggcgaagagctgagaagaaaaggccggagacaacctctgaagagaattaatgtgagaagacccgacctaccacaacgcattcaatacctcaccaaccagctgacacactccgccacagggcgcaggtggggcggatgatgaggcaactttaggggcatgcattagcctgactggtcacacacaagatccacgggtttccgaatgcctgaattaattgggcttgatctcctaggtttttaccattctgccccaagggctagggccacctgccagttggggtgcccttgtaacattccatacgattcatggggctatataagtgtattccgcttcccgaaggaggcagaagaaacagaaatagagcaatctcgttttcactctagactctcatcaatctctgggtgtatttagtttacgtcaaaattggatgtttggttgaaattggaatgatgtgacggaaaagttagaagtttatgtgtgtaggaaagttttgatgtgatagaaaagtaggaagtttgaagaaaaagttgaaaactaaaccatgtctctgttggattttgttccaacttccaacggatcgcattctgaaaccctacttgaaacccggtccattttgagtctcatcatgcgtgtattggaatcgatgacaaaaatgactggtaaagaaaatagcaaaatcccacgcaaaaatggagatcgctataactagtatactctacaagtagcgttacttaattaacgtgcccgaagtagaaatgtacaaagattttgacaaacaaagggatggcgatcaccaacgcgaggccggggaagacgagcgacaccgcgccggcggccaccgcccaccaacccctcgccctcgaccgcccgaacggccgcagcatctgcctcaggctcgacaccacggcggtcagcatcaccagcatggccgccctcaggtacacgtcgtacttcttctgccctaggtacaccgcgtacgtgcccgccatgagcgtgaagctcgtggtcgccacggccctgaaccccttcgccctcctctctctcgcccccgccgatgccgctgccgccgccgcctcaacgctgccgtcgacgacgtttgcgccgccttcggtcgtccacgccatgatggcgacgttgagcgcgacggcgatggcctccgggaggagggagagcatgaaccaccactgcaagaactcgacggcgaggatcgtggccatcgagacgagcgcggcgagcatcgcgcggttgaggtggccggcgaccgcgacggcgcgcgccctggctgacgggaacagggtgcgcacgggcagcgcggtggccgccatggcgagcacggacaccgtcgaggcgaaggacgccacggcgaggtccacctgcgccggcggcgagcggccgcagccatcgagcgacgaggggtacttgaggtagcccaggatgagagccccttcgatggcgaacgccgccgtggcgccgaacgtcgcgagctcggcgctgctcttcatcgcctcctcgtaggcctcgtcctgcgccaccgcggccgccgtgaccgccccctccgtcggcggcaggtcggcgccggcgagcatgccgagcacgagcacgacggggaggacaaggatcacgagcatggtgtcgttgtccctgtccatgagcgcgacgaacatcccgttggtcgcgacgaggaggacgccggtgagcgagacgagcaccgccgacgagaggtcggcgcagcggctgcgcggggcggcgggcggctggtgcatctggaagtgcatcagcacgacggcggagacgaacgtgacgagcagcgagaacccgccggccttgaacaggagggtggtagcggcgcccttgccgatgtccttgtagccggagacgccggcgacgatggcggagccggtgatcccgatggcctccttgccgaaggcggtggctcgctcgacctgcgtgtcgttgcgttgcgggaggaggtgtgcatgtggctggttttccatggatgctctcgatcgttgccgtattcgtgaagacaccgtttggtttgtaactttggttatatagcaaacatagccaaactaaacggtgatcatcgcgtcgcgagaaggttcagagaaatagcagggaaaaacgaaagaaaagtagaaaaatggaggattctgctgccatagcgtttttgcagcggttgctgttcagaccattatgcctgcctgacagtaatttccccttgctttagaagaaaaagaaggcacactatatattgttattggagaagtttattcatccctagagggaacgcccctcgctaaaaaataagtcataaataattttcagtatgtgatatataactctaagaaaaataaaaatttaactccaaataaaacacgtaattttacaaccatttttttatttttgtttctaattgtatagactgaatttgaatttacgtgcttgtggagtagcatatcatagttatctatctttatgacttttagagtttagacgacatgtgtaaaacagatgcacgtcccctagagaaaaaaaaaatccatctctgttattatttggttatgttgatacttatctatgtgtatgtgtatagccaaaaatagttatatttgagaacggagagagtggatcttttactttgatatactgcccttgtttagttcacgaaaaaattttttttaggtgtcacatcggacgtttgaccggatgttagaaaaggttttcggacacgaacttaaaaactaatttcataactcgtctggaaaccacgaaacaaatttattaagcctaattaatccgtcatcagcacatgtgaatcatggactaattaggctcaaaagattcgtctcgcgatttccatataaactgtgtaattagtttttcattttatctatatttaatactctatgcatgtgttcaaagattcgatgtgatgtttttaggaaaaaaaatttaggaactaaacaagaccctataccaggccctatatggtatgatccttttcaacgttctctaatttttaatacagttcagcttaagtcaaggtgccctttataatcccttgggattgccaagtcatgtctttcctctcaaaacacacaaaagctcggcacgttaatctttagacactaagagataattttacaaaacaaccatgcagccccagcccacaagaaatgccagtcatcattgtaacaactctgtagtttatcaacatagctgcattcagccattcagtgctgaacacatttttcatttatcagaactgaacaaaatagatagtaccttgtacataactttctaagagaaggcagaaaagttgaaaacaatgttgtgtaacggcctgttttaaagtgaggatcggcttaactactttctcgatttccgttagtacaccttttaagttgctaaacaatgtattttcgtgtgaaaacttttatgtagaaattgcttttaaaaaatcaaataaatttattttaaaaaaaatcaaataaatttacttttaaatatttttaataattaatacttgattaatcgtatactaatcccatttctcgttttgcttgcggttagtcagtcatttccaacctttctttaggacggaacctatcaattagtttacatctccggcggtccagcctatcaattagtttagtcatctgatcatctggctctagcaatttggcacagacctctgtaatgatgtgatcatttatagtaaaagaaatggggaacctcaggctctagttcaagaaaaaaaaatctggttctagcaatgttgtgcaaggaaatttctatgaaaacaaccttcctaatgcaaaccatgtacagatctccgcagagttattgaaatttcaaagaaacgggatggctgaacgaaatgacagttctccgtctagaaggctgcccttcgtaatatactgggcgtatgtgcactggtgctatagttcttttacacccaatttgacactctacacggaaggattctcagttttgcattgagaaataaatacagtactaattaagttagcttataaattatttcattccttctgcacgcaatgcgtaaatctggattccttttaaatcaggtgagctgaagtgaaggcctctactatcatcacaacagaaaaagtgagaggtgtctagttagtagctgtagagtgtgtggacttaccaatagacctcctggagacacaatctgcattgtaagcctcgcctttgattccatttttgcttgcattcttactgcagtttccgtgaccatgagtccatgaccaggaagttctactagtggaataagtaaccgtgaccctgtccagaaaattctactagtggaataagaagagtgttattgtgttaccaaccactatgctgagaaaaggccaacatgccattatcaaacttgacatcggtcagatttgctgcttccgttgagatagccgcaattttcaatacaattttctactagtagttggccatcttgaccacacttgattaacacaagtggggagattaaatgcacaatagaacacctaaccttgatgcttggtagccttgattgcttctgtacttcaccttcactacattggaccgtcaattcatcatttggcagctcgatagagtttcctgacataacagaccagccgacacattttgtagtgctcaaaactgcacaaaatatacaacaccttctgtacatgcctccccccttcccttagggggggggggatggataagaaagatgaagctgcaatgttactcatttatgtaagaactacagataaattatttaatctatggccaatgtcaataggacaaaacgtgccttcgattttattgacattccatgattctagcttggtttgtgatggacattgaggggaataaaacaaaacattcacaattagtcctattttttctttgtggagatggtaagttggtgatagaggtgcatgatgcagcatgctgtgactactgttgatcaccttgccatgtccaaataatatccttgagtgatggcctaatgtcctctttcatcatcctttgatactccaatgtgtcaccattagttttcttcaactcaactaagagaaaaggagcaacctcagaaacctctgcatcaagctcaagtctgcccttccttccttccttcgtcgtagccaatttaagcactccattgtcagtttttgtaactttgagattcaaggctttggccagttccttcagcttcacaagtacagctgcagctggctttctggatgtaaacagtgactctcttcggccatatctttcaccaaataaacctgatagatcgaatccagtagagagagaaatgatgtcaaatgcattcaagttgtgtaggtttggtggctcttgatttctctcagaactgatgcagattgttgggccagagaaaggagcctcacttgtacaactcttctttcctgtttcgttgttcaatgcagatatggcgatgggtttcctgtaccaagcacttctctttatccttgagatagacatcctagtactaggatcaggatcaaggattccataaaggagctcctttagctcagctgaaaaatgacgagggcatctatactcagcctttgcgatcttcctatacatttgtatgatatttctatcatggaaaggaagataattggccacaagcacaaacagaatcactccacaagaccacacatccgcctttgagccactatagcctttcctactaagcacttctggagcaacataagctggagttccacatgcggtgtggagaagaccatcttgtctccttgattcagctaacgcacttaatccaaagtcagagactttaagggtttcattctcatccagtagtaagttttccggcttcaagtcacgatgataaacacctcggctatggcaatagtccattgcagagatcaactgttgaaaataatttctcgcagactcctcattgagctttgctctggccattttgtggaaaagctcgccacccttagcatactctaaagcaaagtaaatattgctcttggtagccattacctcgaagagctggagaacatttggatgcctcaccaatctcattatcgagatctccctctttatctgctccatgaggccaaccttcaagatcttctccttatcaatcatctttatcgcaacagactgaccagaactaagattacgagcataataaacctttccaaaggttccttgccccaattgtctcccaattacataccgttccatcaacacactcctctcttccattatatcagcaccgcgctgaaattaaaaatgggtctactatctatagagtgttactgactggcacatatctctgcatttccaggtgaatcactttcagtcttcaccaagatgctacctgcaaaatgaacaggccaagaatggaagattagtccaacatctataacgcaaatggctgcatcacaggtattatacgaactgggaacatcaagaagacatttttttagacgttacaattgtggatcgatggcatctaattccagaagaatccaattttctcgcatccgcggaaaaatgcaatacatttgatttaaaatcactaacgatccaataggaagggaagaggttcccatagattcagtacatggggtgtagctgcgatcaaatatcagaactgaagcttcaccgaacgagacagctacaactgcaatctatgatggctagaaactcctctgacataggacggaaaaaagaactgaagagaatatatctgtgtttgtgacaaaaatggatgtccaaatatttgatgcgagcaattgaatcgcatcgggatgcatatattgttttttggctccttccaagtagcagcgaaaagcaatgctcgatagaaacactgaaataaactgttcttttgtcgacacatacggcatgaaatttaatgcttatgcatcattttttttttcatattgagtataccttcctttgagtttgttttctgttctggtggcacttggccgtgagattttatgggacacaacccaaggagaaaaaccgttaatctcgcaacagaaaaactaaagagaagttcccaatcaacaagaactcgaatcaaatcgagtgaagccggcaacaatccaacaacagatgccctcaacggagactagcatgacagatcacaatcgaattagactcaccgactcagctgctgatcgaggcagatccgaggctccgagcaccggactccattcgactcgatccggccgcgcggcaagcggagggcgatgattctctgcatcacggtcggggaggatatgccctcttctcaccctgcattacacggcggctggcctgctcgccctcggcgaggatgagggcttctgctccaaattcggctgatcggctccctcctcgtgccagtcgccgctcgtcggcgtcgagcgggtcgccgcggcgatgtggggacgaacaggcagaggcaggggcagaggcgtttttccggattggcccctccacttttgggtatttctgcatctcgccacatcatgtgtgggatgggatgccgatgggctccactaggcccatctaacaatccaatcgaataggcccacatagagaggccttgttcttcaaggcccaactccacgtctccgtgtttaggcccatttagcagtcacacacagccacatgacacactgtgtcactgtgtctggacgacctctcgatccagagagagagaaaaaaaagggccaggaacactgcacaatcacactgttggtgaatgcataaatcaggcatggtaccatcaggccgtgactattcgtctacactgttgatggttggacgggtcggcggccggctggtgccaccggggttaggtccatgaacagggagcgccactgtgggagcgtgagttccccaggtttttaccgcttcgggagaggtttttaactcgggcggggtgaactccgctgcgcaacacacgcgctgcccacttcacagggccaaccgtacgtgcgtgtggtgccaattcggcctgcgtccatgtgtgtgagctcagtaaaactcaccagcaacgcaccaaatgtctgcagatcagcagccatggctgctgcagctgacctgctgtgtgtgtgctgcctgctgctgcacagctgcaggacatgtcgtggcacgaggactcatgcccatgttttcgcgcacatattcaaacattacaatcggactatatgatagacgacgatgagtcttgttacaaatgagaaatgtacacttgatcgatctgttgcatgccccgtgcaggcatgatgcgagaactgaaagcaccgggagataactaggagtgaaaaaaaaaaggggagatatatatatgtataacatggcaaagggactcggccggtggtggtactgtgtttttcagtttttcactaggtagccaagaatgatgtgcgcagggatcacatgaagaggcgcctggggcagcagctttcctcctcatctctcctctgcgccatcgcctcgtggtaggcccaaccaaaagccacactgcaatgccacagttttcagagacgatcacgctggcccaggccccggccccccagctgccgccgtgcatgcgccgtgccaccgcgcgcgcgtggtaggccagtccaccgcgccaccatccgtcacgcgccccgcgccccacctgcaccacccatgcacgcatgcccccacgcgcgcgcgcgagacggcgagagaaagagagagaaagagaggcatgccgcaccggacgcgatgatgcagcggcagagacgacgggcggacggtgcgcctacctgttgtgtcacggcgccatctcggtggtctcgtgcggttggatcgagacggcgtacgtagaggggtggggggtgtggagtcgtcacggcatgtagaggcggttgcggcacttgcagcgccaggcctcggggtagtactcggtggtgacgaggacgccgggggggacggacacgtgcacgggggagcacgggctgcagctgccgcacttggacgtgcaccgcggcgggtgcgaccctggccctcccgacagcagccgacgccccaacccgacgtggtagtgaccaccaccttcctgcatgcacacacgcaacaccagttaatttaaccagccatatgcgtcgtcgatctatgcgccggccaggccaccgccgtcgtcgtgagcagctgagattcgccgtgctgctcgtgttgatggttgtgcagggaccattgagatctttgcatatgtataagcatctatagatgaatctacatgaactgatgttcacattcatagttataagattgagacacatcctaagttgctactccctcattttagaatatagtaacctagaatcggatggaatatattctagtaatacgaaactggatatgccctttccccctgtctggatttgtagtactagaatatgtccaattcgattttagatgctatggttccaagatagagggagtatattttaagacgtacgggtggaggatggagtatatgatagggatctgtttgaacctttcagtcgtgtaatttgactcgtcatcagcatgtagtgtatcatcagctattcagctgctggcgtcaaacgactagcgaagcacagtgcaagatgcctagcctgtgaggagactgacacggtggttttctgctactaccgctgctctttagctagtaggggagatgcagaactcaccagaaggtcgccggaatgggctcctgctccttccagcctcccgaaatgatctgttcagcgagaggcaactgaaacgagttaactcctatcgccaaaacgtgctaaaaagacgtagagttctgtgcagcagcacaagcatcaacatatctctagtggggttcttctctcagatccgcagagatcagttgatacttgattctgcagccaaaggagatacaccaaacaccaaaaaactcgctttctagctagtacagaatctttgcacgcaaagagcaggagagctgccaagaatcagctctcaactctcaagtgctagctacatctcacacagcatatgcttaccggagtaacggcgcacgtcgtcgtcgtccctgccggcgccgccgcacgcagcgatgaagcagccggagaggcagcacagctgcagggaggtcaccgcaaccgccgcgaggcatgcgacggcgagtttggatccgccgctccatctcctcggccgtctcgacgaccccatgccgcaggccggcatcatcagctagctagaagttaagaaaacgagctagctagctctccctagcttccacttccaccctttggagtggtagtaagccagctagtggctgaggaaggaagagatcgagatcagcaaaatggcaaaggtgatggcggaagcggccgaccggctggctgggctggccggtttgttgcaggcgcggggaggaagaagacacggagacgaggggctttgtacgtgcgcgcgcccgtgtgtgggtgggtgcgcgtgcttgcctttcgtcttgctctcggcgactgtagctgcgtcacaactgggagtgcaggtgcagctcccccccctgagctatgtaggagacgagacggtcaaatttaatatcggcgagcacaaagtacggcgtagggtagctgcatttcagtcgttcacctaagtactctctgatctcgatctctatatatctccttgttttttggttctagaaacagagatggagagcgcgagcgtgtacgccatacgtgcccggccattgcggcttatatatatgtattttgcacatgttgttgacatgcaatcttgttttgagcagcatatgacacgatgtttgggaggcccggttttcacgtgattgtcatataagataatgagaatcagatcgattgtttcctgatgaaatcaggatggggccggcaaaaaaaatatttgctggagtggtgagataaaaatatgcagtataaatcattgtgttctcataaggtctagtgatggcgtaaaagattgatctggttatatattttgttggagatgtcaaatgaatatttataatctatatacttcctccgttttacaatgtaagaatttttagcattacccacatacatatagatgttaatgaatctaaacacatacatatgtctagattcattaacatttaaatgaatatgaacaatgttagaaagtcttacattatgaaacggataaagtactttaaaaggctccaatggtgatggtgacagtaatatatctgttaccacccactaattaacacgtgagtaaaattaacaatttatctgttagagaacaacaccctccgtcctaaaaaaacaaacttctagggataaatctagacaaatgcgtatttgtccaggttttttcccagaagatgttttttatggtaaggaggaagtatgtctttaagaaaaaaaagtcatccttaaaaattcaaaagataatcttcaaaaatttgctctctaagtaaaatacaaaccaagcaatctaatcatttatgtaagaactacaaataaattctctaatctatggccaatgtcactaggacaaaacgtgccttcgattttattgacattccatcattctagcttggtttgtgatggatatagaaggaaaaaaacattcaaaattactcatgtcttttcactgtggagaagttaaggtggcgacataggtgcacgatgcagcatgctgtgactactgttgatcaccttgccatgtctaaataatatccttgagtgatggcctaatgtcctcttacatcagcctttgatactcaaatgtgtcaccattggtcttcttcaactcaactaggataaaagaaggagcaacatcagaaacctctgcatcaagctcaagtctgcccttccttcattccttcatcgtggctaatttaagcactccattgtcagtttttgtaactttgagcttcaaggctttggccagttccttcagcttcacaagtacaattgtagctggctttctggatttaaaccgtgcctctctttgaccatacctttcaccaaataaaacagatagatcgaatctagtagagagagaaatgatgtcaaatgcattcaacttgtgcaggtttggtggctcttgatttctctcagaactgatgcaggttgttgggccagagaaaggagcctcacttgtacaactattctttcctatttcgctatttagtacagatatggcgatgggtttcctataccaagcacttctctttatccttgagatagacatcctagtactaggatcagtatcaaggattccataaaggagctccttcagctcagctgaaaaatgatgagggcatctatactcagcctttgcaatcttcctatacatattggaaaggaagataattggccacaagcacaaacaaaatcactccacaagaccacacatctgccattgagccattgtagcctttcctactaagcacttctagagcaacataagctggagttccacatgcggtgtggaaaagaccatcttgcctccttgattcggctagcgcaaataatccaaagtcagagactttaagagtttcattctcatccagcaataagttttccggcttcaagtcacgatgataaacacctcgggtgtgactttaagagtatcattcttggatgataaac

SEQ ID NO: 64726 - DNA, 1600 bp, Oryza sativa
tcactgagtctcgaacccgggccggctagcccaccaacttttagtgcaagtgagacatggacgggctcatcttgtacctactacggaataccaatgcttgaaaccagcaaggtatgcattatctaaaaccaaagaaatatgtttgcaacctaatccagtccgcgtgctgagcttagcttttacatccagtccgcgtgctgagcttagttttacttggacatcatagtcaccatccaagagtcaaattcagaggatctcattccgaatttttttcacatgataacctggaaggcatgcttgcattatctaataataaactgattaaacaaaagcttgcaagttgcaaccctgattcaacctgcgtgcttaacctaagtttgttcggactccattgtcgccatctaggagtcaaatttcagagtatcatttcgaatcctctacacatgaagacatattctccaacatataaaatgcactagtttagtcattagcagtgaaatgttgacttgggaggaagaactagaagagaggcacctgttcaccacgatttccggacatttttactcgggtggaataaaataggcttcgcttcttaagcttctccgaaacgcggccatgctcctcctaggttagaacaaatcaccaaattaacaaaattccccaactccaaatcaaccttcgtcctctctttcgctctctctcgctctcaataaaaaaaaaggataagaaactccctgtggtgtgctgcgcgaaccgcgagctggagcaggcggcggacggccggagtccggacggcgcacggcgcgcggcgcgggaagaggccctcatccaggtgggtcgcgtggagcctgaggaatgtaggagaggctgtgtgaggagcagatgaagcaatgtcgaccaggagtggccgcgtggagccaagtactcgactcttgaggcggcggcggcggcggcgggggtttgccggagggcggacgggcgccgccggttgccggagaggaggttgggagggagagcagcgcgatttgacataaacccccatcttctattatataattaaaggaataaaaaaaaaaggagacttcacgttcgctctcgtggcctaaaaattctcatattaatcggagaaaaagaaaatacagagtccatatagaaatacaatttagaaatagcttaaattcgaaattaaaaaaataaggaatattagaagaagagactagagtccatatagaaataccattagaaaataacttgaattcggaattaaaaaaataaggaatattagaagaggagactagagtccctatagaaatacaattagtaaataactgaaattcggaattaaaaataagaaatattagaagtagagtatagagtccatatagaaatacaattaggaaataactgaaattcagaattagaaataaggaatattataagtagatatagagtccatatagaaatacaattaggaaataactgaaattcggaattaaaaataagaaatattagaagtagagtatagagtccatatagaaatacaattagaaaataactgaaattcagaagtaaaaataaggaatattagaagtagagtata

SEQ ID NO: 64727 - DNA, 832 bp, Oryza sativa
tactacgtaagtagttagtagtagtaaaaacagactatctgaatttatacactaactccatcctatttcttaacttatataacttaatttgatgattctatcccagcacagtaagctactatagtatgaaccttcagactgcactgatgtttttctgctagagtggtgtattgcatacagtagatttttattgaaaaaaaaacttggcctgtaaaatttcttatagctaaatctgagagatcatgtagttttttgtgaagaatatgacgtacgtaacataaaacttttaaacaaagacatgtttaatacataagtgaaaattgaaatagactaattataacccaaacaggagtttttctctgcgaatgttcggttgaacatcatttcagctagaatatgttttcaacataaactttatgtactgatgaatgctatcatatatgctgcaaactgcagcactaccagcaggagtcctccaaactgcgccaacaaatcagtagcttacagaacgcaaacaggtaaagattccagatacgtatgacttacttttgcaccaatataaaccaaaatgttctgtattgcagtctaactcggcttgcctaaatatctctagtaggaccatagtgggggattctatcaacaccatgagcctcagggaccttaaacaggtagagaacaggctggagaaaggcatagctaagataagggctagaaaggtatatagtgcaactcaatttaaagcattatataacttatagtatacatcagctatttcttcatgacttttgactaagtgcaaattctatgttctttaattccatgcatgagctat

SEQ ID NO: 64728 - DNA, 844 bp, Oryza sativa
catattcattttaagaaatcatctcatcctacctgtccttaaactaaacatctttaaaacaagttcgctttaacccaacctattatattcctccaaccaaacacatgattataaaatctatattatattaacaaatccgagaataatcacttgccaacctcaatacatattcgtaaatcgtctagacctcatcttccgcagctagataacatgtaccatcaatcaaacttcgacgcgtgatagaaacatttcagcaatcaatcaagccaaccagcctaccgaattattggcctctcagtaaaacgcaaaaacacatatacaaactattacagaatcaaaaacaagtaaaattaagccgtggctacatgcaactcacatggtttaccaaagcagcacccaaccaattaagtgacgtccatcgatcggtccatggaaccaagtggggcccaagcggccgcttagctgtgggacggtgacaggtgggacccacgggatgaggagcatttacgcagatgggcgtcaccatcgatcgtggccgtcgctttcggttccttacaacgcccgtatgatcggttgtacggccgtggctttgtccgtttgtgctttgcgtacaccgaccgaatgagtgaatgctgacaaacgatagtgtcacacgtttgttagcggttgccgtgctcctttctcgcatcaaagaaacagtatcctgacccgtatcctactattctatactattctattatatgatactacgattctatcaagccgaaacgatgccgattctatctattatcttaattttcatcgtctctcgatccttctatttattattatatgatcctacgaa

SEQ ID NO: 64729 - DNA, 3168 bp, Oryza sativa
tcggacgtcgtcggttggaaatgcatgtcgatcatctttgttagggcatccacaatgtgatgcaaaagtagtccataggaaatataatattctattcagccacctattaatattgtgcaactagtccatatagagaaaataataaaaggtactcatatgcatatagctaaactagtcatatgaaataaaaaatatcatctatctctatttctctctcatctcgtaatgctatcttgtatccatatacattatgaagattgctatagttaaaatccatttgtgtgggtcccatatatatggatcactttagccatatacattagtgatgcccttatgcctacttttatagcactattttccttccgaccatgtgtacttacatcaaattgggctgcctcatcctcccttgacaacataaataaattttattacatgatacttaaaatttaaagtttgtgtagtttgttgatggatatttaaaaacatgctacagctaaacgatactacaaaaactgataggagtaatttgctagaagacgctgcaacaattattttattatttcgcatgcaattagagagagatttttttcaaaaagacgagaatacccatcatgccacaagcttctaacctagcgctggattgaataaggaatatgatatatggtagcaatttacttgaggtgatgacagattgagaaagcactactacgaaaaggatttttgcgtgcggagaaaaaaggttttcgtgtgcgggtgggcgaaccacacgcacccaggtgtctggaaaaatcgctatttttgtgtgcgggtgcctatgtcgcccgcacgcaaaaataaaaagccaaaaaataaaataaaataaatcaaccctaaccctataaaccgttgtagccgtcgtcctcgtcagatctgccgccgtgacgcctcctccccaccgccggcccactactagaaaaataatttatcaccacgaaaaaaatgtaacatcaatgctaaaatttttgcaatagatacatgttgccataatcttaaaatcgttgctagtcgtggtaataaatagcgtgataataggttattgcaacgatttttatttagttgtaataaattttgttatagctataaaacggatgtgtcaaaaaaatatatattgcaacacttcacatcattgcaataaataactattgccaccactccatatgtggcattagttctacgcaccaaactaaatgtttcaatattaatttatcgtcctaattattttcttttgatatcttgtcatggctaggattcgaacccaagatctctccctcatgtgcgctctccatgatcaactcacctatgcatcaattttgtttaaaaatacatataattccatttgagactgcttaactgagatttgaatcaagaatttgagcatttaaaagatttcaaatgaaaaatttaagttgcagatctcatcgagagctgtaaattttatataaaatttgtcctaatccgtgtccatatgaaaagaataagttaaattatgagatgataaattttttattgtaacggatttgttgatcatggcaatagaaaatagtgaaaagtaccatgtactatgcaaattgccaaaaaaataaatttgtggcgatagaacatgtttttttttgcaatagtaatgtttttgtggcgatagctcattttctattgcaacaaaaaaactgaataaaacaatgattgtaaatcgttgtaacaaagtataattatttgccacataaaaattatcattgcgatagtacaacatattgccatgaagttatttttcgttgtaacaaattggtggcgatagctcaattatcttgtagccgtcgtcagatctgggcgggggatggccttcatcgccccagaccgccttctgcgcgtggccgccgtcgcacgccagctgtcacgcgccggccaatgcgagcacgccggacaccgccgtccgccgagccgctcgctgccacgcccgagcccgtcgagccactcgctgccactcccggccaccacctcgtcagcgtcaccgccgagccggccgccgagccgcggagaggagagaagagaaagagatagagaggagaggagagagagagggatgagtggaaataaaagggagagaggtgaaaaaattaaagtgagtgagaggggaaaagagggaggggcatttttgcgtctatttaagaggctcacacacggaaatcgatttttccatgcagtccttttaaggagctgcacacgaaattggaggacaattttcgtagacgcgaccagttatggtccgtctgcaatctaaagaggtctctgtacaggaaaatcgttttttatagtgaagccacaaatttaatgtagttgtggctaccactctatggttttggaggacattggggtagagatggattggttccgtcatgttcgaccaaaccaagccgagtaacaagtgctggcttcagggacaaattcatcatttcgggaaatttaactatttgccactattagctttaccaattatccaaatacccttattagattagcccttaattttttgcccctctaaagtggtggcatcttaactatttaccacttttgcccatgtggcatcccaacatagcaacacagtgtaaaaatcaacatgggacccacttgtcagtcgcacacttctctctgtcctctttctctggtctgcccgtcggctaccggcactgctcctctcttccccagtgctagcggcgacgacggcggtgcactggctcacggctgcagaggacgagggggagccgagcgctgctcctctctttctcggcggcgaaccatctcaacgacggcgacggcgcgccgactcgcggcagcagaggagggggagccaagcgtcgccgcggttgaggacgagcgtcgtgcgaggtttgtaccgacggtggtcggcgtcctcgccgagcgcctgcctccctcgccaaggaagccatggaaggaggggggagagccgagtgccgacgcgagtccgaccttcgcctcgctgcgctgaggcacaaccacggcctccaatcggccgacgcggcgtccctccctccctggccatccaccgacgacgctgacgactccgcggatctgaccgagccgtcccccgcctccgccgactccatccggtgggtt

SEQ ID NO: 64730 - DNA, 605 bp, Oryza sativa
catcttggcgactgtgatcttgccttcgtagttcttggccacgtcgtcgaggatcggggcaatcatcttgcaggggccgcaccattcggcccagtagtccaccagcacggtgctgccgggttgcagcacgtccgattcaaagctggcgtcagtgacatgcttgatgagttcgcttgccatggagttgttccttgttgtgagtgttggggcagttgcgcacgggcgtacgcagagaaaaatgctgtcgataattgtgacagaaacgaatgtccggacgtgcagcatggctggctaaaaacgcctatgaaagccatagcggcaggcaatctgcggatggctggggcggccccaggtcttcctcgtggcgttatgctgcctgccctttggcgctgcgcgccggtgatgagaagaaagaaggatgcctatgtcagctgccgccgtgctgccggttttgaactgcgatgtcgcgattgtgggggcgggccctgcagggctgatggcggcgcagctgttgtcggcccaaggggtcaaggtgcatgtgtttgacggcaaggcatcggtggggcgcaagttcctgctggcgggcaagggtggcttgaacctga

SEQ ID NO: 64731 - DNA, 854 bp, Oryza sativa
ttgtgcttaaagtacattgataataaagtaagtcaaaaaaaaaataattccaaaaatttttgaataagacgagtggtcaaacagtacaagcaaaaactcaaaatcccttatattatgggacagagggagtaggtagtaagcattaaatcttctcctgttaacaacaagtattgtgagagtgatgaataactactactcggtcatatggctactaatggaaacaaagaataagttatgttatttgtacaatgtcaatgagtatcagcggattgttttcttgtacgaaggagtcaccgtagctcaggattggtgagtttttatagtgtgccccgcacaaacaatatggagttcatatcctgctactaccaccaggcacgcgggcccatgttattaccgaacttggtcataaaattgggcatgcccttactccctttgttagggcaacaccaatgtataaaattgaagtgagcattagtatcaggttttgggtcagaggtagtagttgtatgcaggcagcacaatgtgtatgagatttcaaggtggggtccaccaataaaatattctccaaccctcaaccattcataagtaaagatgctttcatcctgtactctctctgtctcgattgtgtaaacaacattatttattcccttgctatcggtagtaagcatactacccggtactacttatttactggttccacaatggctattaccaggttgtagaggagcattgaatgcctattacctggtttctcaacacattgtggatgcccttatgagaaaagacgatttctagagtggagaagttgtcccagtataaacgatttctgcgcaaagaactagaaacatcgaatt

SEQ ID NO: 64732 - DNA, 21050 bp, Oryza sativa
aaacttgttggttttcttatatgtcattggaagttggttccaatttaatattggttaaaatttacacaccctctcgtaccactaccatctgtcatgtgtcatgtgtctgtcttcctctatatccattttgcaaaatcatatagatgcaaaggaacacaacgaaaatgccatgaaaagttcggagctttccatccagctagctgctctgtctgtcttaccttgctgttgaccggtgttgaccgcggtatgcaactacagttttggagggcgtccgtatactcggtatttggaaggtgtgattagccaattatttcctatatcttatctactggtataaaagtacggatccaccatttgaagtgaaactcgatggctagatttctctagtttgttatattacacatggcggcttagaagcgtttgcaggagtgctagtcagcttagaagtgtgatagaatatttaatggacttttagtatataataatagaagatttccacgtgagagaagtttatatgaaatccaaatttaacataaaatgaataagaaaataaagttctccattcgtttcatattataagttattttggatttgttgtaagtcaaatatctcttcaagtttgatcaagtaatatagcaatatctacaacaccagattagtctcattaaatccatcattgattacatttttatagtaaatttattttgtgttgaaattattgccatatattattttattaacttggtcaaatattaagagctttgatttaaaacaaacccaaagtgacttaccatatgaaacggaggaagtaattaatttgagtgtaggctaatctacatgaacttcaaattaatttcaacaagatgaatgaaaaaaaaatcagatctatatttgattttcagcggtaatacagatctatatcatcaactaatagttagtcaactactttatcttaggattcataaatatttacaaaagaggtaaaccaaaagcaaagcataacaaaattaaaaaaaaagaagaagaagaatctaggagatctttttcacaaacaagagaagaaaaaaaaaggattaaccaatgaacttgcagcagtgcagttagccttgggactcactggatctgggctgggctccttgttcagatcaaagtccctcaccttcctctttccctgcgttgtgatgtctctcccggttagcaaaagcaaacacaatagcatatagagaggagtagatgtatgattcatccaaaaaggcttatcaggagcgtgaggatcttggattacctggttcgaggactccatcttcatcctctcccggtgtgaaatggtaactaccaagagacgacctgaggaaatgagacaagaaggagattgatatgggagtacaatgtgggggtttagggggggtttatatggggaaatttacatggaggtggtgatgaggcgctgaacaacgtttagttccagctgtttggtgatgagaacgatcgagtgaacggcataaacaggaaggtttccaatgtttcctttgtagccttttctgcctctcgttgcaaatctcaacaaattagaatcaattttgtttctcaatttattagaaatatattgaagtatcccacacaaatattaaaataaaggaatgttaccgaataaaagaaatattcaaggttttgtttaacttggcagctttgttaattgcagtatggcgtgtgtactgaaaaattatctaatacgttgtctgacaagcagaaacatattgcgaaagttgaaggagccaccacattcgctttcaaacacgagtttaatatgtattacgtaaagaaccagaaaaaagacgtgttagttaggttttaattttgacgatatagtttcattggatacattgcaaatgttgtgtgggagtaacacacagtctctatctttgttattatggcgggagttagacgatatagtttcatttgctacattgcaaatgtggtgtgggagtaacatatgatctctatcttttttaatatgccgagagttagacggattgaatgtagtaggcatactaattgcacacttggtcttttccgtttttagtatggcgggaatttcatgattagacagtaaatgcgccaatgatgtatgggatgtctttcttctcgagtttgacacgcgggagcaatatggattaaatattagatgcactttatttattgttgaaaatattgtgattttctatggtctatgtatatatattcattaatattaacataggaataaccaactatttctttattgtttctgtaatgcatattacaacaattaaattgtttgtgaaaaaaattccagttcgtttcatttaaaagattttcgtaacatcaggccaaaggtgaccaaatcaaattagttaaatttaaaaaacatggagcaaatagaacaaagagagcaaatttgacgacgtccaaattaaaaatctcctaggagttgctcttgttcaacaactttagaatctttttaaattttttgtatggtgtaatgttgaaacaatttatttggagtattattatattcatattcatgatttttagagcaatatgaataatattaatattaatctcgcagccgttacaaattcggaggacggaaagaccaagttccttttaagagacaatgttagagtggactcataaaactatgaaattaacagatataacagtatgctattttatcactatgaaattaaataaaaaatattacagccagcaggtgacctgttttttctctgtcgtacaggtgctacaattaagattaattgcagtcaacctaacattacatatttagacaaaacttctatcccaaaatattacaattttttttaaaaaaaatagacttatcctaatacaacgaatctagacaaaacatccgtccagcttcatagtgacccatccttgtactctctttgtctctaaatatttgacgtcgttgacgttttttaacatgtttgactgttcatcttattaaaaaaaattaagtaattattaattctttttcctattatttgattcattgttaaatatacttttatgtatgtatatagttttacatatttaaaaaaaagttgaatatgacgaacggtcgaacatgtttaaaaaaattaacggtgtcgaatatttagaaacggaggaagtaatattttagcacggaggtacggcgtttttagctcaactggaaaggagctgctaggagtgatgcgccggtctaggttcaattacacatgaacccgggttacctcaccatgttgttaaaaatagtacggagtagtagtagtaccgtagccaatcctaaaatgtaaaaatccatgctggctatacctcggaaagaaatggaaatgatctggattttctgctgcatatgacctggggtttaattccttccgttctgagattaaccgggacgcgatttctaaatttggacttgatcgtgcacgcgaggacacgttcagactgacactgctctaattcgtttgggctaggacgaaaccatggaccaatattcggcctttgggccttgcaaattacactgcttctcgacaatggagcctttcaaacgaaaaggcccatctaaaattgtacattttgtgattcgagaaaatgggcttacagactcggaagtttaggggaataagttcacccgtcatccctcaactttactttacgccgagtctatttgaggttccctaaccgcaatatcagaaatgtttaccgctaaaccatgtaaaaccgtctaaaaaaggtcccgaggtagtatagccggcgcgtttcgctgacgtggcatcctagtcagcaaaataagtaaaataaaaatgtggggcctacatgtaagtgagagaaaatggtgtggccccacatttctcctttcttttctttttctcttctcttctctcccgattctctcaagtgggcacgacggtagaggggagagaggtggccggcagtggagcggggacggcgggagagggggagagagccggccggcgtgacggcagcggcgggagaaaaggagaggaggcggccagcgtgacagcgagctcggatggtgcaacggtagcggcgagagaggaggtggtcggcgcgatggcgagctctgcggcgaagaggagcaatgtgtagtaggagagaggagaggagtggcgcgcggcacggcagcgggggagaggagcggcacggctttcgactcctccctctccgagagctcgccgacctcctcgttgtctccctctccactcgcgcttgccggcattacaccctgctcaccggcctccccatatccttcctctccgccgccaaactcgttatcgcgccagtcgccacctttcttcctctctagccgccgtcgtcgcgacgaccgcctctctctccctctctcccgccgcctccatcccagctccgccgccggctgggtctctccccctcttccgccgtggcgcaatctggcagcaaaccaccagcccgccgccccgctgccgtgctcgcccgccgccgctctgccgctgccccctacttgcttcgcctttcgctcgcttccgatgaaggggaggagcacgaataggatggtgttgctctgcccacccgccgccgtgctcgccccccccccccccccatcgccgctccacccaccggccaccggcctccctcactgaagaagagaagagaaggagaagaaaaaaatgtgcagcgggcatgtgggccccacatacttttttatttttattttttactgactaggatgtcatgtcagcgaaaccacccatatatatatatatatatatatatatatatatatatatatatatatatatatatatatatatatatatatatatatatatatatatactgccataggatcttgagtgtttgtgtaagtttagaggtatacgtttctggctttgtggttaagggatctcaaaaatctcgttgttaagttgagggacctctggtgaacttattccaagtttaggaagctaatttcatgggcctcagtagatggaattcactgcgttacaaacggtagctagaaaacataagctgtttgtttgatcgaaaactcgaaatttctgcatttccgaagtactagcagaaaacgaaaaacttgcacgctggacatcaaggtactggaaaagcagtaaataatggaaagcgaccggtgtttagtcgaaataaacgttcgtctttttcacacattcgctcaactgcggtgcaccgtgcgaagccccgtcactctctgcgcttaactttgtctcaaaatttctctgtcgcccaccgatcacgactaatcgcaaaattcgcggcgaaagcccaatcgccatgatctcctccatgattactcgctaagcattgtggatttactccagattcgcgatctcctcgtccatgacaatgtcatcatcatgatcatgatcatgatcagcagcgttaggtgcagaagaaagtgacaaggcctttctcgcttgtctttcctctccattttcattccgtggctaagaaaaaaaacatcatcaaagcatcgcgattcgcaacctaataaccggacagaccggcgaaacacacaagtacattggcgcagggcgtcttgctgagcttttgcttgcacccaaccatacatggcacgctggggtcctgggacatttctcgcagatgagtgggacgttttcgcagatgagtgagatgatggaacagtagtttggttgttgttttttttttctttctcttcctctgcttttgcctacaaggctttgaacagcgtactggctgcctgtccgactcagagcaaaaggccgggcaaagctaccagacttgtgctgttgcatagcgtaaaagataaccctgtggacctgtggtcgatcagcagaaccgccatggttgttcatccagacttttggatgacatgtacattatgcacagtaatcagtaatgtgacaactgacaagcaggtggttgaagtatgccaagaaaattttacatatttttttttgcatgtaataagtaccgtttataagcatgggaagcatgcaaacagaaatcgaaaatcagaaaagaagctagatttaagtacgtactttctaatatggaaaattcagatgtcgatgaaaaaaaatacagagctacattctttacactaaagaactgtattacagaaccttttaatttcaactggtacataagccctattccttttccataaaaaggaaaagtttgaatagaggggtggaaaagtgcaggcatgaatcttttcgcagagcaccttcaacaatcatactactacaatttcttttcagcatgctgtctcggccatgtcacaactacaattctactcccattatctttgagagcgccggacagccttgtgcatgcctacccttatctagttagaactagtctcttttttacactataaatgaaaaaaggccgtgaatgcagcgccactgcatgccctgtgtggtgctccacttaacacaagagctttaccataccattacctctttggtcaaagctaagtgcaagtcagaagggagaaaaaggtgtcaacttttgctctaagtttttgcttctcgtttttcctttcctctgccactgccttttaatttcccctttcctgcgagatccagatgattgcttcgctgcacgctcgtctgtactactactccctcccaatccttgtgcgtttgacccttgtagtaatcattcctccctcattgtttaaccaaaccgccttgtttcaaggccgtttttcattggcgccatgatttggttagcgccatcctgacaaccctgtagctctttacgagcaccaaatcatcgcatgtgaacatcccatgcagactacgattagctccacgcaatcagtagcatgcagacgctttcgtcgtcgcctccccgtccgggccgcccgccgtcctcgccggcataattagggccatcattgtgcgtgggaagagcccgtgatccggcacgcggccggtggatcggggctcggatcaggtgctgctcctgcgatagctcacgcagtcacgctcacgcgctgaaccgatcgagtgctaccgctagccatagctcgtcatgacgcggcacggcgcatgcatgggggtggtttcattgcgttgtgtgcgcgcgtacgcgcggggccggggctttgggccatcggattctcctcccatccccctcccccccgccgcgccgcgtgagattgcagcggaatcgtggggaaaaacacgccgattcatcgcgaaaacacggcgttccgctcggtgcgcggcatcgcgtcgcgcggggaaccaaaaccaaccagttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcagaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttataaaaccgggcggaccaggcccaatcaccgggaaattattgcgtggttactcgaccgtactaatgattgcgcctggcgtggtgtcgggccgaggggcgacacgcggggccgcccagggacggtggaggtgggagtgggcagtggctcggctcgtcgtcctgggccacgggcgcacacgcacagctttggttcgttttgttttggattcgttcggattcctctccctgcaaatgtcgcacagctttgggttcgtgctaacattcagtaacctacgaagcctgacctgagacaccggtttgaccgacgacagagacattgcacgtatatggaatttttacatttagcccttttaaaaaaattattttacaaaaagacattaaaaaactttatattccataaatagacccattttcagtggcagggttattgacaccacactcacactgttacagaagtaagtcagcgatgtgaagaggggcagtgccaatgacaccggtactgtgaacctatttgtaagaaaataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatacagcgtattagattttctacatggtatcagagccgtagacaaacgtcgatcgatcctcggttccagctaggttccatccgcgctgccccagggagatgagatcaatttctccctggggcaccgcaccgcattagctagctagcctctccaatcatttacagattagtttaccgcatatcattagatgcgttttctaataattagttttagatctattagctagccacagaaaaccatatgatcgtcaggagcaatgcggcaggtgttacaggagcagacaacgtcaacaagcatcataccatccggcctcatccatggatcgatctgcatcgccgctgccgactcgtctacatagatggacacctcgcgtcctctgacagattaatctgcaagacgcttcatcgacgacatcgaccgtgtcctctacgacggcaacgaccgcgtcaccgacaacggcatcgatcacgtcatgtacgactacaacgactgcatcaacccggcatcactattgtgatgaccgctatacggcgcagaaggaccaaccaaagtggtggcctcattgccaacgacgtcctctgacatatgcaagaggtccctaatggcatcctctgacatctacaaggtgcaagatgctaacaattacagtttttgtcttcacaccatggcgtaaatttttttttttcgcctttggctatatgcggctacaccgacaaccacagttacttcatgatcggctacattgacgaacgtctacaacaaaaatcattgacgaaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcagtcgatgatggtgagtcaaagaaagatgaagaaatagaagatttcaaatccagtcgcaatcgttcgcttcgctcccgttacgactgagggggaatgttagaagtataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatacagcgtattagattttctacatatataacattttaacccttttcaaaaaagttataaatagatctttggcgtcaatgttattgattttattcccattcacattcagttagctttggcagagggtgaggtgtcggcctcaagcttcattggctccgaggcattagtcctcggcgtcaagatcactggtgctgagaaaacagtccattatttgaataagttttttatggcttcatttgtaagataagtttattttaagaagactaaaatgtaaagagtaaatttcacaatgctatagatattttgactaaaccatcgtaaaaactatagatttaaatttgtgtatcacataattttagatttagcacaaaactacatatttaaaatattgtatcacaaaactatagattcattaatgaggttatcaaagaactataattttttagtttatattcataacatgttggggttgtaaaagttgtaactctatgataaaaccgatactaaatttatagttttgtgatagattgataacgtacatgtagtttcttaaaatttactcaaatgtaaaatatccgttttgcacgtatactacctagttcggttaagcgaatcgcggtttggactatccacaccccgcggatcaacgccaccgttattatccacgctagtactagtcgcggtagattgtacggatgattacagactagcggcactagtactagcgcacggcaacagcagtactctccgcttcataattcccgacggattcaggggatctcctctccgcggcgcctgcgtcgacctttgacctttgccataacgagcgctcctgaccggatcatgaggacaattatcaccggatgaagaggacagttaccgtagcaacgcccggcgtatttacgcgctgcatccgccattactccgtccgtcgcgcgcgcaccgacacacgcatgcattcacgccccgccccccccccctcctccccctcccgcagcaagccccgtgccaccagtacaacatcaactattcccccacattaaccgagcacacgtatacgtacgaaaacaaatcccttcacacctcacagtagtactagttgtagaagtactattgctgcttcctcagaggagactcctattgcccagcgtgctgataggggcgcccatgtgccgacgacgaccccccggccggcttgttctctcaaatctcaatcactggccgtctcttctgttgcacatcaatcatgtaaaagctgattgcaacggctgcttggttctctggtaatataggagtactagagaaacaactgaaccacacggagaaaaagacacgggcgagaaacgatcgatccactctcccatgaggatgcactcgatcttcatgagcagctatagctagacaccgctgagagctgtaccatccgtcatcgtatggtcatagcgttgctttgttgttgttgccggaggcgtccactgttgctttgccgtatggtcagaaaggctttgcgaaaggccatctctctcttttgtgttttgcgctccgaaaacggccagttcttcaggtcccgtgacgtgagatcggatcgagaagaggatgtgtgtgtgcgtgcgtgcgtcaaggctgcaaggatacgccgagagacttgggggaaagattctgccattttgcacgacggtaccgtcaaggcgtgtcaacattttcacaccaaaaagcatggcctaaactcgcttaattaaacgccttccattattatggccatgtatggcgtcacgtcacgcgataaatttggggctatttggatgcccaccttaatttaccatagttttttaatcaaagttgtggcaagatgcaaattgtgtggctcaaattttgatggccacacttgtggcaaactttggctaagaaaagtgtctatgactagttggaccaaaagaatagaaagtgtggcatgccaaagttatagaaacaaaccaaacactaaccacatttggtcaaactaacatacctcaactgtggcaaaatgtggcaccaaccaaacaggcccaagtctcagcggttttgattgatttcctacccactgctacctcgtgtgatcgacagtagtcatatactgttggtgcttggtacggagaactcgatcatatggagtacagtacgactagagtagtttttgcttgtaacgattgaccactcgtcttattcaaaattttttgaaattattatttattttatttgtgacttaccttattatctacagtactttaagcacaactttacgttttttatatttgcaaaaaaatttgaataagacgagtggtcaaacgttacaattaaaaactcaaaatcccttgtattgtgaacggagggagtaccctcgaacgactgcatatgttggtcgaagtgagaagtcgtgtacacgttttctccttttcgcgcgatcgcaggggcagcacaagacttccatgaatccattatccatgtgtacgttagaatacgtgggaatatactgatcctagctaatagtcaagtgataagctggcattgcgaagcagccctaaagactatttacaaacacatgatacaaaaaatgtaggattcgagtgttttgtcaccttaaatcctaagtatgaaaaacacggaaaattatatgaattaatgactattggataaagcgaaaaaaaaaacgcaagaattagtatagacagatagacaaacattttttttttccgggaggttaaactcatgttgaaaatccttcaaaacacctatgatttgagacgaacttaaggaattccaaagtaattttgcgtccctttgttccaaatgattatatagctaggaatcctttccctacgaatataaacctttgaaatcatccaaaattcatttgtaacgaaggagtcctaaacatatcatactcagcatgccctgcttcaagttagtagttcaggccctatttgaaatgcatggatggtaaaacatatgaagagaaaaaatacatggtggtagaaatgcatgtgcaaaatggagtattagaaaacataggaataaaccatttggaatgaccattttaaattatagaaattggatgagaaaaatagactcaaaaataagaagttgaaggtacgacaaacttttcttaaaaattatgtatgcattatgctattcctctgaaatttttacatggatttggaaatctcccatccttggtttcaaagaactcaaatagaaaaaatttctataggaatggaatcatgtaaattcattcacaaatccttggtttcaaaggagaactcgatggatgaaacaacaaattcctactgaagaaaaaagttaagggcccctttgaatcgtaggaatgaaaaaacagagaaatagaaaaaacacaggattctgacaggaatacaattgtaaaacaaaggattgcaaaacacagtaaaacataggaatggccgtttgattggaccaaaggaaaaacgcaggaatcagatgagagagatagactcagaggaaatgttccaataggttagacctcttgcaaactttcctccaaaatgtgtgtaggattacccatttcataggaattttaaaggattgtatatgattcaatcctttgtttcaaaggtcttcataggattttttttctataggattaaaatccttcaaaattcctacatttttttctacagatcaaagggacctaaaagggcaatatcacagaattttttttaaaaaatgttcgatttccctacttgaacatcagtgcgtgtcctactgtacttcagcatttcgaagcaaaagagggcatacagtttggtacagtagcctttcacatgattggagaggtgaatgcccatttgtccccaccaccgtcggcttttgcttttgcgattggcatgccccccgcacgcagcagcaggcgcggcgcaccgcagggcagcagccgcagcagtacacagtcaccctgtcctcggtaaccggacggcgacgagttgttgacgacggcgagccctgtgccccgatcgatggatggaacggcgagcgaatcgcgcccaaaagatcttgccaatcaaagcaacccgacgggaccgggcccccccccccccccccccgggttcacatcgtctgccgttttggctgacggcaaacattaccgttgcattcatccctgccacatatctttttatcaacggatgcatgcagtggttccaccatttatgattaattagggactactaatcagcagaatcacttatttctctttcaaagaaaatcagcaaatagaatctcaggggcaaatcgcgcgagaacaaaagtagagctgagggaaagctcatgctttttgacgccaagaaaatggatcgactgacagaagcagagcagagcagagcaaaatactacagctaagcaagcttctgttatactaagaagctattcaaatacttgaacaatagtatatgtcttataaaatatttaagtattcatttgacaaaaatagcattgctgcactactactatatcccagatagagtatttttcatccaaaaactagcagcgaaatgaagctactgatgaaattcttcataatacaactctcatccatctgataaaagattttgttgttctggttctgctgttcctgggtgaatagacatttggtgtcgatccatattcttggcgccaaaaagcaggagctgtccctctgctctgcttttgttctcgcgcgctttgccgctgagattctatttgctgattttttggaaagagaaataagtgattctatatgcttttgttgacagaaggatgtgtggcagggatgaaggcaacggcaatgtttgccgtcagccaaaacgccgtcagccaaaacggcagacgatgtgaaacccacccccccccccctcttcccccctctctgccggtgtgcgtagtgcatcaccccgtgcgatcgatcgatggcacgacgagccgagccgccgggtgcggagagccggagaccgtgcgctggggtgggggcgacgcgtctcggtgcccgtgcccctcatgcgtcacctgtgctccctagctaggagtaccactcgtagcagtagcgttgggccccttggttatttcgatctcctcccgatctcttcctctctctagtctacgtcgtgtccgtctcagtctgactcggtgtctaatcgctgggcatgagggctcgattgctgcatgacttcaataattgccgctgctactactactccccccaccggtgcgtcgcgtgtgcgtggcaagcccagccgtggagggtccatgcatcgtcgttcgacatgctcacaaagttgtggatccggatcgtctgcagtaccgcagaggggtactgtttatgtgagaggaacagtgaattaatgccatgaacagtgtctctttactgtagctacaggacctaaaacactgttgagtactgtttggtactgtgctgaatttactgtagcgaaaaatctgatcctttcactctcgatcggacggtccacagtgatcttaatgcgcagcactgttcatcctctgcattagtacctctaatgcagaggatccgaattccaaagttgttggggggtttagcaccagtgcgtgtgtgtccggttttgagaccactccattcaattgcatgcatcaatgcgtgtagagtgatggaagttttcgatgaggtattgatgagaattatgcgcgccacaggggggcgtgccaatcaaatacatgtactccctccgtctcacgatataagcgattttaagttttttcttctaatatttgaccactcgtcttattcaaattctttttacaaatataaaaaacgaaaagttatgcttaaaatactgtagataataaagtaagtcacaaataaaataaataataattttaaaattttttgaataagacgagtagtcaaacattacaagaaaaactcaaaatcccttatattatgggacaaagggaatataattaaagtgcctggtttatgtactaatgttactatacgaaaacataaatttcgttgcaagcagcaagcgcaagtaccggatactcataagagcaggtacaataccaagctataagctagctataaccacatatcgagaataaaagagaagagagagtagaaaacggactacaaatttgtagccggctacaacaaagactccaagacgttatgtgtgtatgagatgtgggaccgggtattaatgtcgtactatattttttatagataactattatatgaatggactattagattaactatagatgatttatatccagcagttggctatactattgaacttgctctaatgcagaggacgtagtacccgttagagcacccgcaatggtaaagtaaggtgctatctataaaacatgtacatctcagcaatagactaaattaatagtaaaccacttcaatggtatgtctacatgggtatctatagctctctaatcaattgcctcgtttttttctatagactatctccagattagtagatagctttgctctctctcttcatttaatctcttccaagtaggaaaatatgctgacatggatatcttgtagagagcctatagataaccattgcgggtgcccttagtagtagtggcgttatttcgctgcagcgtgggatcgcctgcgtgcgtgtatacgtatacgagcgtcgtactgtgcaagcgagatgaagatcgtgcctccattaacggctcgtactgtgtcgtgcagccgtacaggtacaccgaactggctgtgacctgacctctgaggctgcgttctttcttcttctcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggaggactatcctgaaaagaacgcagcctgagtgctcgcactgtagagtgcctccgtcttaaaaaaaaaagataaaccctgatttccgtgtccaattttgactgtccgttttatatccgttttatatgaactttatttataattcgtatttttattgttgttagatgataaaacataattaatattttatgcgtaacttgtctttttaatttttttcataatttttttaaataagacggacggtcaaacattgggcacggaaactagtgtttatccctttttttttttttttgacggagggagtagtaggctcaccgtgaacgcgtgagccacaccagctcgaaaaatgaagccgcgggtttaccatgacgcgaggctggggctcgacaacaaacagtggcgcgtgcaggcggcccgtcggacaggagcaaaacagacggaagctttgcaagcgcgccagcaatccagcatgcagccccggccgtaagctggctgctgctggtggcagcatcgcagcaaggcaggcgtagtgggatgcgccccgccgcgcgcgcgacgcgatgccccgcgattaatgcccacggcgcgtgtgccgtcgcgccccaacaataaattctcggtggccgacgacggagagggggggcggggcgcagcgcagcgcaggcggggtcgacgcatttaccgcgccgcggccgcggcacgtgacgccgtcctgtagcgcgcgcgcgacggccgggggcgcgggcgcggccgtaccagcatgtgcacgtggtggtcgtggtcgcgcgcgcgcgccctctcgaacggtggcccctgcggctgggtagcgacacggtatggagggagttcaggacggcttgggggtgattttgcagcgcgccgcctgtgcgtcgcacatggagtccgcggccgctgccagtgtatgctggttcgggacagcacggggaggtggggcgtccatatagtccatacgtgcgcgacagggaacgtaggagtacgtacgtacgagacgggaagcaacgacaaaaatacgagggaggatgtgagacgtgagtaggtgacccttttgggcgtgcccacagtacggcgcagcttctccgtaaaagaatgatctggtaatgtacatgtagcttaattaatgaggcttagttaagccttgagccaacccaacctaaaagcccagtccaagcccaacctgactcaaacatggcccacacccaaattttggaatgttcaacatgaggtaaactatatactccctaaaaaaagagtatatatctacataacattcaaaagttttatgacgaaaaacatttaaatagtataattacactataactaatatgtaacaataatataactcctatgtaactgccgcaaaaacatacaacacgtacagaaaacacacgattttttccctacacttctacagcacgaatcttgatgcttatccgatgatccacatttcaaaagtttcatacctgatttttctgtcgacaatttacaaaaccgtaaaaaaaaacacgtggtatactctcttggtcctaaaaacaagtcattttggccactacccagtttaacttttaaccccctagttacaattgtagttgcgctagcacgaaaaagtagttggagtggctgattcagtatcaccaccactaaagccttttaaagtagcatagataagaattgtggtagctcattcaatttataccaccagttcgattttttttcttcaccttgtcttcatcatctccaatggttcctgctctattgttgtcttccaagcctactctaatctggtggggttggctaaaagtgtgttcttttctctccttttccaatttctactctctcgttttcaatgcacatgtttctttaactactaaaatgatatgttatttgcaaaataaatataagaaagttgtttttaaaaatcatattagcatatttttcaagttatttaatcgagtacttaactaatcacacgttaatatgtcactctattttcgtgccagaatggatgagtttccaactatcaccttagaacatagcctaagagtttggtgcactagcgaaggggacctaggacgaaagtggcatgctaagagtattgaaattttgagtaatccaaatataataaatactaaaatccattaagaaattactgatgtcctgcatgtgtactccctccgtcccaaaaacctaatctaggagcggatatgacccctcttagtacaacggatctagacgaagggttgtccagattcgttgtactaggaggggtcgcatcctgtcacgcccagaaattcacgaaccagaatttctaagctgaatgtgcattaaatccctgtctaggaccagccagggtatacgaacgacaattgttgacatacagatccacgtcttacaaaaatataaaagattacagatgcagcgaaaaaagataaaagcgagctaaacttggaagcttgacttctgcagtggggcgactccactccacaggcaatccttgacggcagcgacgaaaccaacttcgacaagacagctcccacaaggaagatcttcagctctggtgtgggggaaaagagagcaagactgagtactacccactgtactcagcaagtcataccggaagaggaggtatgatacaggatatatccaaaggaggctaagggcataaagcaggcatttaaaagcagaagttgaaagcagtaaaacaattgtagtagattaagcaagattaactaatcactgtccaacgctacaccacgttacaacaggcccaaccaaccacctgaactataccagttcattaagctaaactaggggtgagactaatcacggtgaatctggtggatcgcccataactgcgggcagggctattcgaatagttttactctggccagaggtgtacaactgtacccacaagacacgattccatacatgtcgccatgccccgaagtatcaccatgatactgcaaagggggaaatcgtgataagaccctccgcataaccctcccctaaccatccacaccacgctaaggtttcaccccatccctcaaaaggcagtgagcggtcccctcttgcgccgcggtgaatccgacagctggacaaccggacactccggccgacccaactccatcacgcccaccctcgccaccggtgcctaggaaagggtcgagctatacttcagatcaagcagttacccactcccgcttgtggtaagcacggtaagtctctcagggtttcccgtgaactggtccttaattgctatgagtgcgaccagcaaaaccatgcacccacagcccaccatttagtgtatttcctaaaccaacatctaatcattttgatacccaagttatcaatggcatatggtaaacaatatatggctgaataataggacctatcccacatgatattgtaaaagaatgcaacatttaatagaaatgcgggatatttgtaaattgggtacaatatgatcaattgtattgcatgacttgccttgctctcgcagtgatgagaccacagcaacgtcttcgaggaaccgcggatcgacgaaacggccgaaatctacgcgacaaacaaatcacacaagcaaaacacactataagactactgaaacagagaacaaaaatattttcaatagattctagggatttttatgaatttactgagacttgaatggacttaatcggagctcggatgaattacttatgaattttagaagataaactatgtttttactactaaagaaaaatccttaatcaattttattgcgcaatattacccagggctgacgtcagcgaggggggaggcggcgccgacaggtgggccccgcttgtcagcggtacaaggggagagggagggggtgccgacatacgggccccaccggctgcagctcaaaaaggggaagggagagggaggcgccggccgggctcggcttggcctcaaggccgaccggccgaccaaagcgaggcggcagcgaggcacggccaccgacggcgatgaccggcggcgcgggaagcggcggcgacggccgaaaggcggcggcgcatggccggagcagcggcgtggctcggcactcacgggaagggggaggaaaggatggggagggaggccccaccagtgacacggcggccgaagcggaaggcgaaggcggcgacgacgacccggcgagaggaggggcggacgagcggtggcgacacctagaggaggggaggagaggagttagggatggagaggacgaccgcgatgaccaaagtggccggccggagatggatgaaaatggagagctcaccggcgagcgagggaaacggggcttccgggtgatcggcggcag

SEQ ID NO: 64733 - DNA, 626 bp, Oryza sativa
atattcggacataggctagtaaatggcactaacattttcctttacacccattaatttgaaggattgattataactaatttatttggttgctacagtgacaagacatattaaagataattatgctactgtacaatatccattttttttatttattggcacactatttaggttaactattatctaatcatttgatattaattaatttataattataaatatattttattgaatagtgaattatatatcattggaaagcttatgaatttagatgaatttaggttcaagtttcactcaaatccgagttaaaatgaataagttatgctagtgtaaagattcaactttgaattaatccgagaaattgcgaaaagctactgttcataaacgatttatttttaatccaagacatatccattgacaagtgggaccccgggtttattcctttttcctaccgaattattttctaaagggaaataggaagagctaataacaagtggggcccacatgtcatgaactcgagaccataaaacttctataatttgatttttaaccacccggacccacatgtaatagactcaactaataaagattaagaaggggattactattcactaaacacgtggggccca

SEQ ID NO: 64734 - DNA, 684 bp, Oryza sativa
ggatccggtttttttagcctccccatctttagatgtgcctgtctctgaaccatcattgggaacttttagcttatacctctagataactgtgcatgaacgagtttgtttgaatgaatgcaggtactgagtctttaaactgttcatcatctgttcgtattctaacatctgttctggtgtcagcttatccagtgttattgggatgatgttttcgggggcaggatcagacggtggtttagaagtctgcttaccgtccaccatgacgaaaaatcgttacaactcgtgtcccactaggcgtgccaaaagcgtgttgatgcgaaaaaacacacactggcctgggagatctgcttaactccagtgcaggtcctaaatcttgctcttgggttcaaaggcatgccagttgatttgatcctgcaatcaacaagaaagaaagacaaggaaaccgaggttaaatccataaacaatagccgatcggctagaagccgatgacatatcgtcaatcattaagccgatgttattggcattagatcggcaatgaagaataaagtaatataaagctaaatctactccgataccactctatattaagatatcaaaacagacagaatatatcaaacagaaggcccaatatatttttgatgcaataagatcttaatataaagggcggacttagcatggcaagcaagc

SEQ ID NO: 64735 - DNA, 2453 bp, Oryza sativa
tgttttttaagaacgcgttggacagacacaagcatatatcacgacattccttgatcatgttaagtggttgtgtaattctcgaaaatgagatcatgctgattgcagaggagctccgtcaacggaataattaactatttgccactcttacaagtggttctaaaggatttactattgaacccacatatcatagacatgagaacccacacatcatagacaacaagtgacaaattctaaattaccatatcttaaaagtggtatataaggtggtatatagtttaaatgtccctccatcaagagacgcacaccacaatagtgaaatatgtgaccgggtctttaccgaagtctttgtggacatcacttagcttgtttgaggacgtcacatagatcatcatagacggccagcctttactggaagcggacctcactttccgcatgacacagcagcgccgacaaggcctttgcatactcttaaaaaagaaaagactttaatatgttttactttctaaatttatttcttgtttcttttattccttaattgtgaggaatggagtctaaataggttgtaatgtttgcctgtgcatatccatgtatggatatagaaaccggatttttatctattataaaaaaatactccatccctagctttcgtatttatttctggtaacttttttttctattttctgctcttacttcctttctttcctcctcccttgcatgtgtcttcattcgtcatcttttattgctgtgttttgtttgtctcaactcaaaccaaatacaccctccgtttcaaaatatgtgacgccgttgattttttaaaatatgtttgaccattcatcttattcaaaaaatttaagtaattactaattatttttatatcatttgattcattgttaaatgtacctatatttatacatataattttacatatttcacaaaagtttttgaataggcaaaatttgctacaagacattcaaaaaacgtgtaattcgctagaggacatcgaaagaatgtgtatttgctgtagggcatcataaaaaactggtaattagctcctggacacccactgcattactttattatttctagaggaataggagagagaaacgatcattaaagacaaatttgcccttagctcaaatgaatccacgtgggcccacatgtaagcccctctctctcccggcacagcgccgcgtcggccagccagaacatgccggcggtggcaggctcttcgccgtgcaatcatgtctcgcgtcgcgtcgtcgtgcagcgaggcgtcgacggccgaggggaactccatgccgtacgaccaccagtccatgcctgcgccgtgcccaccgccgcgcgccacctccggcgccacatactcgtgtgtgccgacgaacgagctcgaccgtgcgtgcactggttctgcccgcgatgcccatcatgtgcagatactcgagcgcgaggagcacctcagtggcgtagaacctggcgaacgggattgggaatcgacgaccgggcatgctttggcgttgtgagtgagggagtagatctggccggcgtcgaagtcgtctaacatggcgagcatgtaaagggtggtcgagccaacgcaggatgcgcttctccgcggcggcgtggcccagctcgcccttcttggagagcgcgcggcagttcaccaccttcatggcgtactcgcacgaggacgatgagccgacgcattctccttcataccatgtccctggcgcctacttggtggatgagggtaagtcccgcgggcgtcgcggcgacgaggatgggcgcctaagcgaggtcgaccgcgtggtgcgggcgtggtagggaagaggtgggtgtggccatgtcaagtgagaacatggaggagctgaaagcgacacccactgacccaccgtgctactgctgccgctggcctgctgctacttatgcttgagctgggcatggaggcagcgtgtatgtgcatgtcgtggtaggcctgcgcgcgacagcgcagtgccgcaccaggcccgcgcctcgccgcaccgtagctgatgctctccctctccctcgggcttgcttggagaaaagagcagagagagagagaatgagagagaaaagaacaaggaagaaggagcagggaaggatagagaaaaacaaaaagaaaaaaattcgaagggtagaaccgtacttacacagtttttctctctccaatttctccggatataataaaataatcccgtgggtgtccagcagctaattaccaatattttgtgatgccctatagcatattcgcgttcttgcagtgtctcccagctaattatacgttttttggatgtcctgtagcaaattttgccttttgaataagacgaacagtcaaacatttgctaaaaagtcaacggtgtcaaatatttagaaatagagggagttttacgtagtacacaccaaccgatcgtgccctagccacactcgtactcattgaa

SEQ ID NO: 64736 - DNA, 2555 bp, Oryza sativa
cattttagtggtccagacaacacacacgagacgaggagtcgacgggggccaaaggtaaggtcttgtcgtcatttctgtggccaagtgtttttccagttgttcgatttgcctaagattcctgcacgagattaattatgcatgcccctgcatcagttcatcacatgtccactggtccatttcttaatcaccagtaaaataattcaccgagccatatgcatgcgatcttgttttttaatttgtttttgtggcatatggtcgtgtttgcacaagccgcgtgttctacgcttaatcacaaccgtagaaacgacctatgatgaagtactcttctaggttttctctcgtttggtgtcatgtgctaatgcatgctagtcaaagtggctcgttcgatcgtggatttaatcttgtttcctctcggtcgtggggcccctgactgtttggtctctccgacaggcagatctggtgccgagacagtgatagattttggaccatgttttgacgcagcacttgccgatgtcaagaaccccctttaaggggcttttacctactgatcgatacgtgtgctttctgttcaggtcacggcgttacgcagcactttcacagtccagtacgtttaccgatttgacttaaagcgttgcattgccctgcataatgcgatctttggtaagttttggttgctgaaatgaaggagcaagatgccacatcacgtcttgctggaacgaattcgcaaagctttgctcttttgcaagctttcttcggtgagccaccctaatcaaacacatgcatacgtagtactactccctccgttttacaatgttagtcattctatcatttctcacatttatagtgatattaattaatctagacatatatatctatctaatatatctatatagattcattaatatcaatatgaatgtgaaaaatgctaaaataatttacattgtgaaatggatggaggaagtagtaaacatagtatagctagctagcgtagcatgcactgcagatagcagcatggaggggcaaaacctagctaggcttgcttcacttctgcatccatcacatcaagtgacctgccatttcatcagctaaactggccgtggctccatttttcggaccgaccacaaggatattggcctgatcaaccccatggaggcagctactacctgatcaatggccaaataattggccagctccaggatgatcagggaggaagaagaagaagacggagatcgacctgaaacaaaccaaaacctcaaaacccttcgatgtgaaatagatgcagccggctatagtacgtacgtacagcagcagagctgcaggctcgtcagtctctcagccatgtcgccgtacgttctcagggcatcccgatgcagtcactgacctgtcccttcaccggccatgccctgcagcacggagcttcttctcccgtaaaaaccaccactcctccatcgatctttgaattgagctcccactgcatgcagagagacgacgacgcctcgcctgcgtgcatgccggtgactagaccacttgcgtgactgcgtcgatcgagccgcgcgcccgcgtcgccgtcgatctgatagatgctgcctcagcagcaaacggtagagactagctagcgcgtatgggaaactgttttaggtggtgtttgggaaaaagggacttaccaaacaccaccttagactagcagaacgtccacctatttctaacatgtcatctaaatggttataaaatttttttaaaaaaattaacatgataggttatatatgtaatatattacttcacaaacatacaagttcaaattcgacttctataagttgtaacaaaaacaacaaatttaactatatatataggcaacatatcctatgcacacaggccctcacgtgtacacacatgcacaccaactaaaaaatatcaccaaaaaatctagaaaaattcatacacgtactttcaattgtattacacctagggttaaaatcttaacatatatatatatatatatatatatatatatatatatatatatatatatatatagtcaaatttgttatttttgttacaacttgtagaattcgaatttgaatttgtatttttatgaagtgatatagtattaaatattaatctatcttgtattttctttaaaaaaattataatcatttagttgacatgtaagaaacacgtggacgtccacccgagagattaaaatccatcttctagcgcgtatagctcttgccttcttggcgcattggtcggctcgggcatctcggcatctcgttacctcttatctgaaaccctctcaactctgaagctagagaccatgcatatgcatgggcaagacatttgatccggccgcgcgcggctagcccgaccgatcgtgccgtctcgcgggagcagtaaaattccggttagtaacagcgcgaattgaacactggtggagaaaccatctttactcggttagacaaaatccacaatagtcccggttgcaataaaaaccaggattaaagattatctttagtcccggttcaaaagtttagagctgctttttaatctttattccc

SEQ ID NO: 64737 - DNA, 12282 bp, Oryza sativa
  unsure (1)..(12282): unsure at all n locations
gggggctcgggagagtgcttttatgggcgagggaggggaggacgtggccggggatggcccctattgcgccggcgacgtggggtagtggggaggaagagagagagagaggagagacgggattcaaaccgaatcccggcctctaaacgggcgcgcgcgggagaggtggaggaggtgggcggtgacgtgggtgcaaggtgcgggcggagtgggggtgcggataaggcgggaaacggcggcggcgtggggaggtggggcgccggcgtgggcggcgggaggttagggacgaccgacaggtggggcccacctgtcggcgcccgagagagagagggagggagggaggacttcggggaggggaagggaaggagggggctggcccagcaaggagggcgcgcgggagggaggttgggccgacggcccaacaaggaaaaagaagggaaagaaatgtagaaaaagaaaaagacttttcctggaattaaatattgcacttgctcatttttaattggttaaaattacttttaaggctctgaaaattccactaaaaatcttgttaatgtattgtgacatgtgaaacccaagaaaaatcccacaatgccatttccaattattaattgtatttattacttagggatttagctctaggttaattaaaacaatttcttcggatgatttattaaacaatttttttaaaaaaacaacggaaaggggaaacttcaaggcgtgaaacatcccctcttaggttatgtttttttggatgaagggagtactaattaataagggaattgacatatactagcataacacatttagaacataggagcatccctaataagtactctcttatattataagtctcgttttgattttttaacttctttaaatctaaccaaatccataaaaaaaattggcatcatttataacatcaaattagtttcattaaataaaacattaaatatatttttataatatatttattttgtgttgaaaatattactaattttttctataaattttgtcaaactaaaaaaaatatatctatctattatatactaaaagtccattaaacttcctacaaacgctctcaagccgccacgtgagactcctacaaacgctcctaggccgtcacgtggctctatctaatttgaccgttgatttttacttaaattggtggacccaatattttagaccattagattatattttcacttaaattggtggactcgacatttcaggtaggttattagattagatgtattttattttaaagaaactaattatttcgttactctgatacgtacgtacatgggagaaacaagaaaaaaaaccactcacggaattactataaaatcaataagaaagaaccatacgtacttggtaaaattgatgatatttagaatatgtttttctattatttaaagatataaaatattttactctataaatttacgtaaataccaccattgattctcatttaaattggtagactgtcacgcccagaaattcacgaaccagaatttctaagctgaatgtgtattaaacccctgttcaggaccagccagggtacacaaacgacaattgttgacatacagatccacgtcttacaaaaatataaaagattacaaatgcagcggaaaagataaaacaagctagacttggaaacttgacttctgcagtggggcgactccactccacaggcaatccttgacagcagcgacgaaaccaacttcgacaagacagctcccactatgaagatctttagctctggtgtgggggaaagagagcaagattgagtactacccactgtactcagcaagacataccggaagaggaggtataatgcaagatataaccaaaggaggctaaaggttcttttgcattaagctagcatttaaaagcaatagttgaaagcagtaaaacagttgtagtaattaatcagtattaaccaatcactgtccaacgctacaccacgttgagacaggcccaaaccaccacctgaactaaccagttcattagctaactaggggtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggctgtgataggacccttcgcataacccccctctaaccgatcgcaccacaccttagggttcgcccctgtccccagcaggcaacgggcagcccccctttcatgctgcggtgaatccggaagccgatcaaccggacaccccggccgacccaactccatcacgcccaccctcgcctgggtacgtcggctagaggaaagctacactataagcccagccgttgcccacgctggcttgtggtaagtacggtaagttcttccagggcatcccgcgaaccggtccttaatcgccatgggcacgactaacaaaaccatgcacccacagcccaccatgtagtgtattttaattaaccaacaccattacggtggcactaaaccaaagctatgccaataatcaaagtctatgctttaatgtgatcccctttgtgtactagttgaactaagcatggctaagcatttcctaaaccaacatctagtcattttagtacccgagttatcaatggcataaggtaactaatatatggctgagtagtaggattcatcccacatgatattgtaaaacaatgcaatatttaatagaaatgcgggacatttgtaaattgggtacaatatgatcaattgtaatgcatgacttgccttgctctcgtactgatgagaccacagcaacgacttcgaggaaccgcggatcgacgaaacggccgaaatctacgcgacaaacaaagcacacaagcaaaacatgttataagactactgaaacaggaaacaaaaccatttttaatggattctatacatttttatgaatttactaagacttgaatggacttaatcggagctcggatgaattagttatgatttttagaagattatctatgtttttactataaaagaaaaactcttaatcaatttattgcgcaataactcatcccaggactgacgtcagcacaagggggcggcgccgacatgcgggccccacgggtcagcggctcgagagagagtgagggagggacgcaggcacgtgggccccactggcagtggcacaaggcgggaggggttgcggctggcaggcgggccccaccggccgggctccaaaagggggggggggggtggcacctggctcggctcggctccgagccgaccggccggccatggggtggcggcgcgcgcggagctggcggcgggacatggttaccggcggcggagcgggagtcggaggcgacggctggaagcggcggcgggggaggcggcggcggccgacgcggaaggcggcggcgtcggccgaaggcgacggcgagtgcgtggagaggggcggcgcaaacgagagagatgggaaaagggaggagaggggatcctcaccggcgagcacggcggccggcgcgaaggacgaaggcggcggcgatgacccgacgagcgtangggcagacgggcggcggttgcacctacggaggaaaatggagaggaattaggggttgggaggaagctcaccgcggctagcgtggccggtcggagatgggaagggcggcgaaactcaccggcgcacggagagagaggtgttccggcggcgggattggatggggatgcggctgccggggtagctttggcggcggcgaagctaacggcggcggcggattggctcggcggcggctctagcggtggcggcgtgcggccagagcacggcggcgagcggcggcgctagaggagatcggcgcgagcgcggtagagggcgtgcgagagcgtggcgaaaaggggaaaagggagagggggacgcggggaagctttataggggctcgggaggggcggacacggccgggaagccccccgatttggctggcgacgtgggggagggagagaaagagagagagagagacggattcaaaaccgaatcccgccctctctggccgcgcgcgcggggcgggaaggcgtggggaaggtggcggcgacgtgggcgcggcgacgtggggcgagtggaggaggtggggtgccggcggtgcgggcggttggagctccggctccaacggccggaggtaggagacgaccgacaggtggtccccacctgtcggcgcccgaagagagagggaaggagggaggacttcggggaggggaggagaagcgggccggcgcgggaaggaatgggccggcggcccaagaaaaaggaaaaaggagggaaaatgaaagataaaaaggaaaaaggattttcctagggatttaatattgcactttgcttatttttattggttaaaattatttacaagtctctgaaaattccactaaaattcctgttagcatattttgacatgtagaatccaagaaaaattccacatgttgattctgattattatttgcatttattaatttgaggaattagctctaggttaaattgaacaatttcttcggacgatttattttacaaattttaaagctggaaaggggaacttcagggcgtgacacagaccaaatcgatattttagaatattagattagatgtatccattataaactaaaagtccattaaacttcctaaaaatgccatctaaccatcagtttccacttaaatgggtagatccatcggatatacttttaggaaaatcgtaagccaccatgttttatgtcttaaacagtagataaaataacagaaaatgtgagaaaataatggttcatcggtttcacttaaatcatttagataaaatcgaaaaaaccacccctccacttcgccctcccccacacatacgcacaacacgacattactcatcccatcccttatcggcttgagctctccactctacccattcctgtttatatagtgagaaaaaataaacaatattaaaacatgcataaattcaaagctacacatcttatttctaatctaaatattgttctatttataattaaaccaaagatttaaagatccatgaggcctatattttgaactggtataaaatataaaataaagcaagtaatagaatatgtcaatagggactcaattgaactatttagagaaaacgtaataagttcgcaaaaaaattggttcttgcattcactaaaattggaccaaccatcgcatgttccattttcgtaataattttaaaatgcttagacattaatggccctacatctttcctatatattacacatataaaccgcacaaaggttcgcagtatatagttcattgaaaagttatatttgttactattaaattgaaaattttggattcatgctaactaggtatgttcttttgaaaaatatagtatagatcacacaaatcacatggaagcgaggtatatgacatgcctttataaatttatatataagtatgtaacaacttgcatcaacttaaaccgactagaaggagaactacttgatggtacaaataaaacctatttattatcaataatagttctttagaatttgttaaaaaagcaagtaaacattctattaaaaaataacaaaacaacttatttctaatttacacttcatttgttagacacgttttccaaacaaactgaatcgaacttctttctatataataaagagatcgtagataattatttatacatatgtattaaatattatatattttaaaacctaaaaaatatcttggaaaaattatcaaagcaaaatgccaatgaacaacagatgcctcacctgatgtgttctgttaaaaagaaacttgcccgcgcaaatacgcgggctaacttcctagtttgattaaaaaaagttaaaacgacttataatataaaacgtagagagatcagctactacattcgtcaaaaatatgaaggatattaattgctcatgtactactatccatcaccaatttgatatccctgtagatactatcgatggcattgctagaaaaatccatccattatcatacacatgctcaagtatgtattattgctacattggatccctagcatctcatgatacaaatagaaactaaccatactcctagtatatactactgccatcatcaatttttgcttttggacatcaaaaccatactcaatcctcgaaaaattgcaaggaatggaaaaaaaaaaacctaaaggcaaccgaagatggagcacacaagtgctccccactcgttttttgggcgcgtgccgaacgaagaggcgttgtagctgcataattcctagctagctcgtcgtaggaacaccaaagttggggccggccggtcacttttgcggtggaaggaacccctgggtactactagtacgcgatacaaacacggatgattgcgtccttatgcgttttttcgcatgcacttcgacggatcgatcgatcgatggatcacacacacatcaaccccaaccgcaggccatcatcaccggcatcatggcagtaggaggcctcgacacctcgatcgctcagtcgttcgctcgcctgctcctctcatctctgtacgtagcccagccgcggcagcagccgccatcatgccgcatgattgcagcgagacaacggcccatcgactctgtccccattgccgcacatactatcaaacaggattgctcgatcgatcgatcgatcgatcgatctacgactactactaccactgtcagcagcatgctcgcagcggtggtcgtagtagttgtaggcacaacctgcatgcccacaacaatgatgatgatggcggatggccggagtgcatatgcgttggcctgcagtgcagtgaagcccggtggatgaggaattgatgatggccgtaatcatgcctgcatgcagaggagaagggaattctcccattcctggtcagtttcacatgcttccgcactgggcttctacaggtgtgacagtgtcttttgctcgttccatggaattatacaatctaattagcatcattagtcttcatgcaggccaagagaataaaaaatacacgcaaatccaacgtgctactgtacgtactagtactctccccgtctcattttaagtgcagctatgtttttccgtgtctaactttgatcgtctgttttattttaattttatttaaaaaaattaaaaacataagtcacgagtaaagtattattcatgttttatcatctcatagcaacaaaaatactaattataaaaaattttcaaataagacggatgatctaagttggacacaaaaactcatggttgtacttacaatgtgatggagaaagtaatatgctgcacgactaatcattctgtctttctttcaatttttccccctaagagagtgtcattatgcgtgtaatgcatcatgcgctatatttactatactctctcctagcctcctgataaacttaggctgtgtttagttcgtactgaagtttgaaaatttggttaaaattagaacgatgtgattaaaaagttgtgtgtatgaaatgcctcctgataaacttaggctgtgtttagttcgtactgaagtttgaaaatttggttgaaattagaacgatgtgattaaaaagttgtgtgtatgaaatgcttgctgtgatgaaaaagttaaaagtttgaaaaataaaactttggaactaaacagggccttagcatataatctattttatttaaaaaaatactcctaatggcagcacatagcgcttgtctcattctgaaacaagaaacgctggacataatcaaactagttgtctgaactccaaaaatactcctaccaaacactagtctccactacattaccactagtactcactcccaaacaaagacacaatcccaaggtcacaaaaaaaacccgagaaaaatccacgcaaaaatcctggaggattcaacaacagcagcagcagccattcttttatctttttaaaatataaaatatgtttatagctgacctatagcttgctatcgtaactgctcttatcccatccatgagcggctgctgcgtggccagctttctgctaaagattgcgggtgctatttttaaaaggggaaagattacgtaaccccagtgatgattacggtaattattgtcgcctgcctgctactagtactccactgtactaccaatccatccatccaaacccttttttttcacgtagccccccggcgaatccgcgaattgcagctcgccgtgtcgccggccgaccggggctttttcctttcctccgggtcacgtgcggcctcgtcaaccggtcaaaccccgccattatcacgcagccacatacgcgccggagggaagcgagcgagagaggtgtgaagtgtgaggtggtcaggtcgtcttcttccttcgctgctgctataaaacctcgcggcggcttgcgcgattacgaggttttccattgctgtgtgtgagtgaggtgagtgagtgagtgacggattgttgggagagatggagctggggttgagcttgggggaggctatggcggatgctgggagggagctggttcttgggcttgggatggggaggagggaggaggcggcggaggcggggaggagggatcatgaggtgaggagggagctggagttcgggtcgatgtcgagcaggtgcggtggttcttcgccggagccgacggtgcggctcacgcttctgcccatggtgcccggccttggcctcccatggccgccgccgccgccgccgtcgtccgagagcagtgagtgcggcgatggtggatgggtttttttggtggtggtgttgagatgggttggttgatgcgatctgtgtggttgggtggcagggcatttggaggcgtcgacgcggggattcgacgtgaaccgcccgccgtcgtccggcggcggcggcggcggcggcggcgcggaggaggagcaggacgacgtggccggggcggcactctcgtcgtcccccaacaacagcgccggatccttcccgatggatgacttctccgggcacggcctcggcggcaacgacgcggcccctggcggtggcggcggcgaccgctcgtgctcccgcgccagcgacgaggacgacggcggctccgcgcgcaagaagctccgcctctccaaggagcagtccgcgttcctcgaggagagcttcaaggagcacagcaccctaaaccccgtaagcttctcttcctctcatcgatcgaacaccatggcgtcgtcgtcgtcgtcgtcgtcgtctcgctctcctaacgttgcgtctcggttgcgttgtgtcgcgagcagaacagaagctgcgctggcgaagcagctcaacctccggccgcgccaggtggaggtgtggttccagaaccgccgcgccaggtgcgtgcacgcacacgctcgccgcgcacgacgacatgaatttccttctcccttctcgcgaggatctctaacaattttcggctgccgcgtcgtgctcgtgcaggacgaagctgaagcagacggaggtggactgcgagtacctgaagcggtgctgcgagacgctgacggaggagaaccggcggctgcagaaggagctcgccgagctccgggcgctcaagacggtgcaccccttctacatgcacctcccggcgacgacactctccatgtgcccctcctgcgagcgcgtcgcctccaactccgccccggccaccgcctcctccgccgcaacatcgtcgacggccgcgccgcccgcggcaccctcatccggcggcattgcggccacctcctcctccgccgccgccgccgcggcgccggaccacaggccgtcgtcgttcgccgcgctgttctcgtcgccgcgtggcttcccgctatccgtagccccgcaggcgcagccgccgacgagctcgtgactcttccaactctccggcgacggcgaggggcctgtttgtaaattcgctcacttttcttttatcgtttttttttgttttgctcctttggttctttgggattttttgtggcttgccaagtggtttagcgagaatccgagggggcagcgcgtctggccgtccgattgggacacgtcgacggcgcacgatgcttaaagaaaaaaaatgttgcaatagagcttattaacctttataatttctgcgattttttgttttctatcaacaccatggtttaaattttacgggtctcttgcaaaccaagagaaaattatgcattattcttgggtgtcctgccatgtccatttgttatagacttgctacgaaatcaaatgaatttaggcctctttgaaatactagataggaaaaaccacaggaataaaaagaaagtaagaattgaaatagtatgtttttctaatcctacagaaaatgagaggatgagctctttgattgcaccacataaacctaagatgtctaacactttgcttttttttttttatgaaattgaccatagtaatgaaatcctatgaaaatttttctatcatctatctatgaatcaaaaggactctatcggataaattattaggaaaaatgaatcctccatttcaaaggaaccttaacagataatactgtctctcctgcattagtgtatttttggtactgaagcgaaatgtaggaatcaagcaagaatgtgggagagcaccgacggtgacagttattgtccaccgcgcataatacgaacagtagacatacagtactaactacgtacggactacaacgttgtaatggtggtcccctctcacatcgcccgtaggccgttgtgtcgcacagccaccctcaaaacacttctacagatgaaaatgtgttggggttaacccaaacaggaggttaagaaaaaaaaatagagcaagtataataaggttagcttcaacagcggaaaaaggttcaagcttctctccgcataaaaaaaaaactaacctaagagggtatgtgttttctcttagtacaacaaatttagacaaataactgtctaaatcgttctactaggaggagtttttgggacggagggatctaaatcgttctactgggaggagtttttgggacggagggagtagagtagaagagttcaagcacttttcgttctactaggaggagtttttgggatggagggagtagagtagaagagttcaagcacttttcatcgatgtttcaaataccggttttagggaaaaaaatactgatccatctggctgaaatggacaagaaaaaaagaaatcactttgctcaaactattttaccacagcacttaccttttaaaggctcattttacttcctaacaatatttctttttttttctctctctcaattcaactctctattttacagtttggtaggatgatgatacatgtattataacttatgtctcaacactttatagaaccttttatgactgtttgcatgggctcaaagcatctactcactctgtcccaaaatataagtattttttattttgacacagtcttcgagatgctactttgatcaacaatatctataaaaataaaatattgtaaataaaaggagttgtatattatgatggtttaatgatagtttgattaatgataaatctagtaacatcaattttacatgattgatattttttattttttttattaatagtcaaagttaaaaatagttgacttgacactatgctaaaagtgcttatattttaggacggaggaagtaagattgatttagggtatgttcggaaccctgtgttcccaactctcccttctctttttccgcgcgcacgcttttcaaattgctaaacggtgtattttttgcaaaatgtttctatacgaaagttgctttaaaaaatcatattgatccattttttagcaaatacttaattaatcatgcgctaatggaccgctccgttttctatgctaactacttgtgttgggagcacaaggttccgaacacagccttaaacacaaaaggtcaaacaagcaatcatgaaaaactataaaaatattttttataactttgttaatggtgccatatatagttctacatatttgcccttaaaagataacttatacaaagatactactaaaagaaggagagaattgtttcagagtaaaattgaccaattctaatagtttcggagtgaaatgagaaaacaaacgatttaagattaagagcaagtttaatagtataccctactactgcttcaattcatctatagccgatctaatagctaattcatacaatagttgcttactatactattaatatatggaatcacctgtcatatacatattgtgtcttagagtccgtgctgcagctggctacagatctgtagcccgctgctattctctcttattttttatctcatta

SEQ ID NO: 64738 - DNA, 675 bp, Oryza sativa
ccagagcgatcgatcgcccatcagcatttccacgtaaaacctatattactagtcgttctcaaattttatggccactattacagatgtcggttcacttaaaaccgatacatatgagatcctcgaacgtaaaactgacacctataatacctcattagtaccagttttataataaaaccaacactaataaaataagtactaatttattaaaaaactggcacttatacatgagtcatctgcactggttctctaaaaatcgacgcttataagtgagtcatatgtatcagttttcttaagaaaaaggtgcctatatataagctgagctagctgggtgagcgtaggaggtctccgacgaaaatatctatataccaacctctatttttctattcaatcggttcctctccacttctcgttctccctcccagtctctcacttctctcccccttgtttgcctatctcgccgcttccacctccttctcttcgcttcgatctccccgacttagttgatgaggatgcagattgaagatgatggcagcaccggccgaagagggacgagctctcctcaagaaagcttgttcctcttcagccaactccgccgtctatcccctctttatcggatcccgccgatgcctccgaggagcttcttcatcggatccgcacctacatcgctgatgtgcg

SEQ ID NO: 64739 - DNA, 30652 bp, Oryza sativa
aaccgggaaaaaagatgcctactatctttagtcccggtgttaccaaccgggactaaagatctatttttagtcccggttggtaataccaatcggaacaaaagatcgtggcggagagtacgaggcatctgccatctgcgagatcgaggaggaggagacgggcagccttatctcttcacctcttcctccactgaccttatctcttcatcccatatcttcctcttcctcctcctcctctcctctaactcctctccttccctcccccatcatcccttcctcttcctcctctctaacttctcctctaactcctctccttccctccccatcatcccatcgggcggtgggcggcctcgcggcggggcggaggcccgggcggtggcctcgcggcggtgggcggcgctgtggcgcggcggcggaccgcggggccttgcggcgggcggcgcgctggcggccggcgcggcagcggccaacagcctgtgttttttttctttttttttttaagaatttgtgatttggatctatgtatttgatttgtgtgtgatgtttgtgaatatgtgatgtatttgtgatgaattttgtagaagttgtgatgtaattttgttttaagattttgtgatctatttgaatatggccgatttggggatttgaggattggggataatttatttgggattttgggatgggtatagagtaaaatcaatatattaaaaacacaatgaagaaaagaaaataataatagagcaatcggatatagctagctaggctagctctatctttagtcccgattggtgttaccaaccaggactaaaaaggctctatctttagtcccggttggtaacaccaaccgggactaaagatgtatttttactcccggtttttttacccgggactaaagatagtgatctttagtcccggattggtagtcccggtttgaaaaccgggactacaggggggttacgaaccgggagtaaagcccctttctccaccagtggaaggcgaggttgggtcacatcagatcagctgcctgcatcctgctgcgtacgtactcgatcgggatcgtgtccgtttcagagagactgtgtttagatccaaagtttggatccaaacttcagtcctttttcatcacatcaacctgtcatatacacacaacttttcagtcacatcatttctaatttcaaccaaaatccaaactttgcgctgaactaaacacagccagaggacatatatcgatttggaaacggaaagggctcaaagcatctctgcctcctgctatagctatcactctatcgtcgatctacccggtctctttccagctgctcgatcgatcgatcgatctttcgccgatcatcgtggtctaggctcagtgcgtggtcaggtcatgtgcttcaacagtggcacatgattgctgtgttctctctcatgctgcttccgtatgcgtgtttgtgggagcgacacactgtacgccttgttcgtgccactactgccgtttgctattggagtacttgaccagtgatgctactactcgggcgctctagcttgctctacatttgtgtgtgtacactgatctcatcgaagagtaaaaagctcattaggatagaaaccaatggagttacaaagctgcaagagttaagatcataatgaaccatcgtattattggcaccgatcatcatatcataaccatcgtattattggcaacgacgttgagtttccgttgtcactatgctagggcctaacgtcatgtcctccgtttggatggccaatcaatggggagatccatcaagggcagccagcattaattgtgtgcctgcgacgtacgacgtcgtgttgggccacatgtcgggcagggaagcgcccggctgattgagctccgttgtgtccacctcttgcattcattgttgtcctgataatcttacgaaatttgttttttgtcgtcctcgtgtcacactgctcaaaaatcaaaccgtgcaccgctatatataactagaccataagagaagagtcgcaatgaagcaacgatgaagaggatggacacaatgatgatatatatgtcgactgtttaatttcaagtgaagtagctagattgcttgcattttactccttttccgtctaaaatatttgacgttggttagtctggagtactttattttcagtctctctgtaagcatatatcaaccaagcgaaaacacatgcattgatatatccaagaagcattgctgcatatgaacagggcacaccactatcactatacgtggcccatcagttaagaaagtaccaggtgctatacgaaggatgcatcatgcatgtggctgcttcatgtgagatttgtgtacatcgcagtggcgacgtgcgttcgttttcaagcagacagattttcccaaatgggccagtccatggggtcatggccactctaattcaaatcaccttttctgcgttgtgtgtggaactgtgagcttgtgatctgaagtctactcaagcatgtgtgatatctccgtccttgcccccactcgcaatcaattgattttgcaaaacattgttctattgcttggggcttgcttcatcagtcgaactgctgcacggccgcacgggcactgacgctactgagtactgaccatgcattcttctagttttttttctgtatatatattcccagcagaaagtatgaatgcaattaggaggtacagctctctgtagctaattaatcactcttacgaatacgtacagtaaatgtagcactgtagatatatattagtactactccgtcccaaaatataacaagatagaaccaaattagatactacatcttagaacgatgatctaaacatggacatgtccagattcataaatagtgggttatgtctaatacaatactaagttggtatattttaggatgaacagagaggacacaataattgaagattgtatttgagtgtgtagtagctaagagcctcattggctgccctaataagtcaaagcaaaaactaaaatttagattttcaaacttaatttcaaaactgattttaagatattttaacgtagtctttttttcaatattagcttttaaatcaataagaaaattaataagaacaagtacataaaaattttatctataaaataacttttattccctaataaaccatatatagccatataggcaaccaatgaggctaatactgcatagcctatatagctataggaggctttaccaattgggataagttcactttagtccctcaatttgtttccgagtctaaaattcatccctttatagcgaaaccggatacaacgcatcccccaacttataaaaccagtgcaaacgagatcccttaatagtattgtccccggttttggccgatgtggcgcatgcatggtttctttgactaggtcgttgtcctaggtggaaatgacaagatgattatgtggcagtttgatccaaaaaaaataaaagagcaagattgaaaataaaaaaattaaacaaaatatgtttggcccatatgtcagtcaaacacaaaacaaaaaatagtgggacctagacccacatgttagtgggcccacttctgccaccccaccctctctacctctatcgcctctctccatcgacaagccgaagatagctaagcgcgcgcggagaggaaggaagcagggaggctggcaagcaggatgggaagggaggaggcggggagggtggacttgggcagtggagagaagggtgacgatgggtgttggtcgaccaggagagagatggggctgggcatgagaaaggtggggcaccgacaacttcttggttctcttcgtctttgtcgtcaacatctcttcacctctatccttctcctcgcctactacctcttccttgtcatcccctctacggtaaggtagcaacggcagtgggcgatcagcaaggaggagggccacggcggtttgtggcgacggagaaggtgagggaggcgagggagccagtgagctcaagctcgccatcccttccacgttaaggcagcaacggcgaggaagggcccggagctttctgatcctgcctaaaccaatgcttcgatgtcgtcctcccccgatgcgccttcccttcttagccatcattgtccgtgggcccaacacatttacgactccaacctctccatgccacttgctgcgcgtcacctgaagatgggaagaaaggtgtcgatggcgaagggtgtgcccgcggtttgggagggggagggggtcaattctggcactggcagggcgtacggcgacggggatggtgctggagctgattgtggcaacgctgttgctgatgctcttaaactccgtgctagtgtttgttgtcgttgcagcgtcgctgctggcagccaggtttgcgtcctccgtgcggcatgatggtgtggatgtaccactcgccagcctccaggcctcctcctcctcctccttgtcctacttcttgcctcctccctctccgcacacactctctgccctccccactaacttcggttggcttcagctcactagcagagagaggagatagaggtagatatggtgaggtggcggaagtgggacccactgatatatgggtcccactaatttttttgacagacatataggtcctgtgtactttgttttagtattttagttttcgattgtgctcatgttcttttttggatgaaactgccacgtaagcgccacatcattgtcacgttggacgaagaactagtcaaaggaaccacgtaggtgtcatgtcagtcaaaactatgggataatactgctgagagatctcttttgcgcttgttttgtaagttgggggatgagttgtatctggttttgcggtcccaaatataagaatcggagacaaaatgaggggcccaatgtgttcttcccagttcgtgtccacagagcgtgaaggcccatagtgcgcgagcgtgcgcacctgacctgactgccagagcggctcgctagcccgtacattcggcctggcccatctaactgcctcgcgctccagagagatgggccgtctacgcattgcagctcccggctgaccaggccgctcacactttgggccgagccggcgaatcaggctggcctgggccaagactggtgagtactgggctatgggctattgctccttcaggccggcgagtttgttccggcgaactccactggaccaccttcatcatcgacgaagacgtgaaccagtgcacgtacgctcaccaagcatgctgaaaatgaagggggcgaagggggttgtgcaatcaatgaagatatgaattaatatcaagattgatttttcatatcctaattaaatatatgtattaatatcaagatcgattttcatatcctaaattccttattaagttgtttgattagttcgagtatcttacaagaccactggtacatctccttccaacaacatgtattctgcatactactgtctgctgatttgtaagattttttatcaagttttttttttcaccctcagaacattaccccgtttcccgatctaaaatttgaactcagaaccaggcaagaagccaagaacactctgaacacctgcacaccactccaagaatccgagcccaaaaccacgggcgagaaatgatgatccgtggatggaaggaccagctccatcgaccggggagcacgccattgattggccgtgtgcccacgtcgccggctctgaaactgaaatccagcaaagcgatcatatcgccagcgccagcgattcagtcggccacgatttggcgcagaaatctacgtgcccaccacggcagccaagccagtcgggccggcactgaatttttttggcgctccgatcggctgctgtgtctacgctgcgcgcgattcgcccacaaatctggtcgcatccgcgcccaacttgacaacttgctgcaaggattgctcgtctcgtcagatggctggttccaattcaaccgttccagccgcccgttgccgtagcctggacgactgattcccttctgttgcaaacaagtactccattccaatttccgtgggagcgcgggggcaggtttggctgcgcgtctggaacagcggtggacgcggtcgatcggttgcagttagcgaatggcttggtcgcttgtgacggtggattacacgttacagtaccggattgggtgccgctctgcatgttgatgttcccagatgttgggatcgatatcagattttacggaagcacaacgttctttccagtttcgctttggaacctgggatatcaggtttaaacaaatgctattgacaccagcagggtgatggaagcaaacccttccgtttaaattactggacaggcaggacagccgcagggaaacgaaaatgggagagaagcctggcaaaaagagatggaaaagaaaattggagtaaaaaaatactccctccatcccataatataagtaattttgactttttcttgcactgtttgaccattcgtctaaccaaaaaattttagaattattattttttttatttgtgacttactttattatccaaagtactttaaacacgactttttattttttatatttgcacaaattttttaaataagactagtggtcaaacggtatcttttatattatgggatggaggtagtagcgattttcgtagacactttcgagcaaatgggtggttcaactgcatgaataaatagggtttgatcgtctgaaaaaatgtttctttcttttgtagtgtacgtatttttcattatctacttctagaagttatgctgacattactggtactggttgcgtgcttagtatattatggactatggaccgtcgatccatcattgacattgctagttgaagtgctgacagagctaatttactttagtccatcatttcccgttgaatattatattgatactctctcttacaaatgcataagtactataattgacacatgagacttaagctcgctctgcactctgcagtagtatgcagcactgtataagtgtatatatatatactacatcattgtacatttctagttttctactctctcgagccaagaaattaaagaacgattccacgaaaagttagactcagaatctcatactctgatcccagacacttgtactcaatattgctggttgaactcaaccatccacgtagtactcaatagtgaatacacaacgtagtgcgtatcatgtatacgcacatgcgtatgtacagccaagcatatccatacgcttgtaataccgcggtatcatgcatccattaaacacacacgtaaacgttaaacctcacggtccctcaaccgacggactgtaaatctggcagaagcgtcttacctctctcgaggccgcgttgcatgttaatatagatgagaatagccctcaccgagacgtgtacagattggagacatattacatcttgcaatacaagaaagaaaaccaaaaccgattctatctctaaccatagatacgacatatacactacattaacatatgcgtgtatcattgtcacatgtacaaggactcttgtaattctaacactccccctcaatcataacttatctaagttaagattgtgtctaaaatttcttagcagctgaaccgacaatggtttagtaaaaccatcagcaacttggtctcctgaagatataaattttatcaccaattgtttcctggcaactctttctctgaaaaaatgataatccacttctatatgcttagttctggcataaaacacaggattaactgaaagatatgtagcaccaagattatcacaccataaacaagcagcttgagatgtattaactccaatttcctttaagaaaagtttgtatccacattacttctgcagttgcattagctactgccttgtattctgcctctgtacttgacctggatacagtagcttgctttctagcactctaggatactaagttggatcccaaaaacacaacaaagcctccagttgaccttctatcatccacagatcctgcccaatcagcatctaaaaaagcactcacaagcatagaagatgaatgacatattttcaaacccaaatcaacttaagactttatatatctcaatatcattttcactgatgtccaatgttcaactgttggactatgcaaaaattgacaaaccttgttcactgagaaggaaatatcaggtctggttaaagtcaaatattgcaaagctccaactatacttctatatttagttgcatcattttcacccagaacagtaccactataggctgataatttctctgaagtagaaataggagtactaactggtttacaatccatcattccagctttcttcagcaaatccgtagcatatttttcctgttttagtagtataccatcatgtaacttacgcacctctatacccaagaaataatgaaaattccccaagtctttcagtgcaaactcttgtctcaagtctgccaataatgcaatagctgccccttctgtagaacttgcaacaattatatcatcaacatagataagcacaaagattgtaacatcccctttattataaaagaacaatgatgtgtcagccttagatgccttaaaaccaagatcacataatttcatactcaaccttgagtaccaagcacgaggagcctgtttcaacccataaagagctttgtctaacttgcaaatataattaggcttacttttatcttcatatccagggggctgtctcatatatacttcctcctcatgataaccataaataaaagcattctgcacatcaagctgtcgaagacaccatcctctagatacagcaatagacaagataattctgatagtagccgctttaaccactggacagaaagtatcttcataatcaattccatatcgttgtttaaagcccttagccactaatcgagctttataacgatccagacttccatcagacttccttttgattttatatacccacttgcaatctataatattcttgccatgactaggtggaacaagatgccatgttttattattcaaaagagcaaataactcaatatccatagcattcttccaatcattattagctaatgcttcacttaaattatttggttccccgttagtagcaagaaaagaataccgcacagtcccatccgtgtataccttttcttttcttatccctcgttgaagacgagtagtgggtcgagtctgatgtcctgtctgttgtacatcttgctgttgttgtattatctgcatgtcctgctgctgcacatcttcctgcaaagacgtgactggtgatacaggcgactcaacaggcgatgatgaagacgacgtggtggcagtggcaggcggtgattggctctcttgctccccttgcgacgcaacactaacatcctcgtcagcatcaaaccgcacggcatcagaaaaaacaccatgggagtcctcgctattagactgattatttgcatcatgatctggattttctgtgccaccaggatcttctgtatttgcgccaaaaattcttgtatcacccgtatttatatgctccccataatctgaactttgcccctgctgatctgtaacattctcatatacaccattagaatgttcaggagtattaagcatatgatcattactatattcaaccccagaaggacttaaaaatgaaggtaaaagcaatatttctgatctcaacctagctcctgcatttgaatgcagtttagagaaaggaaaaatattctcataaaaaacaacatcccttgaaatataaactctgccactggatatgtctaggcacttgaaacctttatgtatgttactatatccaaagaagacacattgctttgagcgaaactgaagtttacgcttattatagggacgaagattaggccaacaagcacacccaaaggttctcaaggcagagtagttgggtttttgattaaggagtcgctccagaggagtatcatattgtatgactttgctaggtaggcgatttataagatatgtggctgcaaggaaagcttcatcccaaaatttaagcggcattgaagcatgagcaagaagagatagcccaacctctacaatgtgtctgtatttgcgctctgcggaaccattttgttggtgagcatagggacaggagacatgatgagagataccaatcttattaaagaaagaatttattttttcatactctcctccctagtcattttgcatagagatgatcttgcgattaaacagtctctcaacacgttgttgaaactcatgaaacttggaaaacacctcagacttattctttaacaagtaaatccaaataaatttgctgaaatcatctatgaaactgacatattattttctacccccaacagaaataggggcaggtccccacacatcagaaaacactaggtctaaaggatgactcgacacactagaggatttgggatagggaaactgatgactcttagcctgttgacaggcatcacacacacctaactcattaatttctcctaaacatgggagtttattgttgctaacaatcttttgaacaatggctaaagatgggtgacccagacgactgtgccacttagaataggtaggcttgacgactccgaggacttgcttggatgaggaaaacgaagatgttggcaacgggtaaaatccattgcggcatggccctctaagaagaagattcttcgtgacctgatccttgatggcaaagaaacgagagtgaacttcaacaaaagcattgttatcaacggctaatctatgggcagatatgagattctttttagccttaggaacatgaagaatatttttgagataaatattgcgaactggggtatgaatagtagaatgaccaatatgcttaatattcatacatgctccactcgccgtgtggatttgatctttgccattgtatttctcatgagtcgacaatttctccaactctcctgtgatgtgatcggtagctccgatgtccatgtaccagtttgtatctacaccataggaggcagctgctgctgttcggaaatccggaacgaagctttcatcatatctgtgccaacaatcagccactacatggttgatttttccacaaagctggcaggtaagacgaggtttgttgctgaaaccgcgcgcgccaccatttcctcggccgcgaccgccacgatcgccgcgaccaccacctccgcgcccgcggaaggaattggctgagttgctgttgaagttgctgttgaagccgccattattcttccctccatgcttggcgctgttgacagatgaagagctcgcctgctgccgcaatctagctctgctttcaaagcttagaagctgagaatagatttctgtgataggagccggctctgcccttccaaccagattggacacaacaggctcatagtcatcatcgagtccagcgagaatataagacatcatctcctcgtcatcaagcggcttccgagcagatgccatctcatctgccaatgatttcatcttcccgatatactctgcaacgctgaggtcacccttgcgagttgtcgacaacgcgagatgcgtgttcagagcacgcgatcgagactgggaggacaacatcgttgtgattgccctctaggcttcagcggttgtctctatattgacaacctgagtcagaatctcctttgataccgatgccaacatataacttagcacctgctggtcttcagcaacccaagtctcataggctggattggaaaccttgacaagcttatcaccttccttggcgtcaacttctgcagctggagcttgctttgcgccggtgatgtaaccttccatgcatgcacctctgattgctggtaagatctgtgtcttccataacaggaagttattcctggtaagcttctctggaataggttgtcccgagagagggttggcgccgctggaactagacgaactcgccattgccgtagatgcaatctcgtcgtggctatcctgctctgataccatgtaaatctggcagaagcatcttacctctctctaggccgcgttgcatgttaatataggcaagaatagccctcacagattggagacatattacatctttcaatacatgaaagaaaactaaaaccgattctatctctaaccatagatacgacatatacactgtattaacatatgcgtgtatcattgtcacatgtacgaggactcttgtaattctaacacggaccacgtggccggcatggatggcccaggaaagccgtgtcagtgtgtgtcaccgcaccggagtagtgtgtgtgagcgtgtcaccgcaccggatagatcagctagctagtagcgatccactcgatcgtaaatggcgcatccggatatgtcacgctcgcgagtcccaggcgccccggccccaacacccatctggctgctgatggccatccccatcaccatacggtgtgcgagtgacaccgccgtacgtgtcgccgctagctagcaggcgctcaatcgtgtatgcgtatatgcatcgcgtcctatgatttcgttcgaggtattatgtttttttcttttttttatgatttttataggcagtggttgaacaatctagcttttgagtaatagcgatctgcattacgtccttatgcaaatacaagtgatggtgattaatataattacataagctctttccttggtccgcttctgagtgttttcattatctacttctagaagttacgctgacatttggtactagttgcgtgcttagtatattatggactttggactgttgatccatcattgacattactagttgaagtgctgacagagttaattctttaatccatcatttcccgttgaatattattgatactctctcttacaaatgcataagtactataattgacacatgaaacttaagctctgcactctgcagtagtatgcagcactgtatatatatacatcattgtacatttctagttttctactctcgagccgagaaactaaagaacgattccacgaaaagttaactcaggatctcatagcgttcaaccctgaccatccacgtcgaaaattcgacgccacgcacacatctaccttttccaaccgaagaacacggagccaaacaaagcaacccgttcttcgtcagaactggcaggcgtggggcgaggggcacattgggagggggcatggccccatgcgacgcccccatacccatgcaacggcggcggcggtatagggagaagaagagaagatagcaactgcggtggcgtagggcgtaaaaaggaagatgccggcggcggaggaagagaaggtggtggatctagcacctaacttcatcgttgtcattgttccgcgccgcctccaaacgcaacagtgacagatcgacggcgtcgagctatgccgcgtagtcccccgcaagcgcgctgccgaactccgccgcgctgtccgtcgcaggcgcgtcgccgagctccccccgcgtcatccgctaatagtcggaggaggaggagaagcggcgccgcgcttgggctaggccgccgccgagctccgttgtgccgttcgttgcgggtgcgtagctcagtcgccagggagacgctcactttctctccgccaggcaaaattgctaggagaggagagagatggggagaaaaagtgaaggagaaataatgacgagacccactacaaatgatttgtattgtggagcatatgataaatacagttcttagtctacgtgttatgtagggttcggtataaatctgtgacgcactgctattgtcatcatactctgatcccatacgcttgtactcaatattgctggttgaactcaaccatccacgtactactcaatagtgaatacacaacgtagcgcgtatcatgtatacgtgcgtgcgtacgtacagccaagcatatccataagcttgtaataccgcggtatcatgcatccattaaacacacacgtaaacgttaaacctcacggtccctcaaccgacggaccacgtggccggcatggacgatggcccaggaaagccgtgtcagtgtgtgtcaccgcaccgggtagtgtgtgtgagcgtgtcaccgcatccgatagatcagctagtagctagtagcgaccactcgatcgtaaatggcgcatccggatatgtcacgctcgcgagtcccaggggccccggcccccatctggctgctgctgggcatccccatcaccatacggtgtgcgagtgacaccgccggccgtacgtgtcgccgctagctagcaggcgctcgagatcgcgtatgcgtctgcatcgcgtcctgtacggttccacacgcatacgatggcatcaccgcgcgcacacgtcgctctcccaagctagtaagccgatgcacctcgcgacgagccgctaccgctcgctactcgtcgcgattgcggcgcccccacgacgtcacgcccccgcgcatcctccccgtacgtacacgcaatcctcccgcgcgcgcatcttatcgcgtcgcgtcgcgtcgcggaaacgtttcggcgatttggggcggcagaggcgtgtggcctggtgttattacctggttaatctccaccacgtcgtaacgtggcgccgcccacgcgagaacggccgctttgctcgttggattagtagctggagcttaccgcgctccactaattaccagccgggccggcccggccggtggtcagaggttgacgccgctgctccgctgccgccacgtgtcgccgtggccgctaattcgcgagatcgtgcgtgtggtttctgatcaagtcaaacgttaatcccggctagccgcgggctaccaatcacgcatagattactcgattggattaggacggctggtaaatatgtaatcccaccgtttcaggttataagatattttaaatatagtcaaagtcaaaccgtattaaatttcactaagtttgtaaagaaatatagtaataatatttatattaccaaattagttttattaaattaataattaaatatatttttataataaatttatcttgggtttatttaattaaacttaaaagtttaaaagtagtttgagtttgatcaaagccaaaacatcttatcacctaaaatggagggagtattttatactactagtttaatccgcatgtgcgtgctcgatctatctatcgcgcgtgttcggtgacctgtataacttgatcgcctgtttacttttggggcggtcaaactgggatccttttcatttgcccggatccgtgaagaaaactttgaccgctacgtggcgttggatgctgatcgtgcgatccggttttggccggtttgtttattattctcgccttcgtctggcgtgagaatgagatgagatcgttcctgccttcattgctgccgtactgcgtgtactatactgtgtggaattcggcctgggcagctgttgattttagccatcggcggcggtggccgacgtgaatgagccgtcgccgccatattttgttcctttcggttgctacttctatagtaggattatgttgttgggttagtacagcgacgggtactgtaaatttatgctcgtttcttaatttcctactctacttttgattttggggattccttgtctatctgtttggatcaacgtgacattagatttgaatctagctagctggaaagctctcaaggcgtggtgcatgacaaatcacagatgtataacctatttgcattcaacaaactagtgtaacagtagataaagtttccccgcgttaagcaattcttcacaaaaggaggccttagcccttaagcttcgcgtaggcctgtgagggaggaagcatttagctacagtccttttacattcttcttttttttttttgaacgaagtacttttacattgtgttcaccaacagatcgaagaggaaatggtcacgagtgaccctgccgccctgcacacacatgcacattggcacgagcttagaggaatatttccaacccttaacccggccttctcataagaaagcattgcttggaagcgatccgatcaactcaaaaccaaacccagccggccagccagccccaagctgagtcatcaaacacacccccaccaaaacacacccatctcacccgtccatcgaccacaatccagcggtcagaaactcacaacatcttcttcagtctatcaaaccaaaaaaaaaaaataataaggagaactcaataaaataagcacacgatgggtagccatcacatcaaggtaaacaaaagtcaggaggattccttccaggttccacttccaaccccttcccagctctcgaacaactcaacgcgctaaacgtctctctcgcacgtatatatatactacggcctcacgccttcgtctccgcaaccatacaaatttttttctgagttccaattcgatttgttcgttcggttactgcaaaagaaagtcagcaacaaaatggccaacgcgaggaacgcggctgccgcgtcgccgccgccgccgtcgtcgtcttcttcgtattcctcgtcggcgtccgacggggagatcctccgatcgctgcaccgcctggcgagggatctggctgcggcggaggcgccggcgccgttcttggagacggtgttcgcggcggtgtccaggcgcgcgaagcttctcgccgcggtgttcgacgacctgctccggtgcgggaggctgccgcggtcggcgtcgctgtgcctgcgcgaggtgctgctcgtgctgcagcggttcaaggcggtggtggccgactgctcggcgcgcagccggatgcggctgctactgcaggccgacgaggtggcggcgcgggtgcgtgagctgcagcatgacctggccacgctgctggatcttctccccgttcccgagctcgggctcgccgacgacgtggtggacctcctcgcgctcgcgtcccggcagtgccggcggagctcgccgtcggcggacgccgcggagcacgagctgaagaccggggtgctggcgctgatccaggaggtggagagggagatcgtgccggagagggagaggctggagggcatcctcgaggaggttggcatcaacgacccggcgtgctgcagcgacgagatcgagacactggagcgggagatcggcgaccgcgtggcggagaggtggacgtcggccatgattgcgctcgttgggctcctccggtacgccaagtgcgtcctcttcaccgcggccacgccgcggccgatggacaccaaggtggatgttgacgacgatgacgatgacgacgacgccgagccgccgtcgccgccgccggacttccggtgccccatctctctcgatctgatgcgcgacccggttgtgtcggcgagcggccagacgtacgaccgggagtccatcacccggtggttcggctccggcaagtcgacgtgccccaagactgggcaggtgctggccaatctggagcttgtccccaacaaggcgctcaagaacttgatctcgcggtggtgccgggagaacggcgtcgccatggagagctccgagccaagcaagcccgagccagcgccggtggtgaccgcgaacaaggcggcgttggaggcggcgcgcatgacggcgtcgttcctcgtcaagaagctctccgtctccttctcccccgccgcggccaaccgcgtggtgcacgagatccggcagctcgccaggtccggcaacgacacgcgcgccttcatcggggaggccggcgccgtcccgctcctcgtgccgctgctccactccgacgacaccgccacccagctcaacgccgtcacggcgctgctcaacctgtccatcctcgacgccaacaagaagcgcatcatgcacgccgagggcgccgtcgaggcgatctgccacgccatgggctccggcgcgacgtggcgcgccaaggagaacgcggcggccaccgtgctcagcctggcgtccgtccattcctaccgccgccggcttggccggaacccacgcgtcgtcgagagggtcgtgcacctcgtgcgcaccggcccctccagcaccaagaaggacgcgatcgccgcgctcctgtgcctgtccggcgagagggagaacgtcgggaagctcgtggaagccggcgccgcggaggcggcgctgtcggcgatcagcgaggaggagaccgccgtggcggtgctggcgtcgctggccaagcgcggcggcgcggaggcgatcgtgaacatcgacggcgcggtggtgcgcctcgtggccgagctgcggcgcggcacggagtggtcaagggagtgcgcggccgccgcgctggtgctgctctgccgccgcgtgggcgccgccgtggtggcgcaggtgatgtcggtctccggcgtggagtgggcgatatgggagctgatggccaccggcacggagcgcgcgcggcgcaaggccgcgtcgctcggcagggcatgccggcgttgggccgcggcggagcaaaccgcggagtaccccgccacctccgacgtcacgacgacggccattacagcgtcgtgaaattccaccacggccacattgattaattcataggagcagataaaatttcgattttttttcccacgcacaacgaatgcttgtacaaaaaaaaaaattgtttcttgccttcaaggccttcacgattctttggttcatgggaccagtttgagtaattgataaactgcacatacaattatacaaagatccatttctctccaaatcttgtcacatatttctcttgtctcataagtaacacaaagagaaaaagagatgtcaccaacttgtacaaatgcttgtgaattgtgatcatctccacttcccccattctataattctttaatttctgtatccacatcgacgcaacaactgtacgatttcatttcattccagctaccaatatgaaagatgtgaacaaaagcatcacaataattgtgtagttgatggcttgcaactaggaggcgcccgtgatgagtgctcactcacttagttgcttgagctgccggggaccaaattgccagccattcccggccatccaatttggaggagaaaaaagaaaaaaaaagaacaaagcgagcgcacgctacctaacgaaacaacgaatatgttgctccgcgcgagagagtgcagcaaagcataaaacagcttgcaaattcaccggcttttgggcagaaaaaggccgtagctttagtgccagcaagagccagtgtgcatccatactgttgatagattgtaggaatatctcgtatctttggatgcatgtctcgctgttccggccattgacatcgcctgatgctggccatatgtgtttccctttgaccaaagcaagatggtagtattatgttcttctttctactactactacttgtctactagtagtctatgcaatgttaatgttaaaagtagtaggctcccatcggatagcataataagctaaaaaaaaccaaattttaaattttcgagcttaattttgagatatttttaacgtagtttctttttaacattggcttttaagtcacaaagaacatatttataaaagttttacccacaaatttatttttattttctaataagccgttttaacttattaggaaataagccaaacgatggagaccgtaaaggcgtctgctgaatttgattagtgtgacttgagacgggtgttgttcttcctcttgctgttgcgtggctggaaagatgggcgtgtggttccttcctgccagggaactaagtgtgtcattattggtgtaaacaatctaggttttgtttgttataatcatacggcgctatttaattacattgcatgccagtttaaacacggttgacagtagctttctggaccagccgtgttgtttcggatgctctctcttcgtctttaattgggaggttattctgaatcatagtatgtatgagtggatcgtatttggacttggaaaatttgtctatttggggcctgttcactttgatgttaaaaaaaaacttaccaaaattttagcattaccgaaattttggcaaatatgctaaaattttggcaacttaccaaaattttggcaggatttcttatatagttaccaaaatttggcagcaaactaaatgtaggtatttttttggcaactttactaaaatttagtaaattgaaaatggcatcaaagtgaacaggcccttggactgcacctgagcatggaaagggttgaagttagcctattaattgacaagtaaccagactgaatcaattcaggactcatcaggtggtgttattttctaataacaactacatacttttcccccaaatgcagcaacacaggactgcttcttctttgcatacttgtgctactattaaggagcatgtgctatttagacgtactagttcttgataagtcaaggggtgtacttgttgtactacatgcagctattgatcctcatcaatcgatcacttatgtcttccagattgatctgcaaggttggagaaatggagagagcttcatggttgccacagtgtttttctgttcggagagggagaattgttaggtgacatgtttaacacgcctgcattttgatgacaaggacaaccggcgttgggtctcctcttttaaaaaaggtttggtaatcgggtaaccatcgccaatggcatgaagcaagagagcaatataacgtcagattatgttcttcctcttcttctttttttttaacctggcagttggccagttgttacttgttactgaccaactgaggaaggaggtaaagatattttaaagtggcatgctaattagtaactggatgtcatgaataagaaatgtaggagcatgagaaacacatggaactggagttgtatgtttagttgtactatatgcttagggatattgcaagattagagagaacaaaaatgtttgaatatactccctccttccctaaatgtttgacaccgttgacttttttaaacatgtttgaccgtttgtcttattcaaaaacttttatgaaatgtgtaaaactatatatatatatatatatatatatatatatatatatatatacatgaaagtatatttaacaataaatcaaatgatacgaaaagaattaataattacttaaattttttgaataagacgaacggtcaaacatttttaaaaaagtcaacggcgtcaaatattttaggatagagggagtagttgattggatgatttgagaataaaaaaatgtaggattttggataaatgatgtgaattacattaaaaaaatcctaaaactatattgacttattcgttattctaaatggtcagacaggagaagtttccttagaatttcaaatctcacatagattcctgaagactaaagagagccactgttccaaagggcacatggttcccttccaaaagatgggcgcagtgcctaattgctcagtgcagttcagctggcaggaaagcaacgcagcaggcataacattagacggatttgtatgatcttcagataccaattcagcatttcagttcagtgatttatttataactgactgtcacccaacaaaatctcgatgtaaagcaaatcagaagtgtttttttcttgttgacaacttgacattatgcatcatgatacagacatatgtttttaggtatcatccagaggatttctaatcggtccattcggcttccagaaatttcaattcagatcatgttgttgtgatctctgatctgtactccctcttgtacagttgtactggctgtttgcttattcaaatcttcagacatgcagtgcaccactgtcatcaggtatccccattcaacttgatcctgcagaccatgaaagtggcagatttatcatgactatatcagatttcaaactcccgtatgcaaacaaggtaccgcactcgcaaaaaggaaaaatcttaatgcagtgattcgaatcacgtcctgttctccctctccctttgcgtctctgcttgttgatattgatgcttaatgctatattatacgctttggtatctcccagacgatttggaaactggaatcaggccattcggcttagggatttcaatgatcagggcgtggattttttcgaaaatgctgcgcgtcgggcgccgagcggctgaagaaaaaaatcggacgcctccaaccacgtaataagtattttaaatagctttaaaataatttttcttctcaactaattatccaatctacgatccgatcacaccgttatattcgttgcaattaaatctttataacaagatcacacatgattatatttcgataaaaaaatattttagcttttttattgatattgttttagaatgctgcatatggttttttttatgtttcgaccagtaattttacaatgtttcagctagtgtactcgtgatgtttcactatgtactgatcaaattttgcagtggattttaatattatgggacgcgtcgttgcaacaaatcacacatatattttggaaactctctattaagagaatttgtttcttttttttcactaaaaagtttcacctagtgtactcacaatgtttcactttatatagatctaatgttgcagcaaactaaaacattccattgcaacaaaaaaaattcacatattttggaaaccccctattaagggaattcgtttcattttttgttccaccgaaaaatgtttcacctagtatactcacaatgtttcgctatgtatggatcatatattgcagtgaacttacattcttttgctatttgctgaaacattgttttttatataaggtgaaacaacacccgatttaaacgagtgaaacattttcactctacttagtgaaacaattccgatatacctagcggaacatcgtgtaatctattatatactaaaagtccattaaactttctacaaacgctcctaaaccgctacatggctcctagaaacactcccataccatcacgtggcgctctaacaaattatagaaattccaagaaaaaaacaaacatccgatcattgattttcacttcacatggtggacccatcgttttacaacattagatctatcttatatattaaaaatatattcaaaaaacccatccatatcccctccgtcatgtacatacctaggtactcctctctcctttcttccatttataggaagcaaagttttttatattaaaatatcaatctattattatatagtaaaaatccattacacttcctataaatattcttaaatcacgtggtgttcctataaatactcgtacgccgtcacatgatattgtttaatctcacggtcgattttcatttaaattgatagatccgttattttagatcactagattagatgtattatttaaaaaagtaataattccctcgtgtatattgtgggccggaatataagaaaccaaacaaaatactccgtgtacgtacgtacgtacgactggaaaataaaagatgaagcttacctactgttcctagaagaaagaaatcatacgtacggacttacgataaaaacgataaaataaaaaaaaaacatacgtaacatacgtacgtactgccattgaaaaaaaacaatggtctataacataggattttctactatttaaaaaataaaatataatactctataaacttgcgcaaatatatgtagttaaaatagatcttcaacaataaaaaaatatcctatcattaaacatcatttaaattattttaaaattatatatctaatgtgtgatcaagtcggattcctataattaaataaatattgatgtatatatacctaaatacatcataacacatgagaccgacatataataaataatgttatcataatattttaaaggaaaaaggacaaagtacccccgaattattatggtcgaccgaattacccccataaacccgaaagctacacatctttcaccctcaactattaataccgaacgaattactagttgtcttaacccggggtggttttgatcctacgtggcagtccagtcagtattttctaaaaaaaattggtgggacccacctatcatatctccccctcccctcttccccctctctcactttcttatccctccacgtttgtcaatcgacaaggctggggacgacgagcggcggggcgaaggagtatgagtggtgagtggcggacgcggctaggggcgacgagcagtggaggcggctcctcctcagcctccgctggtgcgcacctccttgacgaccgcgtggcttctccacggcctccaccggcacgcgaagaggacaacaacggcggggcggaggagcttgagtggtggaggcagcgagcggtggaggcggctcctcctcggctatctcagccgccacatgcgcactccgacggatgccatcgtctccatcctttttgtcacatctcatcatcacatgacagtcggcggagcgagcaggtgcgctggtcctccattgccaggttcggttgcacccccgccatcgagaactcccctaaaaaatgcggtcgcagctccatctaccatagcatgccatcccaccacgtttcttaatcgatccccaccaccaatgcctctctcctgacgagacaaaaagcaacaatcaatcaaagaacaacgaggtggatcaatcgtgagagcaagagcagggcaatagatgaaggagaaggacaagagagttgaggcggtgaagaccctgcagcaaggggagggagaagaaagacaggctggggaaagggattgaggaagagagggagagataggggagaggggagagagatagagagggtagagggtgtgacatgtaggtctcacctattttatttttttaaaaaaataccgactggattgtcacgtaggaataaaaccactccaggttgagttagggggtaattcgtccggtattaatagttgagggtgaaagatgtctggtttcgggtttagggggctaattcatacttttttctattttaaataatttcacatcatatttcaggtgtcaaatatcacttgatgactatatagcgctaatttaaatttacgtatgtaaaataaatgaaaataacacaatttagttgtgtatttttaagtaaatctgatttacttttaatttgtttgaaaacaacacaattttggttgataatctgtttgattttttacaactatttcattagtatctgataagtgggaaacataaatgttacacatatgtaaaaaatatgaaaaatattttaagccaatgatcttgctataatacaaccacttaatccatcataagatttatggtcatatatgtatgtttttgtctttttcaaatagttttgataacaaatgaacaatcaagtaacatgcacaataaactatttatgatatattttctaatagttgaggaattcctacacatcagacataatttgatggatgtatgttatacaccctattgacgtgtctataaagtattcttcaataaattatttattgtaaataagtttaggaaaatagattcattcatcaaattaattagtaaaagtgtctcatataattatgaacaattaataggcgttgaaaaaaccaaacgcaaaagtattgatatttatcaaaatataacaaataatatggtgctttggagattatcgtggtagcatttaaaaaacatttatcctgattaaaaaaatcacatatagtataaatagatatgaaacaactccagtattccattattattccattatcatgacacgtgtttaaaaaaacatgtttaaaatagagtcaagatctattttaaaaatatcaactacacgtaaacattcataataaaaaatcaatcaacattaaataagtgcccgcgcacacatgcgcgggctactttcctagtatttaaaaataattcaataatatgctaattttttttcgtcggaatataccatgtgtggttttgttttgaagatttaattgcaacgaatttaatgttgcaatcgaatcatgatttggataagtaatttaagagaaaaatcagttttaaagtagttttgcacgtaaatcgggcgctgacgtcagcgcctgatttccctagcccggatcggtaggcgcgtccggattttttgacctacttgatccatgcgtgtttgcatctgcaaacgagttgattaagattatcactcggccacgtgcaccacatggctcgaacacagaatatagatgcagaggaaccaaaactggggaagacattaacgatgtaatcgtcgatcagcttccaaattcactgaaatttggcgacgtaagttcagagaactgactgtacaaaaagcctgaggcataactccggtcaggattcataactgtacaaaagttgattttctttttttttttttgggggggggggggcggggagggggggacagatgaagtacacttctacaatatcagcaaactagtttcaaaaccagaattagaactgcagccggtatatttcagtatttgttcgtgccgaaaagtttagtgacatcgtctaccgatacgtgggagcagctagccttgcagccggagggaccaggacgagctcacggcagcacgggcaggtgcgtctcgtcgtcagccactcgtcgacgcaggcggcgtggaatgcgtgccggcagcgacccggccgccggcacctctcgccgtcgcgcatctcctccaggcatatgctgcagctcctgccgccgccgccgcagtaggcgaaccacggcagccgccgcagctggtctggcgttaaaccgtccttattgtcgccgccaacgtcgtcgtcgtcttcgtcgctataatctgtgtaccaggaatcagagtcgtaagagtcatcgacgacgccgtcgatgtaggtgtcgtcgtcctcgccgacggcgcaccaccaagggaggaccaacatcgcgactccagcgacggcgccggtgaagagtaacagggagaacggcatctgcacgaagagaaggatcagtttgcgtatcgccgaaggcgaagcagcgtcgtgatcggatttattggttagcaactttgcattgtccgatatcggaattcgaaaccgaccatgaacatgaagaggggttgcgaatcagaagggaagaaggatagggaggaggagaaaggaacggggatttgttgagttcgaaggataaaacgacggcccatatacgcttaggtgggcctacggttgtagggccctttcaccatcttcctctttagtgggccgaggccgaatgggctggcaggcggcgacgcgagaacagcccaatcttttaccgacggcgaccgacgaacgttcccgtgtgcgaacaaggcgccacggccgcgttctcacctcgctcactggcttctccggcgaggtgatgcgagaatttttcttaatgcagcggggcgtactgcgtgttctcccccgaccttttgcttgctatcactagagattttctagggatttttttaaaattttaatatctcgaatgaatgtctctttgtttatctataaatcgtctaaatagttatagaaaatatttaaaaatttatagcatttttacaacacatatatcatttaaaagattttagatccaaacacaactcacacattgaactaaaaaaaagataataatgtcggaaaaaaaccctagggttcagggctttaagtttggaaggtggtagaggggatagggaggtggaagggaggctttagaaagatggtcttggacggctattggacctaccatgcagagccgcacgtatgaagcagggtggcaggcaggatcaacaacaatggcattggatctagagcggttaggagaaaagggggtgagaactgagaagggccagtgtggcgggcctcacattttgcattcccttgtagagtggggttttaaatgtttacatctctgcgacaaagccccatgaaaaaaagggctaaatgagaatgatgcattgataaaagtgaaaaaaaatattccctccgtcctaaaatataacaattttggggttggatgggacacatcctaatccaatgaatctagataaaagattgtccaaattcgttggactaagatatgtctcatccaattctaaattattgtattttggaacggatatagtaataatgtttgggagcataaaagatggtcaaagagtgtggtgctaactcaatgggaagaatcatttgttcgttcgtctgtactgaataacatgaacggaacatatgcatcgcattgaccatgggaaaaattccaaaaccccccatcactgtagacgtcaccttttactccattttgattagccatcacgtacccgacccctagacgacctgagcgatcgggacaacctcacgtcaaaccgcaacccgggggcacgcacacacacgccgcggagaccaactggcgagccatgcctgacgcgcgcgcgcgaacgtggcggccatcctacgaacctccaccgtattcccacgcctcgtctcgctcccggcgtcagccgtcgacacacgcttggcacagcccacgaccacacgaggagcaaagcaaagttaagaaagcaacgcgacgcgacgccctggcccctgcatgcgtgccgcgcgcgcggctgcgggggtttctcgcggtagcgtacgcgcgtcctcccggctaccagctgccgcgccgcgcgcgcgctttggctcagaccgaatcgagtcgcaatcgcatcgcatcccgcgcaaacctgtgtgtgccggggtggtgccgtacgtggtggtgagcgcaacgcaagccgcgcgcgtttgcggggagcgatgtgcatcggagtttcacgggaaaaaaacacgtacgtcacgtacgagaagcggtgtgcgcgcccggtggttcgttcatacgagcagcgcacggggcaagcgatcgatcgaactccgagggagaagaaaactgtcccgagtctcataagcgattctcaaatactaacagtctaactgttgtcagtttgttaaccccgtttgagcacgtgagtgtgtatgctcagctcgtatgacacgaccaaacccggccggagagataaagaagagaggatgcgtggcacttattacgacctgacgttgcaaaaggcacctttgaaaaatcgtgtccggaaatagtaacgtgcatgggtttttttctgtgtcagttttgtcttgcccgtgcaccaaaacacaagagttaatacagggtagtctattgtgtgtctactcctagagaattactgtagataataccccacctcaaggtgaattaaccatcgcccgcctccatatgagttgtgacaaaataaaaaggatatatgtaatgtaactagctagttgtcgaacaacatcgatcatcatcatctcgcgcagtcggccccaagatgtgcaacaagcacgggatattaccggaggacgctggttctctgtgtgcatcatttcggactcttaagcattacacacgtacgtcaagaatgcaacctgatcaatagaatgcttccttctcaaccctatttctcacatcgtacttttaagctaaagttttgttcgtgaccatggaagccttgggtggactgacttgatcttccattgattacctgaaaaaaccatccatgttaattggttcctgtctagttttgtcacagcatatcttaggtgtgctacaattttatacatatgtgtttatcatacctcacgtgtcgtatatagactcggtttctaattaaacatttgcatacttgtttgttgtgacactcgttttctttgccacatctttttatgcatggtgggttacactttgctgaaatttacgtgataaacttcaatatgttaaccaaatagctctagataccgcggaatagacgtgagtagcaataataaaaaaatagacactgatatttttaaatggataacgttgtagaatacatgcaatatatgaactcttaattctaaaatcaataataaatgcaaaaaaaatattatttgatatataaacatacaattaatagtttattaaaagagtgtgtcatgcagatacagtattatatcgtttttttatgatataggagtatgttgaaaaagactacaataaaacatgaagaacgagatgtatagagaacacattcggaggtacagaagggtggtgtttttttaggaaataaaagtatggtattgtgtgtgtagtgatgtgcatgtgtgtgttgatttggccgtgtaataaaaaaagattatataaaaggttattaaatgaatgcctttttatgaacaaagaaaatgaatgcttggaatagtagcttatccggtgatcctactcaatgtagtcatcccgtattaacctttttctgcaaaaaaccatgcgagccccatgttgtccagcgaaccaggtgtgctgaccggacggtatggcccaccgttcagcgagacaagaaaggaacaaaaagagcagcgaaacctcgctccgcacgctctctcccgccgctacttatcccgcgcgggtcacggcgtggtcgcgctctggcctggccccccattcgatctctccctgctcctccactcctcctcctcgtacagcgccgaagaacggaggcggcgccgccgccgcgccggcgagaggagagcgagggaggacatgggccggcggaagttcaggctctccgacatgatgcccaacgcgtggttctacaagctccgcgacatgcgcgcgcggggcggccgcggtgcaactgcgatgcagccgccgtcgtcgtcgtcgttgatgagggggagcagggcggcgcagcagcaggcgggcacgtggaggctggggacgtcgtcgtcgtcgtcgtcgttgctgccgcacagggcgtcgtactactacaccacccgggacagggaggtcccgccgctgccgccgccgccaccgccgaggggcgtggatgatcaattcccttccctcacgctgtcgccgccgttgccgacgaggaacagca

SEQ ID NO: 64740 - DNA, 25325 bp, Oryza sativa
atacttggccttggattagggagatggccatcaagagcaggtacaatagtaggctataagccagctataaacatattttaaagagataaaagaagagagagaagagcaggggactacagatttatagccagctgcagcacggactccaaaacgtaatatgtgtataacaggtgggaccatgtattaatagtacagtaaataaatattgtataaattagctattacattggctatagataattttaaactttctctaagggcgtacagtaccttccgtctgttactactattgctgataagaattcagactccggcgagaaagaacgaaccggtcaaaagcaacgatggccatatataggagtcaaatgtcacaggatatgagccggagattgagctctcggagtccatgtcacgcatgactcagaggccggagaaacggcacccgagtccatgtcatgaccgagagggcatcgccgcatagcgatgaatgccaaatcatttactcgatcgatcgatcgatcccaagtccatcgagcgatcgatgagatgagctgaaatcgcgtggtcgtcgctccatcaatgccgctcggaaatgctggccggctgagctgaccggtaggcatgcatgcacactcacaatctcacatcgcccatcacgaggtgaccaaaggaagagatgatgaacaaaggctgtgtttagttggggaaaagaaaatttttgggtgtcacatcagacgtttgaccggatgtcggaaggggtttttggacacgaatgaaaaaactaatttcagaactcgcctggaaaccgcgagacgaatcttttgagtctacttaagccgtcattagcacatgtgggttactgtagcacttatggctaatcatggcctaattaggctcaaaagattcgtctcgcgatttatagctaaactgtgcaattggtttttctttttgtccacatttaatgctccatgcatgtgtccaaagattcgatgtgataggtgaaggggaaaatttttgggaactaaactagcccaaaggcccaagacttgtttaattttcagctccccaatttattgccagtgttgcttacggccgagggaagcgagagagagagagatgacatcggactaagattggactaatcgagacccctcgacttgatactgcgagtctagccgatcatcatcgtaagaacgtatgcttagtccgagtttagttccaattttttttcaaacttcctacacacgtaaactttcaattttttcgtcacatcgttctaatttcaactaaacttctaattttgacgtgaactaaacacgcccaaataccttaccatgcaatcccagataaaatttaaaatctttattgtattctatattccagtattgattatgaacactattttaaaaaatgcacatacaagtcggtactatagatacaagaacaactaaaaccgacactctttttccccttcaaaagatgaaaaaaaccggcacctttaatacactaaactaccgtaaaaatgcagtttgagagttgcccactaaacctttttaatagtgcttatttttttttcttctcgtttttagccattgaacttaataatactcactcatagtttttcttttcaccatattaataagaggcatttgcaaatttgccacttgttttttcaattttgcaaggatgccactcgaatgacagttccagtggtatttttgtaattttttagtggcagttttgaaataatgattaaaagcagttgtaaattgcaattgcccctattaataaagggcaagttagtcttttaatatgccgcttaatatatgtctttaactagataaaaaaactatgctcttttaaagacaagggactatgtttaagttttaaccataaaatatactcactcatttccaaattaatcatcatataatagaatccaaaaattctcaaattgatcatcatataaccgcatggacacaaatttcatcgaaatacaattaatttagcatggaaaaatatgtacatgctagggtgtaattagcatggtattttaatcgatgcatgcattgtaggagaatgtatacatagtatcttgatttatgcgatttaaattattcttggtcttggtgtataaacatatatgataattattttgggatggagagagtatttaggggccgtttagattgtagccaaaataaacataccaaaattttggcaagttggcaatattactaaaattttagtaggatttcttatgtatttaccaaaatttagcaacaaactaaacgtagttatttttttaataattttataaaataacggtatggttgaaaatgatattaatatgaagagccccttaattacttcgtttatttttctggggttatccacaagtcattgatgtgcgtggttcagaaatgatgatgaatcggtatcggtcgaacagtgcgtagattttgttcaattctacgagggatgataaaaggctctcctgatctctgcatttacttggaaacctttagcttttgattaggaggtctttgttgcaattaagcttcggtgaacactaacggttgcgctaatctcatcgatctcgacgtgtgccttgctctcaagggcgccgattaccacctgtctcccatgctctgctgaaggcactgtatgtgatcaaattccacaaattcctacttagtaaacatagattaggcagctacaaggtgtcaagataaacgatgtaatgttagatgcgtacatgactacatggtgttgttttctcatcacgcctcaaccgaacatctcatattcacatggaaaaatttgacccatgctatgtttagtttctgaaaaaagttaaaagtttggaaaaaaaagttaaaagtttatgtgtgtagaaaagttttggatgtgatatgatgtgatggaaagttggaagtttggggtaggtggggtgaactaaacacggccccagtttaaccaggacgccgctgcggttacaacagtctaagcaattcaaaatttataattaatttgatcactggaatgactaaaaagaaacttttcttctttgatttaagtatgctaaacaatgtagaaattatgagtattacacttgtacgttgcagctttgaaacccggcccactggccacaggagagctctcactgctgtcccaataattatgcagcatagtagctagcagcttggccagtgacagtgaatagtgtgtccgctgcggccaggccaaagtgccaaaacaacgtcgtcaagtggcacgcactgatgatcaggaaaccatcaatccttcagaaaaaaaaaggctcactcagtcacgagcagcagcgagcgagagaagggccccttgatcatctccatcttgtccctcgggggaggcagtctaattgggaagttgcatcgtgtctccttgcccctctctgagatgttcccctgctactgctatatagctagctccatcgatcgcaagctgcagcaacggccacttgctgttgcctccctcttggccaccattgctgatccgctgctgctactctgctagttactcactgtgacaggttggattttggacaggtcagggtggctgtttccctgtctgatatctgcctttttgctgtttgtgtttgggaggagagagtctctggataacgagaaattaattaacgtgagtggcttgatgtgatgccctaaagtttctctcattgctgatttatgtgcactagtcgatgtgataattaaagtactagggtatgtttggtttggtatcatgataaaatgtcgatgatgctaaaatctagacaagttttttcgttgtgcaaatttggacaacttgtgtgtgttgttggcacattttgatgacgaaccaaatattagcaaaagtaataactaaaatgtcaacaatttgatagggaatattttggcttagagccaaaatggccttattctgtccatttttaaatggaaattttgagaaataccacgcgagatgtatgagttggaaaacaccaccacatgggacccataggtcgttgacacatgtgatgatatttttcaactttgaaatctttgcgatggtactcttacatattgtatttttgaatatatggcgtcattgattttaggaaatgtcgatcattagtcttggtgaaaaattcaatactaatataaaaatataaagttatgcttaaaatacgtttatgataaaacaagttgaaaaaaaaagatacttacctagtttttcttaataaaatgaatatttttagaaggaaaataaaacgaataatcgaacatctatctattatattattaagacagctcgaaaaggaggcaccacgttcgctgtgaaggctagaaattttcacattaatcggagaaaaagaaaaaaaaagaaaaggagagtccaagtaggaatacaatataaaaatagctgaaattcggaattaaaaataagcaatattgaaagaagtttccatataagaacccaatacgagattaatccaaatttgaaataaaaataaaataaaatccaaaattagaaaagaaaaagagagtccaagtaggaatacaatttaaaaatagccgaaatttggaattaaaaataaggaatattaaaagaagagtcaaaccaatatgagattaattaaaatttgaaataaaaataaaaataaatcctaaattagcaaaagaaaataaaagaagagttaagtaggaatacaatttaattaaaaataaacaatattgaaagaagaatccatataagaacccaatacgagattaattaaaattttgaataaaaaataaaataatatccaaaattaaaaactaaaagagagttcaagtatgaataccattttgaaaccactgaaattgaaataaaaaataccaatattaaaagaacataatacggtattaactaaatttttttaaaaagagtaaatttcacaaaactgcagatactatgaccaaattatcacaaaactacagatttaactcgatgtatcacaaaactacacatttaacaccaaatttatcacaaaactacacatttaagatgaagtgtcacaaaactacatatttagtaactaaattatcacaaaactacaggtttagaatcaatttaatcacaaagtattgatgtttatagctccaccataacaatggtgctagggatttaaactccaaaagttatagttttgtgataagttcaatattaaatatgcatttttatgatacttaatctaaaatctgtaattttttgataaatttggtgctaaatatgtagttttgtgatacaactccttaaatctgtagttttgtgataacttggtcaaaatacctgtagttttgtgaaatttactcaaaaaataaattctgaaattagaaaaagaaaaataatacttcaattaggaatacaatttataaataactaaaatttgtgataaaaataaagactattgaaagaaaagaccatctaaaacacatgacaagataaattaagtagcaggtctataaaggagtagaggggtggcggttgatacgacatataaaaaatattaataaaacaccaaatagaatcctaacaatgattaaaaggagggacgtcaggcaggccgtgaagcaaacaagtaaggcagttgctaggacttctagaaagtaaaaaaaataaaccccattgataatcatatttgatttttaaaatctcaatgacaataaaaaggagaagcagagccgccgacggttgacaggacttctagaaaataaaaaatgaattccaacgatagttatgttagatgtttagaatcacaatgacaataaagagtatgcggcggacgggttgtagagggggtatagtggcatcgtttgatgggacttctaaaaattataaaaaatgaaactgcaagtccaatttttaaaggtttggaacttccaaaaagtaaaaaaaaacccaatgataattatgttcgattttaaaatctcaatgacaataaagaagggaggcagcgggcgagccgtagaggagtataatggcaaagccgctgatggtttagccggacttgtagaaagtaaaaatgaacccaaacgataattatgttcgatttttaaaatctcaatgacaataaagagaagaaacagtggacgggccgtagaggagtataatagcaacgtttgacgggacatctagaaattataaaaacgaaacccatcgtgacaataaactctaaaaactataaaatccaatttttaaaggttttaagaagaatgaatagaaatagtggtagatcgagtaagcaaataaaaaagaagatgacgtaaggaatagcaactggtgtgaatttttaaaactatatatagttagaaacacgaggatgataaggtttggtcttttaaagtcttaagacaatgagatagctatttaataaattttaagtaaaattatacttaaaaaaatatatgattttatttgggtgctagccgcgcaattacgcgggccacccagctagttaggtttaaaagttaacttcttttaataagatgaaaaataaaacattatgcctaaatgttaaaaaaactttatttagtgagaaacggaggcagttatttcccgtattggtcgatggacttcagtcttacaagtgcaaaatcaacatttctactctaaagacaaggagatctatttcaggatttgattggttaagaagcacgtaatggctatcagataaaattactctggtagtactgcaagcatgcaggcacgcactcatggccatgcacagaaaaatgccgacaatgatcaagcctttttctgggacagtttagtacacatttaggcgacccgcgaagcacaccattatggtaggtccagcacattagcagaccagtgataaagtgctcaaagacgattcagatcacgtccatgtaatgatgtccatgagatgtgtgtatcagtattactgttggtgatagtgccagcatgcaattgcttgttctaagtacccagcctgatgactgtccgttatgagcaataatacaagcaaggacagggttattgatcattggtttgttgcgttctgtaatctgtagtagtagcagcagcagcagccaaacataactttcacagttcacttgcgatccactgatgtggccccacggcttaaactacttgttctaaagttgttttaaatatattttttaaaatatttaatttatcctataatcaagcagataatttgtattaataatatgaaaggttttactatgtttgtgaggtacttagaggtattgagagctggagtaatatagactgttgatcaagagaggggcaatgtatggaataaaaattatcataatcaatggtaatgaagtaattaactagtgaaatattgccattattactgaattgaatatcttgctttgttgatcgttaatgtacgatagagaaaatgtaaatctacctaggcatcgattagatctacacggaaaaaaaatcaggttgtgtcttctttctcttctcccacatcacttcgttcttactggggtttgaattggttcactagaaaaaaaaagggagaactgtcaacatggttgaggattgaagcggagatgaggtcagccggtcaatggcaaggcgaagcgcatccgctaagattccatttatgcagttgattagtgatttatatagctcacaatttcattcatataagagactggaatgagttctcctcccctattcttcttcttcgagtttttgaataggtgcactcgcatggagacacagtcatcctggttgagcatttgtgcaatctacaacgaatgtctctggatatttggccctgtggtgcagactttagggcaattgcaggccttttaatgtggcatgcaatccgtggactgcatgcatgcacatatatgcccaataaatggacatccaatcaagaggtggtttccattttattagatatgaggtaaatcagggatattgttattttggaatcaatattaaaatctaagtgtatggataatattataaaatagttatttaattccctaagacatataaaattttgttaattagtgaattctacaaaaacatgtaaaaaacgaaatgaatgattaccatgcgaatctgttcttaagaaaaaaataaatataaaaaagaacacgtaaataatgtcctagagatgataactaactgtacctatctatgtacttagaactaatacttaagacaattatacgcttatctatctcctataaaattatctttgtaccattactacctaagtatctgtgctaatatttaaatatcttttaattgatacattttattgtggagcgttagatttttaccttttttttaaatgcaaacaccgtaaaacctctctaacaatataataaacaatttatttcagacaggactattcattttgtacagttgaaattaaaacaggaaaaatttgtgcccaagtgaataacacacgccaaaacgatgagacacatggccctacgagttacttccccttcccctgtccaaataaaccaacttctgaaattgaaatcagaagaagttgattctttttaaagtcaaggcgtgtaaacgcctaaacggtatgcatcagatgattcagatctgacgaagccttccacagttagctgtcactgccatgacgcggccaataatttccttcgcattgactgaacagcaattgccatgtctgccgccgtgtttagttactaattctttaaacttccaactttttcatcacatcaaaactttcctacacatataaacttacagcttttctgtcacattattccaatttcaactaaactttcaattttactgtgaactaaacacagcctgcatcgatcgatcggtacctgcaccggtgggaaacgcctttactgccattgcgaccttcttccgccggccgtccggccacaggcccgcgatgaattttcccggtcgtcggcgacagcgacggcgagcgaccaccatgcatgcgcccgctcgaggaaacaggacacgggggcacgtgagcccgggtcaatttccggccactggcgacgccctgtcggcgagggccttgtgttgacggattccggcggcgtgttcgcccgtgtgtggtggctcgatcgtacgccgctctcgacttggccggccactggtctcccgggctttctcgcgctttttcttgcagaggagcaagggttgcaatccgacgtgatggagattggagagttggtgatttttttctgctcccattttgttgcttcttcaggtgtcagtttgcaacgatttttttgttctttgttgacattctagccggaagcccaatatgatggaatgggtagaaagctattatgtgatcttgggctgtgatctgtgtagccattcggccattactagcagtagcaaacagttcacccaatatcacttgctggaggaaaaaatatgtttgatttttaagtgaattaaaattcggttaaatcaaataaaactagtgaggtagctcattgcgtgggtagctttatttactgtgtttgtatttgcttatgacattgggtttagttttagagagaattcattatatgccaccgagtttaccacaagcctaccaatatgccatcgacttttgcttaacttctacaatttatcatcgtcatctggttagcctccgttagtattatataattttattcaaatgaccaaaatacccttgagacaaaaacttccaaaatttagacaaaaattctaaaaaatcatattattaacatacaattttatgttaataatatgatatttcagaatttttgtccaaattttactactatctctgtttcacaatgtaagtcattctaacattttccacattcatattgatattaatgaatctagacatatatatctatttagattcattaactcaatataaatgtgaaaaatgctagaaggacttatgttgtgaaacggaggaagtattaatcactgaatttaatatcatattataaacattgtatgatatttttgaaatattatactataattataatatgatatttcagaatttaatagcaaagtcaccgatccaaaatgcaataatgcttttcttccgttacatcgatatctcaccttctgactttgctatgaatcagtgctaaaaataaataccacgatatttcgcagggttctcttatggaaatgactagccccaaacgaggaatcgcaatgggttatcctgccctgattgaggatgacatgaggatcaagtcagcaggaaagcaagaagacgatcagcagctgatcgatggagtactaggcatccatgagctagctacgcagaaaatgctgcagaagattcacgggtcgcatcgatggacattgtggcgcagtcgacatgtccatagaattcttcccaacgcagtggaagccacggttgagctcgatcatcatatcagatgttcgcagctgcttcgatctgtacatcagctcttatgccagtggattagctgaagagtttgagctgtttcatggcgacattggtgagccatgtgggttgagaaggtttgtggtcgctgtgacgctggatcgcttgttgcacttgagattttcgttgctgaaacgaggctccgagaggtctgaagaagtcgcgtgttcgttgacagcgcagaaatacgggtgtaaaacaaatgaaatatatgttggtccggcctcattctcgtgaagattacttggtcaaactgtgtccctaaattgtaacaaaattaattcgtccggccaaattacgtggtgatacttactaatttcccgcgtttatttttctatatgcataggttaaatttggactcatgtttgcgaagtgataacgttatgttgatctatcccaccaatttttatttgcagaaaatcactttgactttttttaactaaatgaaaaactagaaatatctcctcaaaagacaaatataccttttcccatgaaataagcgagatcaatgttgcagaacgatgcattgtcctgtgcatggtcgatctcaagggtaaactcttttaatcactcggggacattcacccgtttcttatatataaattaaatagttatatttttttaaaaaaataacaatccatttcttatatgtcaattgaatggttatatatttttttaaaaaaaaacaagatagattcgtatgtaatatatcacttgacaaacttgtaaattcaaattcaactatttataagttataaaaataataaatttaactataaatatacatatactagttagagtttaatttgttattttttaataacttgtattagtcaaatttgaatttattttttttaattatttagtttatatgcaaagaaacgggtggaggttaatccatctttcgatctcaagcttggtttctgcagcttcaccggcgagctgatgcgcgcctctgtctgcaacctcagtcagcctactagtctagcacttgagcctcatcttcttcatcaacctctctgtctcgtcggcctggtcctgctccgtcgcggcggcgccggcgccggcggctggccggcaggtggtgatctccgtgacaccccgccgcttgtggagaagcctccgcatcagcgcggggaggtccatctcgctcctgatctcatccagcgcgttgcgcacccggaggatctcatccaccttgggcccctcgtagctgctcgtcctggccatggcgagcagcgcctcctccagcccgatcgccgcgccgaggcgggccacgatcatgtccagtatcgccagcacgccgcccccggccgccgcggcgtcgccgtggcccctggggacggcggcggcggcgccgccgtcggcgcgggacaggtagagcgtccccggcgagacgctgacgctggcgcggccgaggcggtggcgcggccgccacttctgcttcggggacgtgtacctccggtacgcgcaaaccaggctgtcgccgccgccgcgcgggctgtcgttgagggcgacgaggcagtgggcgcggctggcgtggacggtgagcatcggggagcccgggtcggcggcgctgatctcgaccacgccgccgtggtagccctcctcgccgcgcccgacgatgccgagcgcggcggcgtacgcgtcgtcgatgatggacagcgccatgccgtccagcatctcccacggctggtgccgctcgatcagcgccatgtcgtgcgccgccgcgtgcacgctctgctcagagtgatccattgccccacgatccgccggcgtaaggaaattggttccctgatatgcgcgacgcggcgtgtcccggaacctagggcggatcggatagccgtacgtaggcgagacgggctccgattccgtggaggagaaggacacacctcttctttcgcggttcgtttgctttgccgcgcgattcgctgggttcgcgactggccatgcgatgggatgagatgtcggcgatcgccgccggcgaggcgcggtggcggtggcgggtggcaggttgggccggggtgggctgtattcctatcgtgggctttattggtgcagacaagcagagctgcaatccgacgatctttctaaaaaaaattttggacctttaaaatttttaattttaaaaataaaccctcacaaaaattaaatacgaagattttgaaaaggttcgtatttcaaaatttttggatttgtattaagctttgggagtgctcaattttaaaatttaaaattaatttaaaattaaatttaattttaaaaataaaccttcccaaaaattaaatacgaacttttttaaaaaaaggttcgtatttcaaaaggtttggatttgtattaagttttgggagtgctcattttttaaatttaaattttaaaattaaaaattaaaatggttagaaaaaaagttacaatccgaagtgagagacgatggagaattggattggaggtggccttgtgcgttattattcattttcatttcttactcgacattgctcttctactttctggcgtcagcttgcaacaatttttattctgaaattcttgcccggcctgatgggatggatagaaagccattcttgcgatctgtgcagccataacttgccagttgccaccagttcgtcgactattacataatagggaaatcaattgtttcaatattaaacaaaaattttaagtgaaccaaagaaaattcagcaaaagacaggaagaatcagagaaagcatgttaagctgaaacatggggcattggaacagagtctgaacagtatggttcgaccacatttactgatttacagtcaccaagaaactcaaaaagaaaaatgtattgctgcacttgcaggaagccactgaggctattattcagctaagggaatgtcccaaaatttgcaactacacaattgtgccccaaattgcaatccattccagaaacgcttatgacagacccatgactttgccagtggctgtgtcgacgtcgatttcgtagaagcagggccttgtaggaagaccaggcattgtgctcatggtgccaaccagtgggtagatgaaaccggctccaatgctggccctcacatccctgataggaagcacgaagccagacggcgcgcccttcatggatggaacatgcgaaaacgagtactgagttttcgccatgcatattgggaggtttgagaagccttgcttggtatacatttcaatctgcttctccgcctgcacggaagtcagtcagtcagcagaataaagcagaatgttatgtgttcagtgtatctgtctaatgccattcccacagcatgttcatcagtgtcaaaagcatgaacatcaggggattcctctttcagtgtgaaatgaaaggcatgggagaaagatagtagatacaatctcaaacacagtaatcagaataggaggtagtagcaaggatacctgttcagagtattcaacgccgctagcaccatagaacttagctattgactcaatcttctcctttatgccagattctaaaggatacaaaaatttcagagggtctgcctggctctcacatgcccgttgaaccgcgagtccaagatcaacctgaaaacaagttaaatggtagaacagacatcagtttaatgctgacgatttcaaccttcacactcttcgtagatggaagaaataagcacagaattcccattaaaacaatatgctagacaataatggagaaataaaataagagatgcatgggcgtcacatatcataacactgtccacagtttataacttaagcaaactggaaaacctgccaggagcacaattattttgaggcaaatttttgctaggcatgaaagagcaaagtcacaaagtttgtaaacataattaggtaaaacataagtaccagaacacaatttactgattcacaatcaaacattgcccataaagagtggaagatttagttaaaaaataggtcaagatgtatagacatgactggattaataattaatgcaatgacagaaaactaaccgctcctttaccaccatgcgcatggtgagtgcagacaacagcatcaaaagcaccagcagccaaagacgcatttcgcaccacgtccatttctgcttcagtatctgatgcaaacttgttgattgcaactacaacattaactccataactctttgtgtttgcgatatgtttagcaagattgacgcatccagcttcaacaagagccacattttcactcacatatgcatgatccaaaggcttcccagccacaacatcagggcccccaccatgcattttaagagctctaattgtggccacaataatagcacactgaggcattaatccactatatctacactttatatccatgaatttctcagttccaatatcagaaccaaaacctgcctctgtaactacatatccacccttcccaaccaacttcagtgcaattttatcagcaactatcgaagagtttccatgagcaatattagcaaaaggtccagcgtgcactaacacaggagtgccttcaagagtttgcatgagcgttggatggatggcatctttcattaggacagtcaaggcacccccaacaccaagatcatcagcagtaataggctcacctgccttgctgttccctatcaccattcttccaagcctttccctcatgtcagcaagggaagttgtaagagctaatacggccattatctcactagctacagctatgtcaaagcctgtttctctcaccatacctttttcatcagggccttgtccaatagtgatttttctcaggaaccggtcatttacatccatgacccgtctccaagtaatggattcagggtctatgtcaagtcttgcaaagcgtctaacttcatctggagtaagctcattaggatctgtctttgagattccaagctttatcaggcgtctgagcattacatcagcaaagcgcctctttccttctttgtttggcggacatagtctattgaacagcgctttgtctgattgtgaagcctcatggaaaatccttgtatcgatagcagcagcaagaagattgtttgcagctgtaattgcatggatatctcctgtaagatgaagattgaactcatccatgggtatgacttggctgtagccacctccagcagcaccccccttgattccaaaagtaggcccttgtgatggttgacggaggcaagtgacaacctataatagcaacattaatattgagtaaagtagtaaagcatatcaataacataatatatactctataaaaaaataaacataatatgtacatcgatatgtcaatcgtttcaatatgctctggaatgcataatatactctatgtatcagtatcaacattcgccacttatactacgttcatgatggttagagacatataaagaaccatgcagtctatcatgactgttacaagaaacaaataaagtcatcccagacccccagaacagagcattgtatcaagtatttaaacattaggattttgtttttcctgaaaattgcttggtgagagagaatttatcaacatgactcttgcaggcaaatataaataaacacagagagttcagttctaccatggagttctgacaatgcaccaatgaagatttgatattaataagtttgacaaataaatcaaaccaaactgacagaattcttgattccactagaccactgcagaatttaaaaaggacagtgcctgcatccaatatacaggtgctagtgtgctactacgacagcataaaaagacttaaatctaatcaacaaagctcacaggctgatactattgtgccaagcaaactgattgtttacctcaacaccaatcacaaactttatctataaccaataagtaaccaagataccctgtcgattatagaacaagcgaaagtggcatggaaagcctctcacctttttatcaagaaacgcacccagcgcctggcacagcccaacggtggtggtcgacttgccctccccgagcggcgtcggcgtgatgccgccgaccaccacgtagtacccatcctgctgccctttcaactcatcaagaacagacagcaacacctgcaaaaaagaacaagcgaaaaaaaaaatcatcaacaaatcgcatcgcatcgcgcgacaacccaatccgcatctttggaagcggcgcacgcaccttggccttgtacttgccgtagagatcgaagtgctcggggcgcaggccgagctccgcggcgatgtcggcgatggggagcggcgagacggcgttggcgatgtcgatgtccgccggcaccggcgacgccacgtccagcctccggatcgtcgggctcggcttcggcgtcgtcatcggcaccaccagcggcggcggcagcggcggcgcgacggcggcgctggatctcacacgcagcgagcggtggtggtggttcgagtgcgagagcggcggatgcgagacgactgaatggcaattgtttattgccgcacgacgacgatggcatttgataatcgaggataaagatttcggataattggttggtgggacagacacatccatgacgcaaacacctcccccaaataatacagccacaaaacccctcaaatatcccacctttttcacttcaagattaccaagaaccctcaaattcctaacctttttcactgcaagatatttggggccaacaccaagaaacacttctcactgtactgagctttatacccttcctgtgcagccccaattcttcgggagttgtggatctgggttttgggaggatggcaggggttttggctgctcttatcttggattggttggatggaaaatggactgcaatccacaggagaagataagggttttttgtgtggagatgcggatgtgagcgatgatgatgttgttgctgggttgcaaacggtgatgcgtgcacaagattggggcttttgaaagagccaagtgtgtgctctttttataggtgattttgcttgagattttgggaacagttcatgaacattgcatgtgaaaaaactctactggcgtgcacgtaatgcagtgggtgaaaagaaaaaaaaaaggaacttttttccctttctcttcttgtcttcgttgaacattgctgtaagcctgtaactgcattggagttgatatgatcagtgagctgtaggacacatcatctctggattttgctgtgacaaaaagaggatctcatgtcccaaccacactcaagaaaaagcaagtaatgggacgaacaatctggtagagagtggtccaaaccacgtccgttttgcttggtttgtaagcgtgattcccttggattttgaggttttggggaggtcaattcccctgggttttgaagggtttaggggttcattcacgagggcattgaggcagataagaaatgctagccaaccatgctccatgcatagggagacgccttctttttctaatcctggattagggatgccatggtccatggcatgcattaccagacgagttggtcaactcatgccgtttgatccgggcgatttggatcttgggacaatgaggcccgttggtttactctgaattttttccttggtgaagcccaactgaaaagttaggcctaacagtttgatctgacgttcgatgggctgttctacttctatcccaccgataagggctaagaaacataaagaaccatttatttaaatttgttaataaaattcaaaatagaagtttcagaaatatcattgtactatctgagaattaagcctcacgaatcaacaacatacggcaatctttttttttatctcccaacgttctcgatggtactgagcaaattgagccaatgtaaaatgttacagtaccattaacaaaaataacaaccaaaattcactatgtagtattgacatgcatacaaatcaaacgaaatgaatcggatcaaagaatggtgaacatccagcaagcaacaggagcaatatatcatccattttagctccgcgtacttgtcgcaacaaatcaattcaaacactggcacctctcctctctcaatccttcttccggccatcgacgacggccaccacgggcgacggctccccgccggcgggcatgtcggagagcgcggcgagcatgcggcggacggcgctgacggagcgcgccggccgccgcggggcgccgccgccctgcaggctctgggccctggagaagacgtccgacgactgcgcgaggatgaggtacaccagcgcctgcaccagcacgaacacccacatcttcaccagcgcctcgtgcgagctcgccgccgcctccattgccggacacactcttcttctcgagctccggtgacacaaacgtacgcaacaagtgcgagagcagatcaatcaacttatcaaccgaatcttcgatcttcttctgctgctgctgctgctgatgcttgtgtgattgatttgtgtgggggaggatcggattgaagctttatatatatagacgtcgatcgacgacgtacggtcgccgggtttgaccgtggccggaggccggaggcgagcgttcagagtgtgcagagatgcttccaaggcgatggcgagttgaagtgttcgacgtgcgcacgagttcgcattggtgcgcgtcgtcgtcacgcgttcggtgaaaaagtatatcgagtttggcgcggccgtcacgggtgaactcgctacgtgagccggtggtggttgtttcgcgggtcaatggtcctccctgtcactgggattagaatgcaggggaaaaatactactccatccgtaatatttgacgccgttgattttttaaacatgtttgatcgttcattttattaatttttttattaattctttttctatcctttgattcattgttaaatatatttttatgtatacatatatttttacatatttaaagagaaatttgaataagacgaacggtcaaacatatttaaaaaagttaactacgtcgaatatttagagacggaggaagtacctttttggcatatatgtttattttttaaatttgtttgactgttcgtataaaaaataaacaaatgtataagacatgctgaagggtacttttggtgtagtagatctaatgttactcttttcactttacttataactaagtgaataaatatttttgttaaactctgagagaaaaagtcaacaatatcgtagtttacaaaatcgtctgtaattgtccaagcaactttatatagtgcacaattgttttcacatatctatgaatgtaccccctcaatatatactcaaagagatgaaaaccacgattaaatcttgacatcactaaaatcctattgaaaaaggcgttgtggagactagataattaatagtcttttaagtggcctgctactttcttcgattggccagccactatctccaaacgttgacaacatgctaaagaaatggaaaccatagtcaaatcctagcatcattaaaatcctattgaaaaggtattgtcaagctcggacaactgatagcgattttcagtgacctgccactgtatccaaacttcattagcaatcggcagtagaaacgcaatggcaaagcctggtttgcctcctaatcaatatgggagctggcttggacatatgtgcaatatctgtagatatagatggccatgtgggctgcccggcacggcacggcctaggcccggccatgcctgggctgaggcttgtcgggccggcacggcccgaccgatgcaccgggccatgccgtaccagtccacgtgccacgcccaggcacggcccaacatgcgtcgggccgtgccaggccggcccgaaggcacgatgggtcatcgtgcttttcctcagaataagtctcattttcctccctcctatcgggctgtgacatatatatagctaaaaatagtctattttacctccctcttctttgggctgtggtatataaatagctaaataagtctatttaaggtccctattctttggacaatgacatttatatgtctatttttagtccctacactttatgtggcgggcctggcctgccggcccatcgtgccgtgtcggatcagcccagcgtgctggtagggaggcccagacacggcccgtcggtcgagccgggccggcacgggcccaacccaagtcgggccatgctgtgcttgggccagaccaaaaagccatgccgtgggccgagccttcgggtcttatggccatctatatccgtagaccgtagtcattggggtttaaaacctattggattggagtcatgcatgcacatgcatgcctccaattttataatggttgattgaggaataaataaatgggctggtaccttgtcaacttatctttggtaaacacatcttaacggggaaaaaagttattggtcatttcctaaaaactgtgaaataatttactgatcgatcaatttgtttattttagacgtacggtttgattcctcgaaccgaacttcccataagcaaatgattaagcaaaatagctttttccatttgcctctagagctcaacgtttttatttagagaggttcatccgtgctgggaattgattacgaccgttgatcgtctctaatccaatgcatcaggataaaaggtatgatggaaaaggtacttaaaaggtgaaccaggtatagaaggtaaaaggttaaaatggtaattgattttcatggtttatttgtaccattaagggcaaatacatacaaacaacttttacctacctgttcacgtccgtttcctgatccctcgatctcgggttgagtttagtagaggctgcaactgattaatcaccgattagtcggatgagattagcatgcaccggcatggtgcttaattagtttctcaacgtggctgatctgcgtaattaaatgctcaacaattagccacaaaatatcttcttcgatcatatgctagcagcttagaaattaagcgcatcaatttcgcaaggaatcaattactccaatcttttcaattccatttaacagcttcacaacaatgaatcaatgcttcagcgttctgtaatcatcagcaatggccagagtccagcagcagcagcaacaacaacattacgcaacattcaacaacaatcagatcaaccgccgtacgccctatgcaccggcgctcagcatcagcacaggatgccactggccagcggatgggtacgggggttgaggaattactaatctaccctagttaacaatattttttatttctaaattatcctttcagaatcaacggttgatattaattgacttaggaggtacccaggtacctcccaagcattgtaaaacccctcattaatttatttatcattgctgcacacagtcacttacgcggttacacgtgcagtgaaaagtaaaagctaagtacgagtaggacacaaaactttccgtgtcgttgctgagtcagctgggatctgatccaaatcaaaatagatcagaggtgtttggtagaataactttcaaagctccaaccaagacaaaatactgttagtaaatgatagtttcctttatttgtatggtcaggtttctttgaagtttgaattcgattcccgtcgaaataacttacgaaatgtttgcaagtggtagaaccaaaaatgatctaggggcagggcgttgatttaggagatccaaggtcaaagacaacattttgatgtgtacttaactcatgagatagtgataggtgcatcatatgctcgtagagtcgggcctagacgacccaaactgtgagcttaactcatgagctgcagatttacctgcgttcgagaaaaaaagctgcagatttacctgcatatcagcaatgtaggagtaacaacgaatgcttagcctcactaatcaaagaaagaatccgtatttcttgacaaatcgtaataatcccatctccaaatctgtttaatcacagactgttgactgaccttaggttgtgtttagatccaaactttgaatccaaactttcaactttttccatcacatcaacttgtcataaacacataatttttcagtcacatcgtaccaatttcaacccaaacttacaactttaaaaggaactaaacacagcctcaatatagcaattggtatttgtaatttgtgcctgtcaccagtcacgactcaatcagtgtgttgctgccgctgacggctgatttccatgtaattaagcaacctgcggcaaatcctcctgatccggcgttctcccggcagagaccgccgccggtgatcggtcgcagtcgtcgtcgtcggcggcggcgatggcacggcctcttggtcggtctccgtcggcggcgaccatggcggcgcggtctcctcagtacgcatcgggacgctgcggcggcagaccgggcaggtgtttcgcagcgacagccactgcgcgatgcagtgggcgtggtacaggtggccgcacgggagcctggacgccggcgacgcgagctggagggcgtcggtgcagacggcgcaggccgccgccgccgccgcgtcgtcggagacggtgacagtgatcaccgtggccagcgccggtcgagacgacgatgggcctgacacgaaggaggagtcgtggatggaagacgtcggtggaccaccggcgtgcggcggcgtgtcaggatcggaggagatgaagtaatccgaggagagaaacggcggcggcggaggaggaggcggcagcagcagcagctcagtggagaaggacgacgacgacgacgagggttcccgccgtagcagcggcggcggcggcggcagtagctctgtggaaaaggacgatgacgacggcgaggctacgcgccgccggagtagtggctttgccggaagcgtcggcagcggcgggggtggaggcggcggcagttccagctctgtggagacgaacgatgacgacgacgatacgcgggagagtggcagatgcggcatcgccgtggccgaggaagacggcgacgaggggtggtcgtactggccaaagaagtaatcccatgtctctaagtccgggaatggcggcggcggcggcggaggcggcggcgagcggctggccatggcggcggaggtggacatggtggttttccacttgtatatcaggggatcgatctcgttggctttggtaaactgttttagcagccagtggtccacccgtttatagtatgtcatctaaatagttataaaagatattaaaaatatataaataagatagatcaatatgtaatatatatcaatcgtaaaatttaacttctacagtaatctatagaagttgctgtagaagttgaatttgaatttgtatatttgtggagtaatatattatatattaatctatcttatcaaattttttgaaaatttttcgtaaccatctagttgacataaaataaattggtggacgtccacttgagttagaatcctctccccgttggcttttgctttgctttttctcttgcgcgttgtgctgctgctgctgacgatacgggtgactggttcgcgcccttttttttttctctcccgcgtttttgtgacttaatcacgaagaacttcgacgtgaatggccaatcaaaagttaatcccacttaattagttacgtgtacttacatggttgatgggtgcacttgtaattaacctctagaatatgatactgcccatatgaatggataatgattgtactactactacctgaatcttggagtagagttatgaaaatacagtaacacatttaacagtttaacaccggcagtgacgagttagttatctttttccgaggatcacctagaaggcaacgtataaggtgaaaactaggttcctgtgcaaacttggaaactctcaattaagaccacaggatgctcatccgatggctagggacagaggtgggctaattttacactttaccacccgccattagccagactaatcatgttttttttgcaaatcaccccacccaattttacaattaacgaccatcgcttcgtctggtcgtttcgtctggcaacgccgccgccgccgccctagtcgccgctccctcgcctggccgcgaacgcagtggcgcccagccggctcgacgccgtcgctggcccgccgagtgcgccgcacgccgtcgtttcgtgagtcaccgccgacctcacccgcgatttgccgccgccgcccgcccgcgagtcgccgacctcgccatcagccgttgcccgcccgccaccgtgatggagtccggcgcgcgcgacgccatggagtcgcatttcggcgttggcagcggcagcccttcatgccatcgttagtttctactataagactttcatcttaactttgatagaaattaatctgattgctagcgtgcctgcatgcagtggacggtgagcctgtagtcgtcgttgattctacctctgttgaggctgctgccttggatcatgtcatcatcaccgtcgacgccggagttggagcccaccttgaacatccaagcacaccacaaccaaaatcttctgtgagtatagcagtaagttgcaaagaattcagatcatatgctcatagggtatttggcatgagtggctaatgcatttattctggaacatttgaatgaaatgtgcagatacatttccttttccatagtaaacatgtcgaactagttctgcctgatttgttgatcatacaattttacacttctataggtctcttgtacaagtgacacatgcaacacacattggaaagaacatttgaagcctatggttggaatgatctttgatacactcacagatgtggagaaattttacaaatcatatgcacataaagctggtttctctgttcgtgttggtcagcactagaagcaaaatgaggaaatattattcaagcggtattattgttcaagggaagggtacagacaggagagtgtaaaaaaagttaatgatgaatccggaaaaaaaagaaagtcaccaaatgtgatggaaactagatgtggctgtgaagcacatattgttg

SEQ ID NO: 64741 - DNA, 1615 bp, Oryza sativa
agttgtggcaaggtgaggcaaattgtggtagtgaaccaaacaacccctactctccggtcaagtaatgccgtcttcaacattttatgactatggactgttgactattgtgatcatcagccacaaaaactgaatcttttttttttcagaaattctgaaccattagcaactgtacagactgaatgtgtcttgcggcgggcggatgttgattaattgttgagtatagtaatccaggtatgttcctcaccgtcttacaatattaatatcatgatcacttaactctgtaatggtgacaaggacgtccagaattaaaaacaatacaatactgcttgattagccaaaaccattaaaaatgagagatttagggatgacgtaggtgatctattagattaaagaagctgataagatgccaatgcattcacactcttatcaatacccataaacgatcatggatgtcattagtaaacactgtaaaacatgatggcatgggtctaaattactacggattataacagagcctgatcgcatatgattactaaaacaaatagcatacgaagatatgtcatcttacattcaccggccggtcggttgcatcagcatcaggaagtccaaatgctagtcattctgtttcagcctaccaaccatgtacttctattaatttaagatacaagtgtttgattgactgacttgaacactgataaattaatggatgctagctgcgtgaatcaggcattctgcccaagctaagctaagtcctgtgacagacatgcgtattgcactattgcgcgttcgccattcatgagagcatatctgcctctgacctatcaggtaagttactggtatagtaagcatcttgttcatcaacatcttgtttagctttaggtgtccatgcagttgataattcatcaaactgatcaaataacttgtactgttgtcagtgtgctgtgtgctccatatttgggtagtttgttgcaatcggtttatttctctgtatctgaccctgtgtcactgatcttgcatattactcaaggctttcacttactctgaatccagctgaagaagaagcagagaagaaagcaatccgttcttcagtaaagtaacagctgaagttcagagaacaacaacccttcaggcttcaggtatcaacagttaataattgccaacatttcatcatcaccatctaaacaataatactcctttgtgtttttatttgtctatacacatgaaccagaaccaaaattggaactagccatgaaagctccttcagttggagagcttctcttggtgttcatagcctgctcttgctgtgcacatgtcgtctgcagctcgttgcctggaaatgagacagacagactgtcactgcttgagttcaagaaggcgatcagtggtgatccacagcaatccctgaattcttggaatgaaagcacccacttctgcagttgagaggacgtcttgtgcagggcgaagctccactccgtgtcacttctctgaacctgacagattgtggtttagcaggcaatatctctccatcaattgccaacctgacattcctaaagtctctttccctgggtaaaaattcattctttggagaaatccctgcatcactgggccacctgca

SEQ ID NO: 64742 - DNA, 2199 bp, Oryza sativa
aaagtttcaatctttttaaaagttgaaatacaatcaacacctcatgaaatattttgctaccacgtataaaacaacggttctgaatatattgaaacatgaatgatgtagctatcaaaaatcattcgatagccatttagccttcccgttacaaatttgcctattcacataaatgtcattacctccttccttttttatcttcttccttctcactccccatcttcttcttgtcttgaccacgctgcccgacacgtggatgcgagcaaagagggaaagagggattgatggatggatcagtgcggcggaattggctgtagcggccttgagcaagacctgcacgtcgctgcccaatccgccgcatgccgctccatcaatggtcgtccatggagatctagcccgcccccacagccgccgctgcagccgtggcttgcattttcatagactgcaacacaataagatgggaagaaaaaaagacgaccaaataaataagatgaatggaaaacgtaacagctagtagtatcacgatttcaattttataaaatttctatggtatagttaggaatagacgaattgtaataatatttatctgaatagataaatttacaatggcatagatccaattaactttttttttctcttcttgaactcagccgcaccacagcaccttgaacggttacatctgaaaatggtttgctcggtaacttttgaaggggaataactcacgagggattgattgtcatagtttcatttttacttctcatccctcaatagttggatagtataagattattagctcatattaaatctaacatgtataatatatttactatacggttagttttattttttttcttttctctctttctcttactatgaatttaatgtaaatattttggagcatttgtatagctagctcttgcatgagagacaacacttctcacttttatttatctttctatttcacacaagtttatagttggcttatagcccactaatatacttgccctaagagatgagaattatagttaattcaagtgagaattaaattttatgtgatgatgtacggcttaggctatctcattgaaattaaaggggaattccctcccaattaccacttgtacctaaatgacgcgacaaaatctaacattatgccattgtcacaagtgggattcgtttaaatgtcattccctagaagggatttaatgaaatatcactctcaatccatagctacatgctaaaaaaatgtttgtgaccaaatttcccctacacacctcttattcctgtctccaacgccatcatcccttaagccctagctcctcgtcgctcctcattggagcaggcggcactaaacggcagatgcatgcaaggaggagtaagaagctcatcgaggacacatacgtggggaggagcggagaggagcgaggttggccacggtgcatgctgggatgaccttaattaccagttgaaggcataggctgggagaagttagaggacttcgctggccagaattagaagagaagatggagatggaggaagcaaggccagtctagtcttagtcttagataatattttagcgtgtagctatgggttgaaagtgatattttatcgaaacactcttgcatagtggtttttttttaacaaaaaccatgtattgaaaaggtgggagttcgctcttaaattccctttcttaatccctcctaaaacttctacgtccaccaaccaagacttaatagcccccgcccccataaacttctatgcccacctaacaatttcaccccttcccccaaccaaacacattcttaatgttttggagtcaacttattagaactttgaatattaataacttccaaaatatttagttcaaaggcattaattagaacaacatgtaaaagattagtgttaaaaacagtactatcgtaaaattaaatatttatttattgtatatactataatagaaaattacagtgaaagatatgtttgcgagaccgtattattgtccaaaactttaataactatgaaacggatagagtagtactaagtactaatctagtgtaaatatcaaagggcactttaaaatttttaattgaaatatcaattgatatttcatcccgaatgaacagttattatcatttacaataattgaggatagatatgttgttgtggtaaataatatcgaccaatataacccgcatgctttctaga

SEQ ID NO: 64743 - DNA, 13440 bp, Oryza sativa
  unsure (1)..(13440): unsure at all n locations
caagataccactggtaataccaacatcatggaatgttaatgatgagaagtacagaacgccatttatgccagcaaactgttgcagaaagaaaagggaccctccaatcagtgcaactgcatatacatcagaaattaagctattaatatcatggaaataaagatcataataatgcaaagggaaggaacaaatagaaacaagtatacagacattaagtcgccaccccctgctccccgctaccagcctggtcggcgcccggctcaccaccgatgactgtcgctgcccgccgcctgcgcattcaacgacaagggcgggagttcgccgcagccgcagccaccgctcccgtcgtcgtcgtcgttgccagcggccggatcaacggctgacggatccgctgacccgtgaccttcggccgctggggtcgaagaagacgaaggagagagggaggagaggcggcgggatccgcgagcaggccgcagtcgccgatgtccccatcgccgcatccgtagccattcccgacggcagtggagccagctctcccgagggtggcgccgccggatccgaggaccaccgttgccgctaactcccaacgccaccgcctgccgcttccgaggtcggggatggcggatccgcaagccgtcgccgctccagagttcggcggcggcggatccaacctctgccgccgcaactctcgaggtctggagcggcgggcgcgcgtcggagctccgcatctggccgccgccgccaccgccatcccccctcccggcggagccgcctccaaaactgccttcaccctcccctccaccctcctcccctccttatccaatctagccagcagccccttcaccacgtaaccggcacgcatgcacaccaccacagcgcccaaatttgaattttttttaaaagcaatatgattttaatgaaaaatcgcaaaactatatgtcagttaggcgaaatcgcaagtttagcaccctgtcgaacaaccgcggttcgacagggatacctatcgaacaaccacagttcgacaggtacatgtcgaactgcgtcagttcgacagggtaggtggtccaaaaacaaataaaaaattacatgaacagtatcactacaatgctaggcagggacatatcgaacagccaaagttcgatagggttgcgtgaacnnnncgnnacnnngatgctacagtgctcgcagtcacatatcgaactgccttagttcgatagggtactgtgaacagtgtgcaacagtgatttttctctttttttaatttttttaatcacctgttgaactaccgcagttcgacaggtaccctatcgaactgtggttgttcgataggtaccttgtcgaaccacggttttttctctttttttaatttttttaatcacctgttgaactaccgcagttcgacaggtaccctatcgaactgtggttgttcgataggtaccttgtcgaaccacggttgttcgatagagtgctaaacttgcgatttcgactaactgacctatagttttgcgattttccattaaaatcatattacttttaaaaaaatttccccaaattttgatcaaccagcgcaccgcttatgggcggttgcccccttacgcgcaaggagcaagagggattagcagcgacgtgtaaaacaatataagatagcctaaaaagaatttaaaaaaatgagaaaaacagtggggttaggagagttattgattgatgattagcgttggggaaacgcatataagagcacccgtaatagtaaagtaaggtgctctctataaaacatgtacatctcagcaatagactagattaatagtaaatcacctcaatagtatgtctacatgggtatctatagctctctcatgtattgcctcgtttttctctatagactatctctaagttagtaaacagttttgctctctctctttatttaatatcttccaagtagaaaaatatgctgatatgaatctcctgtagagagtttataaataaccattgtgggtgccctaaaaagcatatcagtagtagaaggtacagtaaaaagcgtcgataaaaagcacactactcggtactcacattctcaatagcatcaggaattcaggaccattacagccgcgctggagagatctgcgcttctgtaattgtgtttgccattccacaggagtgagtggcagacaaatcgaatgaacgcaacaaaaattgggcacaacccgacgctgcccgacaaaaacacagccggccacagcttctgtacaaaattatgtagcatcaacggcgagagccgctctgttaccacagcaggttgccgacgaggcagagagcgaacgccccaagaacgtcgccgacgacgtgccggccggccggaggagggccggagctcgccgccggggtgctcgtcggcgccatgccggccatgacgcctccttcggatgccatcggcgtcggcgaagggccgaggtacgtctcgaagaaggacgacgtcggcggcggaatcagcggaggatactgatgcggacctgcacgaaaagcaagagctgcataaagtctcggtttttcaaggcagaaatggtgaactgagacataattgagcacgaattttatacctgggcattgaggcttgagtgctgtggttaacctgaaagatgcacaaaatgtatcgctacggtgagacaacggtttctgaatagcaaaatgcgagatggatttgggacacacacacacacaaaaaaaaaaaagctgatcaattacgtggtgagaattgtgccgttcacgaatccgccgtagctgcaggacgtgacgctgcagccggagctggtcatgaggagagtgaagttgccgagcatcatgctgctgttggcgcactgcatgctggagcacgtcgagtcggcgagcggcgccggcacgcagaacaggctgcaacagcagagcaaaagcaagcaaagcaacgggcaacggcagcgtcagaaacaggagagaaatctctcggttcgcgtaagatctggagcagattgaagatgggagggtgaaatcgatcggtgcctactccaagttgcctgggccacagctgcactggacacaccggttggcagtaactgcgtaggtcccgttcgccaccgccaggccgtagtccgccgtgaacgccgggaatgatgatgtgcacgctgcatgttcgagagaaaaaaaatggtactccgtcatgattaattgcatgtgagataaatgaagcagaaaacggtatagggataacagtgacgacgaggacgaaatggaccaatcatgtactaactgtagctaggtactggctattgtagtggccactgattaattatgatagaatcctgtttgtccgtgatctgacagaacatctgggtatggaggggattgaaacttttggccacttcccttcagaaattatcggaactacaattcggtctagaaactcagagcagagtgtttagtttgtttaccaacctccttttaggaaacaggaaaacagcacagcttttcagtgctgaatctatgtgcacaaatgaaaatcgttaattttttcaatgcatcacacatggatcgcacttaagaactctagaagacctttcagctattcacaacagagaaaacgacacaacactttctttctcacaatagtgaaattaaagtctctctaagtttgtgttgaacattcttaattgtcaaatttatgtcgtgcaatcgtgctgcatgctacaccttttttttcatctccttttcttgggtgtcagcttaattgacagcaaatgatcaaaaggagcagtggaaaggtaaagtttcatgcatggacccttttattttaaagctgagagcgccagtacgtgcagatacacaaacagagcatccgaactggcactagtaaacaatttgagcagacaagcagtgatgcgctgcattgctggcactcatgtttcacctcacgaatcttgaagcattttggccctgtttagttacaggatgaaaagttttggcgtgttacatcggatatatggacatagacttaaagtattaaacgtaatctaataaaaaaataaattatagattccgcctgtaaactgcgagacaaatttattaagcctaattaattcatcattagcacatatttactgtagcaccacattatcaaatcatagcgcaattaggcttaaaagattcatctcacaattacacgcaatctgtgtaattagtttttttatctatatttaattctccatgtatatgtctaaatattcgatatgacaggataaaaagtttttgcataggaactaaacatggcctttctgatatcaaagctagatactccctccgtcccaaaatatagcaacttaggatcggattagacgcattctagtactacaaatctgcacatgcccgtatccagaattcggagtaaatctcatgctcgcagtagcaaggcttgtggccagtgcggttactgcattgcactaaattaccaaggacacactagactaatcacattactgtcagtatagtactcctactgctacttcttactgagtatggagtaaaattaccaaccaaatttgtcggttaaccacccatggccatggatctaattaccaacgaaccacgcaatacatctcggtagcacaaagcaacaaaaccaaaaactaccagatccaagaagaagctatgaattgaagctagaaaagggctcacctggcagcgggacgacgatgatgtcaccggcggcgagctcgggggtggccatgtcgttgacgctcatgaggtcggtggccgtggtccggtacctctgcgcgactgcggcgacggtgtcccccttcccggcgacgtacgtgaggtacaccgcggggaggccgttgtcgacgccgccgaagcaggcgcagtgcagcggcacgaacagagtcgtcccggcgtcgacggcggcgtcgggcttggcgccgaggatgccgttggagtcgctgatccagtccggggtggtgaggccgccgtagacggaggaggcgacggaggcgagcgtgtcgcccgggcgcgcaacgtagcgcacggtggtgaccctgcggatgccgtcggagcaggcgcaggggacgggcacgcggagcgggagccccgcggggaggatgcggtcggcggggtccgggacggcgaagtcgatggagttggcggcgaggatggcgagcgggtcggcggagaagagcgcggccagctcggcgagcttgaggtcggcgtagagcgtgtaggagagcagcgctgggcaggcggtggaagaggagcaggactccagcgtcgacttggaccgcgcgggcgcgacggcggcggcggcggcggcgaggaggaggaggaggagcaagggtggtggcatgatgatggcgacggtggtcgggagcgcggaggcgtgggagtgtgtgcgactgcgagccagtgagagtggagactgttgacctggagtggggcgatgtcgagagagtgctttgctttggaaagcgtgcggggggttttggatcttgtgttcggctgtgcagaactgcagacctgggatcacatgaggtgtgagtacgggagggtgaggtttttacgagggtgcttgcgagtatctgcgagactgcaaatgcagaggatccagatctgcgagaagctggtgttggttcgttcgaattttgttttgtgccgtttgtattctgatccaatctgattttgatcagatcaacggagttgcttggcatcttggcagtgtacggttgcgtcttttcctttttgtcctgaagagcgtgctgattaggagaaattgtcctattcatactcctctactagtacccctacctccgttcgtataatataagggcatccacaatgtaagacacttctagagtgtcctcactaactgaggagacttgtaggaaactcagctcgcaataggaggtatctctggatgggctcctcaaaatctgaagcaacccgatgaagatactacagcccacaatgggtatcttggcccaaagtaaccccagatgaaaaatccccaaataaccctcccagcccattcttcttttttccttctcttttcttccaccctctcttctcacgtcttctttcttcttcttctcgccctcctcgtcgaccattcgccgcccccgcctcccagcctgccgccgccacctccctcctctctcccccgccgctcgccgccaccgcttccctcctcgccctccccagccgccgccgcgcctccctcctcgccctctctagcagccgccttcctcttccctccgcctccaccagccgtgtcccaccgtcgtcgcagaagtggttccagcgccggcggcggcggatccggcaccgaggcgggcagatctggtgggcggacgcggccgtcgaggtggcgggtgcagtcgtcgccgggtcatcgtcatcctctccgtcgcggaagccgagcccgtcgccggttggtggccgccggctgccgcggcggtggccggatctggtcgtcaccgtcgcggatcctcgtcgtcgtcgcctctctcttctctctctctcgttgccatgccgccggtgaggggcaagaaagggaaacgccaggagagaaggtaggagatggggcaccgggtcgccacaacgcgtagcctcgagggagtgtctctggaaaaagtgagctggggagctagaggggcgcgttccccgcgtgagggtcgcacctccctctagagacacgccgcgcggacggacggcggacggcatgagcggggggacgacccagggacaccgactgtggatggcctaagaaattttgtttctataatttgtcccgcaatataagttactatttggaatcccaagataacacaatccctttcccattcatcaatttttttgctccctcatccataaatataaaagattttggttagatgtgatgtatcatagtactaaatcctttacatttagggacaaggagagtattactttattcttccacctatcaactctttgctaatttattccacatatatcaaatcttgtacaattttatcctcctatctaccacaatttgtattattttatcctcctatggtacaattgtgttaactaaggataatttggtgaaggaattagaatgatagtttaagatgttgttttttatgaaaaatgaaaccatctaccatctattcattgaatgtcattttttgagatttctttggagatatgtacacatttcttttgatttacatcctccacaaagtatgtctcatatattcgggaattggcttgttggtgttgataaaagaattaagaatcttattcttgttggagcatccgctttatgttgggctctctggcttagtaggaatgacatggtttttgataaatcaccatcaaaatcttatttacaggtacttttgagggcaacgtattggctctggtgttggacccaattacaaaggtgtaaagaagatatcagcctaattaatgatgcatgtcctaaacttgagtcaacgattatgcagctcttccccaacttcggatggaggttctcaaatagaattcaatagttgtgtgatctttatcttgttggtgtctattagtttgtgcttgtttaaaattttcattctgtggttctagactcactgtgtgagtttgttattgtgtgaactatgtaataattggctgtaactcgtttgagcaaaggccgaaatattttattccattatcttaaaaaaatatgttgctacttccttaatttatgttaaaaactgtataatctcttgtattatgggatggatggagtactttcatcattttaaaataagtggtattttaatattagaaaatactacagaacaagttctgtgagtggggcaatgtgtcagtacttcttcggtagtgtaggatgggaactaatccttcatgcacgcaaaacggagtggtttattagcacatgattaattaagtattagctttttttaaaaaaaaagattaatatgaatttttaaagtaacttttgtatagaaaatttttacaaaaaacacacactgtttagtagttcgaaaaaagtgcgcgcaaaaaacaaaagacgtgagttgggaacatgaagtgccaaactcagcatggacaattatgcatacacgcttttcaaactattaaacagtgtgtcttttacagaaattttaaaacgatgctattactacgacggcggtgcccctccccgtcgaccgcctccagatcgatgccgccgacgcgatggcgcccttgccctcccactacgtcacgagagagaaggtgaagagaaggggggagaaagagaagggatagggagggaggaggaagaagagaaagacagaggatgacatgtgggcccacatttttttcgagtaaatgacatatgggacctacgaatattttctaatgccacataaacgtcatgtgggatgaagccaacaacgccacgtcagcaaaaccgccctccaaaaccactgagggggatcaaattgcactggtttgaatagttcggggagtcgtcctatccggtttttgcgattgagggtcacggatcagattcaggttactttttaagggagccaaagtggacttattcctagtctgatagtaaccgactaaccgttgctttctgggccgtgttgtactggagcacaggttatgacgtgcggaggcccaaagagttttgggccgtgggggttgcttatcttgccatccttgacgcgcgctgagctggcccagacgcccccagttccccttctctgatgctttttttttaacgactcgcacgagacggtgcgaagttctaattacaagattataaccctggagggtcgtaaccaggaaaaagaaaaaaacaacaccacccacacaccgacatcgccaacacacaagcccaggagaaggctagcaccggaccggccgccgctaagcgtgaccagccgccactagactaacaaagggacacagctgagatcgctccctaggggatgccaaaacgacgtcttcaagaagagaagcgacggaaaaaccgccactgccgtccgtcgggactcaaaggagccaagactaggctttcgcccggcaatcgcccttgaggggtgagacctacggctgacacaccgatgctccaccaccacacaagctctgccgacatgtgggaccctgcaccggcgtcccctgccgaccagccttcgtgcgccgaagatcgcgccacacccaccagcagctcctcctcacacctaggtcgcctcctctaccgccagccgcgcctctcgtgctaagccggccgcctccaccggacgcgcctctcgcgccaatccggcctccctccatcggctgcacctcttgcgccaagccggcctccaactctgccgcccgcgcctctcgcgccgagccggcctccactgccatcggctgcgcctctctgcgccaagccggtctccgacccttccaccaaacgatgccgcgtcggccaaatgcagccatctcccacgccctcagctagccgtccagggccgccatgcctccggtgactgctgtcgcggccaccagccaccgcctccgtgagccgccgccactgccagcagccgcttcgttgtcgccattcgccatgctgccgccaagtccttcgccggcgtcgtcggccgacgccgtcgctgccaactgccgcggccacaccgccgccgtcgccaactgccgttgccagccgtcgcaagtcggccaacgtctccgaccaccacagccggctaccctccaaatccggccgagaggcgcggatctgggggcaccgccgccgtcgccgcgcagggaccaataccgccgccttcgcgccctcggccgacgccatccccgccgccttgaaccaccatgacgccgtcaccaccaccaccagaaccaccgccgcccagctcaaccccgtcaccagccgccagctcgccggcactatctccgccgtggcggccttgccgttgccagccagccacggccgtcgtgtcgcgctgccagccacagctgcccaccggccagccacggccgtcgcgccactgcgcctgctgcggccgcccgctcccccagccgtagcgcttgccgccgatgccgcgtctccccgccgacgccacgcttccgcaccactgctgaccagccacggccgtcgcgccatcggcgtcgccgcatctgccgtgctcccgcaccaccacggctcagatccggcagcggagacgtcggatccagccgccactcgcctcgtggccgatgctgggcgccggatccggtggtggcggcgccggatccgctgctcttcgccacaccgccgccgcggccttcccgaagctccgcgccgcctgggttggagcctcgccgccgccatcccagcggccgcacgttttccggcgacgtgctccgacggcggcgaggccagagagaggaggggtgtggcggcggtgctagggttcacccccggttgcccgcgcgaggacgacagggagcccagttgactccccttctctgatgctcagttgacgtgtgcgtgtttacaatgttaacacaagcattaacctcgaaaaccactgtataatagtagtatgtatttcatcctaaaaacgacaaaaacatgtggcttgtctagttgtctagctagttaggcatgaatctacaagctagcatcattctcgtcagccggtcagttataatcttcaattaacgtattcccagagtgatccagtcttattttttccagttcttatcacgcaggaaattacaggacacaatatctgctgcaatttgatggtgatgttgttgaattaagatttaggaacattaattggtttgagttatctagctaggcagaaatttggggtcgacaaggacaactagtgatgatcattgcgttgatctttctgtcttccagagattaccaaagcatcgatcaatgtcaacgcatgtgctcgtcagtttcacgaacagagtcatcgattgctccaagtctgcatactgtacaccaaattgatctcatcaacgacatgaaccttggattctacctcaagtggaggcgctaagctagcatgcatccttctgaaaccatcataggcatcgacatttgacgtaccaatgttcatcattgtactcgatcaagacaacatatgattagtagtactgctgcaattacatatctgaagatttttctgaaaatgcaatgtcagtatgcagcgcactagtaaactgcagtctgcagaagaacacacatggaacataaatcccagagagaaaacgatctggcgccttgaagtggtgcaacttgtggtagtagtttttcgccgtgtaaatggcatcgtcgatcaattcacagctgctgcgtgagcgaagtaatgaggctagctatagccgtgtccctgcttaaatgcgtcggcagttacgttcatgtcctccggtcctccccttgttctgactgtcagagtgacagtgctcacgtttactaccaccctgaacccagtgaatactagcattattgctacgtacagtactagcatagtaccacgatgcagtgcttcacaaatcacaatatgcatgcacgtacagtttctgaatttcatctccaagatctgcatgcatggctgttgatataagttttcagagaagaacacctgcagcaattaaatccgtgcaatgcatgggtgtgatatcattttcatgtaaacatagttaagaacttgatgagatcgagatttgatgccaatgcagaaatgcaaggtgttgaggtgcataaaactgcagggtagcagttgattcagagtcagtgagaactgagaaaatgagaagctcgcagcatgcgtttccccgcatgagcagcatgcctgacacacatatacactgctcactgtctacaaaaacacatatacactatatagagtaactggtccttagctatccagggtttccttctagatagaaccaaaaccttggattcttgatgagcaaacctagatctttgttaaactttgcttgttcatatgctgataaaacaaagcaagagctactccagttacagctaaaagcaaatgaaaatttccgggttaatacttaatacacaagaacaagaactggaggtgataaacatataacataccagtgcaccacactcggatgagagacatattgtgcagatgctggttaaagggattgaagcctggtccgagatcaccaagcatcctgtgcctccatgaatgaacattttgcacaatgtggagaccttgaaccagacaacaatccccttaacctaacttcagcctggacatgccatgcactccaaaacaagaactcctatcaaaatcaaactgattcagagatgccaagatggagtccaccatggacagtggggaagaggaagaagaagaagaagacacgccaagagaggtagctactgatcgagccatcagtgcagtagagcgctggtgtttttgaagagggagaggagggcagttggcgcagctccttgggatgggccgcgcgagctgaattgccatttattgaggggctagcttaccaattaccattgggcacgagctgctctgatggctgctgcaaatgggacttttatgacctgtggtgtactggtacagcgtatgagagggaggaggacattgtatgttcataccttcagactcagtcatgtgtggagtgcagaggggggagctggtgatagcattacactcgagtcacaaatatgtggggtttttggccatcttcgtaattgtccctgtcacaaatactagatatggacctgtttggttggttggatgcctaggcaaaataggagaggagaggaggattatttggatggagcaacttagctagaaacgattgattcttttggaaattcagaaaattatagattgaatgtgccacatccaacccgaatcccttatattttggaacggaggattataaacataacaaatagcttagaaaaagtggttcaaattaatcattttattagaagcgtggcataaataatcttagtccaataatccatttggaacatggttatatgacaaacattttgattagtgccatacattcaccggttggcacaaaaactaagcccaatttgtatctgcatagttattccctccatcccaaaatataatcacttatcgagctttttcaaagattagggagagaggtgaaattaaattggaatggttgttggttgatactactaggaagtagtttgcaaaattaaatgagagatcattgccatttgctgagacgaggaagtaaatggagaagttgctatattcaagcatgcagtttaaatgctagaagttactatattttgatagggagtgagtacaaatttttgctaaacatgtgtatgtatgatttccgagccctaaaaatggcatactccctccgtttcaaaatgtttgacaccgtttactttttagtacgtgtttg

SEQ ID NO: 64744 - DNA, 2279 bp, Oryza sativa
gtgtggagatgcttttagttaccacatcaagaaattgagtaactcattggtataggttaagctcatctaagttcatctgcataagtatttttccactctattggatgagtatagttcttattagaaccttaccaacttactttgtaatgtaatataagcagtttatctatgtcaaatatgcttgtataaagcggttcaggccattttaggatggtagcaatatatttctgatatagtagttcagtagttgttaccatcggtacagaactacaggtgcccatctcgattggttccatggagcataattcatggaacactttgattttggcgagatgtgtacaacaatcgatacattgcttttaagtgttacaacttgaagtcttgaacattcttgtgcaatcaagagatagtgttgaaatattattcctcactggaagttggctatgctgatatcccgacaggaagttgagttagctaaacacattgattactttgcttgaacctgcagagacattagacatagttgttcttattcatatgttgtactcttttcatggaattaagaaaccacaagtccttagttcttgatcatgggaataattgatattttgtattactaacaagtagtacatcccccgtttcaaattacttgttttaggtttgtcctaagtcagacattcgtatattttattatcaatttctaaaaattcatatagtttgaacgatgttcaaattggtggtcaaagatagacatgtttgacttaggacaaaactagaatgatgctgtgcatttgaaatactatgatcccaaaatatttttattggagaatgcctgtatgcatcagcactccaacatactatgcacagatcattaaacaagttagcattatccaccctattcatgcttgttttccttatttagagcaccatgtaaagctctcccagagtcatggactcatggtccttcagatatctttatccatctttatgagaacaattctttacaacatgacccttcaagcaagaaaagctcacataaagggaatttaaatatatttctcaattggtcaaggattaaagcatgaagtgcacgactgcatgttgtaaagggtacaagttagcatatttttcttgaaatggtgtggccctaagtctatagatggaaatggtgttgctgacatgctgtagtgttctcatgtgtgactgaggagcatagcgtaataaaaagagacgagatttggtggaataaatattatgaggaataaactttttctttaatgataaattcgcttaaatcattttgattgtgctggaagcctggaatgctatttctttacccggcatacatcttatatgtacatctgatatattatagcaagatatccttgtagaatcatcaattgcatttgccactctttgtaggttaatatcataatgtttgtagttacatgttgcccacaatgcatatgaatagagtgaaatgtatacctctatactactaaaaaagacaatagtggttgtggtggttctgccacatgcccaccaccactacttttgcacgttctacaaattagtccctgatattttctgttattatgcaatagtctaatatttgtttgaatcaaatgaataacatatattcaaataagcatggccattttacccatagcaaacgtggacatattttgctagtactatattactagtaattcagtttatgcacctagagtgagatttaaatgtgcactccacatcatcaggttacttctctttcagtacacaggacagcttgaggggaaaattaagtagatttagaacctttttttatgtgtttttcacattagttagttaattctgccaaccgtctagcagttctatacattttttcccctattattttgcaggttatgtgcactgagaatgtcaaggaaaagactgagttattacatgctttgatcaatggtaagaagctttcagaccttccaaaaattaaccaggtaatgatttgccattacaagcagttgatgcctgtccatgttttttttacagttaatttaatctcttgcctgttgcattctgtttatttgacagcaaaccttgataatttggggagagcaagatcgggtctttccattggaacttggcctacggcttaagaggttggtctaaataaaattgtcataatattcaagttaccaaggcaataaattctggtttggatacagacatttgggggatacatccgagctagtcattgtcaagaacgctggacatgccat

SEQ ID NO: 64745 - DNA, 1260 bp, Oryza sativa
acataagatcaaattgctttatgactttgttgaatccatattacctccattaaattgaatgatactagcactaatcaatttcaaacattgatcagtacttccattcagataaaaaaaagtataaataccttgaaatatggtgtattatggaagtatttttgtgccacagatataacatcaaaatcaaatagttattgacgtaacttgtggtcaaagtgtgataagtagtcaacaacactagtttatttgagagctcccatcccatgctacacccttctttttctcccttagactgtctccaacagccctcacccaaattcgttcgtttgggtcatgcgggatgtccgggtcacgcacccaattctttcgttctccaacaacggaccaaaacgagcgctgagcgccgcccgcttccctccccaccgagcgccgtgcctccctccctccccgccgcggacccgcctcgccgcgccggtcgctccccgtcgcgggcccgactcaccgtcatcgtccgagggctcgcctcgccgcgccggcgtctaaacccgactcgcctcgtcctccgcttccgtgtccccgactcacgcgggagctcagccacaagtccggcagcgaagaccgtgcagtggccggctgatgcagcacccacacgggaaggatgaccgcgagcatgcggtggcggcgagcggcgagcctggacgaggcggtggcggggcgggcggcaccgatttgggttgaggagagagaaggacgcatttttgcgttctcactcgactccgacgcaaattgcgtctccggtttgggtactctgttggcctccgattttttcatcggatgacccatatttgggtttaggtaccattatgggtagactgttggagacagtcttagggcaacaataatggttaatatcaaagtgagtattattgtggaactgtgtggtgtcagtggaattatgtgtcagtggaattgtgtaggagtagagttttgtataccatgtttccaaaagtttgttttggggagcctggttcaacatgtgcataaaacctttgttgtgggatccatcttctatgtcgtgtttagtttatgaaattggggagaagtttggggaaagttggtagtttggaaaaagagttaggagtttatgtgaggctgtgtttagttcaacacaaagtttggattttggttgaaattggagatgacgtgactgaaaagttgtgtgtgtatgacaggttgatgtgatggaaaagggctgaagtt

SEQ ID NO: 64746 - DNA, 1030 bp, Oryza sativa
aatgtaagaaaataaaaaaaatcaattacacagtttgtatgtaaattgtgagaggaatcttttgagtctaattatgccatgattggacaatgtgatgctacagtaaacatttcctaatgacggattaattaggcttaataaatttatctcgcaatttacaagcggaatctataatttgttttgttattagtctacgtttaatacttcaaatgtgtatctgtatacttcaaagtttttacacctaaagaactaaacacaccctaaaatggcaaagtgacggcgcgctctccgtattggcatttttaacaaaaacgcgtttttgggatggtgttctagcaaaatcgcttttcaaacctgtccaaatgtctattttctcagtttgcatgtggaagagcaatgtgctgttcgctttgggccagcaaaaagagaggtagaaataaatccaggaagaggaaattgggacgcacaccaacacgaaagaacggagaatcaactccgactcggattcatttctataccgcatcttcccttacaatacctcgacagactaaccatcgccagcgtcaacaacgtcttgactaccaccaccgtctcaactctctctcagactgtccgccatggcgcagccaccggagttccaggacgtccaatcccgcgccgccggtgcggtggcattcctcggcaatgttaaggcccggttccggcggaggccggccgtgtaagtcgagctctgcgatgtgctcacggcgtacggcagagaccccgccgcccccgccgcgccggtgctccgccgcacggcggagctcctccgtggccaccctgatctcgtcgccgagatcaacgcggttatttatccccgcaacagggtcgagctcgtacccgccgccgacgacgacgatggcgatcatgcagcagcagcggcggcggcaaggacgcgtcggaggagcgacgcacagcggcgccgcccggacgatgccgccgtggcggagagctccgccgccgccgagcgacgagcgaaggtgcccaaggc

SEQ ID NO: 64747 - DNA, 1329 bp, Oryza sativa
tgtgatgaacaattgggcattggagattattggttttgtatttggaatttattcacaaggtaattttggagatgattggatttacaggtgaatttacaggatactgctgtgattttatgtggtccggtcagaccgggcaggggttgccggtcagaccggcggtgatcgagcggtcggaccggccagcccgcggtctgaccggctgacactgtgtcggtttcggtttcgggttgtttatttggatatctgagtttatttcatgattatgacttctagatggataatatacttatgtaatactattgtttgctgctaatgagtcaagttagagatagcttggtctcggaatatggtttctttgtttgttccatgtgtaggtgactcgatgtctcggaagagtatttgcggtgatggaccgggagtcggcttggggataagacgacgtccgttgtggtcagagatcatgcgggatacttaggctagagttgatgcacgtggttgatggagatttcatatggcatacgatggagttattgtgtgtgtatgggatgcggagtcgaatttggaagaagtccaaatttggtacgattggttatgtaaagtttctttcttgtactagtgggtttcctaaggtgtttaggactcctagtatgagtttggttcgtggctttaggctgcctacctcatgtataaatagagggggagcgtgaggcttccctgtatcgctttagagagtaattgagttgagttttgagttagggtttcgagtttagttgaaatttttgtaaggagtgctgttggtgcactttgtaaacacagagagaatcaataaagttgtcatccactttaagagttcttcgatttgtgtttaccgaggttcggcggtctaactggcagcgcaccgacggtcagaccggcggcattgcggcggtcagaccggcgggcacacggcggttagaccggcggcgacaggagtcggcagccggcgttctcggcggtacgaccgatcgatctacatcggtcagaccgatgttcatcaggcggtcagaccggcgcagtaccttcggtcagactgcgatccatcgatttcaagggtaacttttatttccgctaaaagttttcggtttttgggtataccaaccattcactccccctctggttggcttagttcttgtgattcgatcctatattttagaggaaaataactagatcatttgtctcttgcaatccttttttttcagttgttgcaatcagacacatatctgaagcttttcatgtggtttatctttcctatgaattcagagtccatgtcacttgattttttgtttt

SEQ ID NO: 64748 - DNA, 705 bp, Oryza sativa
ccaaaaatcatgttttgcattttttgaactttttgattccggtcaaaaacatcgcaccctcgtgtgccaatattcgcattaattgagaaaagttcgccgtgcgaatcatgaagtgagtttttgccacgaacgcacgcaatacactccaaaatgtccaaaaatggcgtttttgaactttttgattccggtcaaaaacatcgcaccctcgtgtgccaatgttgccattaaggacacggatacagatggatgaagtcgttgcgacgatggatatctctgaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgagataccggccgtaggcagggttgggtcggtacttttgttcacggctaggatgggtgaagggttatgtcacatgtttacgacgggttccaaggccatggaatgggatgtcaaaagaagcaccatctattgactcggctgacaaggagattcagccggaaaagactgtgccgtaggagtactgcgacacacggttgctgctgtttccccaacgaaaggacgagcagttcgctcgttt

SEQ ID NO: 64749 - DNA, 7274 bp, Oryza sativa
agggttttttttttttttgtcacaccatggtgaatggggtggcactttgttgcacacgctgacaactcaccaacatatctactagctttttttttgttctaaatgtttaaattttaattttaccaaaatgcctcattttacaaaattgaatttgtccagagccagaggtacgcccatgtgagcagtcatttgtgtcctgctcagccaggctgtgaatggaccgagctggaggccctgccattatctttgacgtggttgaacctcattggttgcagcaattatggagtcatgatgcggtagtgattgagatggagaggaacaggaacgcagcaaaagctgatatctcgataaacgggagcatcacagctctccatgtactacgcattcaagactacagtacgggatggttggagtagttccgcatgggtctttctttttttttcccttcattttgtttaaaccgtctagagcaagtataatagtaagtacaatagtagagtattagccagctataaacatatttaaatgagataaaagatgagagagaagagtagcaggctacagatcggtagccagctgcagtacagactccaaaatgcaatatgtgtatgacatgtgagaccatatattaatagtatagtaagcaactatggtatgaattgtctattagattagctataaatgaattagagctagtagtgggctatactattaaacttgctcttatgtgatgatgcatgatgcacttgcagagttcaactaaagttgaacgagaaagaaaaatgctaatagcaacataaacataaaacagatggagaaaatagacaaaacaaaaattaagtttacattttatatggcgtatgaagcacaggaataaactgcctcaaaaacttagtacatgaatagacaaacaaagaagagtatggagaagatatccttacccctgcattccaaatgacagtataacatttatactacattcgttcctaattaagtactgcacttccataagtactgcacttccactattttaaaggcaaattaccggagcagaaaaataacttaaatgccatttattaaatgagcgatggttggaacggcggggatgattggtactaagatagaaagaaattaaaatgatgagtggttggattaaaaaaaattagaaatatagtactagtacacttgtgagtaaattgtaatagcggtatataaacttgtcagatgtgtgcaatctagtgcataaacttataaaatatttattttggtgcacgaacttatttggtgcatgcgatcaagaccaaaatcacttgacaaggataatcttgctgattttgttgttgatttgaatgctatgtaaacatgtgtctcagaaaaatatcacatagataaagatctgtttagcaatacatataattaggtatattgattgcataaagaaagttcggtcctgttcactttgatgtcatttttaaccttatcaaattttggtaaagttggcaaaaaaaaagtggctacatttagtttgctacaaaattttggtaactatatagaaaatcctgccaaaattttaataagttgccaaaattttcgcatttttgacattaccaaaattgggtaagattaaaaatagcatcaaagtgaacatgcacgaagtgtgagccgtacatggccgttgtatgctcggttgccccgttccaaaatacatgggccttttgggggtgaagtgtgaaccatgcatgggccgctgtgtgctcggcctgctccggcccatcatttactgggccggtttacccgcccacgtcgccacgagcggcgaaccaccaacccaaaatccggcgacttcgcagcagccggggggacgaggagaggagagagaacggggaggcgtctcaaaacgccaccgccgcgcgcgccctaaaaccccagcaaccaacctctcgtctccgccgcttcgccctcctccggccgcccgtgcaggcggtgcagcctcccctcccccgtctcctccctacctcggggggaaacggggccccgcggtggtgagtctctttcgatctctgctgttcaaatcgagcccctctcgagctggtagtatcccccccgcgccgccttcccgtgttccgggcggatttgcttgtgtgggttgtttcttttgctttttaggttcttgattagacttcttgatctgggaactgtgcacttgatgcttcgtggaggtgccgggagccgtatgtggggtagtctctcctcaaatttaggttttggaattcggttatgcccctgatggcaatggcacgcccaagttttaccacgtgacgttccctgtaccaaaattattataggtcgtgctctgttagtgcaaaggtaaagatttggaaaatttttggacatatattttttgacagaaaatgatcttgttgtgtgcaaacgtttgtaaactgttcataaaaacttacatgtcacgggttatgagttcaattgaatgaactatcttgttgatacacacccttccaatcaaagttaggattgatggactgatagacttaatatttcattgcttcttgtatctagatgctatatgcctgccagttggtatttagaaccttgattgctatgtttctgtatttctggcaatgttgatgatagtgcagatttttttagtgaagtcatggtattgcaaatctgcaattatgctgaagaattttctagaagttctggttgctggcaactttacatcaccatcagtgttttctgtgcatatatgggcctgtttattttgatgtcattttcaaccataccatttttttttggcaaagttgccaaaaaatgtctacgtttagtttgttgccaaatttggtcaatacataagaaatcctgctaaaatttattttggcaatattgccatcttgccaaaattttggaattgctaaaacttggtaaggtttattttggctacaaactgaacaggccctatgatttcggacataccgttatctcttgatgggagggtttgcccacatcttataattggtctggctgttgaaataccacttgttttgcagtaccaatgacaagcatcaaagctatccattttctttgccattaggatcatcataatttgttttttttaatctttgtggttgaaaaagaaaaccatgtatctctggcataaacagatcaattatctctgatattatgtccagttgtctgtttgatctgactgtttccatctggtgtccagtaggaattgtgctaaattaaatcaaaggttcaaagtttagcagtaacttttgttcccatagaatttgtcatcaccatatgatgaatttgtcaatgagtgaatattgaacgcatgatttatgtgatgggtcgattagctagaatcagactgcattgtttccaatgcacactgataaaactgtagcagcagttgacatcaagcatgtgatttgttatcttttgaccgtcgagcaggcttataatgtattcatttttagagataaggagagtgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaagatgactaaaagtataaggggcaagaaatgttcatctcgtcagctcagatcacataatcggaggctcttcagccaatgcaatttcaagagagttgctaacaaggaattggcagcaacagagaaatgtgcgtggaaagattcaatctgtccagtttgcttggaatgcccacataatgctgtccttctactttgttcgtctcatgataaaggttgtcgtccatatatatgtgcaaccaattaccaccattcaaactgtcttgatcaactcatagattcgcggagaagctcaaaagattgtgaggacctagactccatagagcttacatgccccctttgccgtggtgaggttaagggatatacattggttgaacctgctcgggaacagttgaaccaaaacaagaggagctgtatgcaagatggttgctcatacatgggtagttatggagagctctgcaagcatgtaagaaagaagcatccttcagtgaagcctcattctgtggaccctgtacatacttacagatggaggcgacttttattccggagttcactgcaagatatgatctgtgcaacgagttcaccaatggtgcggagggttttgtatgttatgttgcagtttgaggagttgatggcatctgtttggcacgaaggtcctcatggagctatgcaaatcaatgaaatgaacttggctgatccatgatctcaacctcactgaaatgtgagaatatcttatgctgttctcgcaatggggtcagtgatttgagccatgctgatccatcatgtgtgacctgacacagaaagatatagcttttttagttttctgttcttgagggaatatttgtcaccatcttcagaagaaacagatcctatcctatgctgccatgaattcaagaaacctggtcaaattgtgggtggaatgtggaatggcgttgaaggcttttgttgatactatctcattgtagtcccccctttgtgtcgtgtgatgaattgatcctgtgcatcccttttgcactgtattgacattacattctattcggaaatgcagagttcacttgctcctgtatgttttattgttcctacctcctcagaaggtacccatatatgtttgttgtttatgtcgcgtgacagattggtgtatactgaagatgaaatttgcttaaaggcctcaccgccaagctacgcgtggcaaataattattcgggacagataattattgtactggtctctccgatcggtttgtcgagatggtttagattagcacgaagaatatgctttctgatctgaaatagttccatcagatggtcgctgtgcagttctacaggcagtcaagcaacacttgcacttcgaatttcgacgcaccagttcacgtaaatggcaaggcctttagagtttagaggaactttggaggaaatgaatcgtttcatacgaaaatcctgtaaaactcctgcgttccaagaggagacctaaacttcgttgatcctcccaacgttcggatcactatcagaatcgtcctgtcgctgtgcagtgtggcgccaatggcaattgcaagcttggagttataagtcaggactaacataacttccagtcaatatgatgaaagttcaggggatcaaaccgtaagacgagtgaaatgacggttcaactaatcaaaggagtgaaactaagctaaagaatatgagctcgagcaaaaacgcaaacactagtcatgcactcagacacgtcatgatctgaagaatatttagcgcaaacgaagttccgcgtgcaaagaagggattttaaaagaaacatacggttcaaaatcaattcagatattcactggtacgcacatgcaacaccaatgatatagccttgtagcattaaggatgatccagctaggttcatatatatcataatatcaatacctgcacaactgcataagcatgtcaacggctgccggccgcatgtcatactctcactggaaccaaatgggacaacttgacaatcatcagtccaggaaactattggtctggacaagtgacaaagtttacagcataaatatcaaaccaaggtttctctccaaggttaacttaaaaatgatagttaaactcagggaggtatatatgctcttcacacaaatcataagtttagatgatgatagagacatcacatttggtaaatcatatctccccctcaaaaccatgtctgaatcatggtagccctataatgtgttgataaagcatacaccaattttttgttatcaagtaaagatagaggatgtaattcaccgtccttctgatttgttgaggtacctctgaactgcttaatgcatatggcttcgcccattacttgaaaggaatttgtaatatctccactaataatatgtactccttttctactcgttgaagtttcaattgtactagaaaatcgctaccaagtcaaatagtggttttgccattaatgcaagtcaaaagctgaatgaagagacataacaaaaaggtacatgcatttagttgtaattaagaaaacaaaaacatactgtattatttaacttaatgccgtgttaacatctggtcttggttgcgaaacacgctactccaatttgctgatgtgattgagaaaccaaaagagaaggtaaacatattttaactgcgattaagaaaaaaacacacggtaacagatgacctttttgcaggtgtgaaccaaacatctgcttctgatacataacatcataattcagttagccgatttgattgaaaaggttaacacacagaaagattgaaaaaaaacactaacaaagatgcattggcgcacatttaaacaaacaacagaaatgttatagtatatagcacaaagttagcacctaagcatcataaaatacattggttcagaataacaaggagaacaccataacttgttctatccctaacttttgactgaggaatgtgcaaccttgtccataaaggtaagtaattaaccacagagattctatctagaaaagaaaaagacactaatttcccccttttaacaatgcactactcaccagatatcacccatggactcagtcagccatctccagggcatcaagcaccatactcagtgtgtccttcatcaggtccatccgacgcaactgctgtctcatctcagtcagcctgaacttccgcagcttttcctccatcacctgtgctttcgatccttcaagcaactcaaacgccttcttgaacactgctccagttggatgttggctggacagctcctcaactgtttcccacaggtaaggatatacatccttccctttctcaaactcactcctccctctcacaatggcattcacagcaccgatcccagtcccattgccatttgccatagtgactggcactgatctctgattcttgcggtgacggttatcccgcccactctccatatcatcatcgctctctctgccatattgctcctcttcgctctcaccagcatcagcattatcatacccacttcctcctccctcaccagcagtactcattgtcccccagaccttcttggcaagctcgtagatattgtggtcatgcggagtggcgaatactt

SEQ ID NO: 64750 - DNA, 755 bp, Oryza sativa
tctcgccggccgccgccgtcggtggccgcttgggccgccgcatcatctaaccggccggccggtttgaagccgagccgggccgaccgggcgcctcgccgctcccccccccttttgtgacactgcccagtggggcccgcctgccagccgccccctctccctcccttagtgccgcttaccaatggggcccgcatgtcggcgccgccccaccccttgctgacgtcagccctgggatgaattattgcgcaataaattcattaaggtttttcttttatagtaataaacacagataatcttctaaaaatcataattaattcatccgagctccgattaagtccattcaagtctcagtaaatcaagaaaaatgtgtagaatccattaaaaatggttttgttctctgtttcaatagtcttatagcatgttttgcttgtgtgctttgtttgtcgcatagatttcggccgtttcgtcaatccgcggttccttgaagacgttgctgtggtctcatcagtgcgagagcaagacaagtcatgcattacaattgatcatattgtacctaatttacaaatgtcccgtatttctattaaatattgcattattttacaatatcatgtgggatgggtcttattactcagctatatgttgtttcccttatgccattgataacttgggtatcgaaatgactagatgttggtttaggaaatgcttagccatgcctagttcaactagtacacaaaaggggaatcacattaatgcataga

SEQ ID NO: 64751 - DNA, 8568 bp, Oryza sativa
catcacacatatacaattctatatgcatataagtttgatgtactgaacaacttatataatccaactagaaatttattaagtgatcctctagattcctggggaagttaacaagctaccttagtgttccatggaatcgtgattgttcccttcaggggcaggcccaggattttaagattgggtattcgaaatggaaagggggtaaaaaaatttttttacaacatgagcacaatatttggtacgtataatcaacaatatggcgacaaaactcgatccggtttctgaacgaacacgctacttagccccgcaaatcgcagcaccacgtctcatctggttatcaaccgtgccgaaacccggttaatctcgccgagaaggctaatccctacatgcgaatcgaagaacacaagcaagaacgagatagattgcaacacaattgcatatgaatgattaagcactcgaatttggggttccacaaaccgatctagcggcgatactattcttgacagattaatctaagcaaaaaccgacttaaaacgatgacgactactgaacaaatataattagggatgtcctagggttgccctagggcgcacacccccttgggctaagtccatgacacaattacaaggcccaaaacccaaatcagattcggactggatgaaatacgtggcttattttgcagattcccggcagctcggtaggaattttaacacgggaccaaaaccatatgaaagtagactccataagctttctaacaagtactcataggcaccgaaaatccttctagatcagcggttaggtccatttgaagttgatgctatcaggaggcccgaatccgaatgcaaaacgtgtaaaactttatctcttggcttctatagaccaaaagtgacatggtgagatggaagtagacttggagaaggtcttagtttggtccccaatcaacttctttgatcatccatgcattcgttacgctcggtctcttttccttcaccaaagcaagtatctctgtaaacaaaaaaaacacacgaaactcattgtgtagcaatgtttgttcaaatatataacaagtaaatccaatatagaacatatgcacatttggttgagtaatacataagatagtcaaggttatatccgagctagttgtgtcctcatcatgaaggacgaaaatcggatttggtgtaaagttaagggacctcaaatgaatttattccacatataaatgcagaaaaaaaagcccaaggcctagcggcatagtctgactcaccagcacacaaatccatcgggcatgcacgtgcgcttgtagggtacttcactagttttctctgtttctcatctccagtctcgtactttcctgttggccatttggcggcgtggcacggcgcatgcgaatttactttctctggatgattcatattcatgaaatgtgaaaacaataagttcaaagaggacctaggtttgtgatttagattaaattgaatcgatcaaatgagcgttcgttttccttgtaggaagataaaaatgaagatgatcaagtgcataaagattagtaacgtcattgagagaaattttctttaagattagacatgaatgaatgatgatgcgtgcaagcaatttctaagctacaaaaaccatcttataaacataatttcttttcattgtttgtcttatgtaagacatgacctacactatctattccatacttgggggtaaactaagatcttttaccctatttgtgtacttgtgtgtatgagtgactctgattcggctcttgaggattgtgtgggcacacccacgacaaaatacctaggtccgccacttggtggtgagatcgagctgcatattgatgagatggatgtcgagacacagtggaagatttatcgatctgcaacaactccaacaagaatcgacgggctgcaaattgttgaacggtgaaaatgctgatgtcattgatgctttcttggctaacaatagtgatgatgtgctgatgaagtgtacaacggtgaggtggtaatggcaatagtaatagcaacatgctttgttcttggctcctgttagctctccagtaatcaaatcacatattgttcattgaacagcttgccacactttttttccattaaatagtctcgacgtctagtagtgtctatcacaataaaccgtctgtcagataaaataaaatctgatctgacaatagagaatgagatgagggtagtgttatcacaatgttgctagaagccgagaaccatgatgtaaaaaaccacatggagtattgtgggagcggaaaaatagacaaaaatgatagaaaaattaagtagacacgtctactctagtttctacatgatatggcaatctcgtacatcaccgccggacccttgtgtattgcttaatttgtacgttcagattgcttggtagcattctgcattggtaagttagctctttgctgcataaattgatatcgagttcttccagagatggtgggaggccctcttctggcaaccttgtgatgcgagtacaatgccaaatctccaacctcttgagtgagggaaggcggtgtaatccggcaggaaaatctatgaattcgctgcacgcaaatttgagctcttgcagggacgagaggtgctgaagcgctttctcttgctcatccaatagtctctcctctccgcgtctgtgtttttcaagctctaggcgtttgagggagccaaggtacttgaagaacgatgtagaaaggattctgggatcatcgatctctagtctttccaatcgagggaataactcatcaacccgccctggaaaccaaagaaaagatggggacaagctggggcatttgtatactttcaaaaacctgagattgcagagggattgcgagacctctattttggtgagctgtgaacattctcgaatctccaactcttcaagtgccgtgcagcattgcaactgcagacattccaaacttgcgttgttctgcactagtaattttttgaggcggacgggcttccctataaaacagggtagcgccgtttgtagggaataatcatgtacgctcgcctggtcatcatttttgccgttatgcacagaagacaagctgaaattgcgagatttgtctgaacaactgcaatgaatcttcttcagagaggagacgagatttaacggaattcgcaggagtccgtcttcagctgagcttatcgaagcgtcacttggatgtcttgacgaggaagcctcaagatctaacaaaagctctagttgacacttttcctcctctcccatcgatagtctcgttaccgccaggcaatttcttaatgtcaattcctgtacgccctgcacatgttgcagtatctgagatagccacttccccgttattccacattctgtaatactgacaagttcaagagatgggcggtcattgcgatttccaattccagctaccatgtcttcacgggtagaagtaggctcttgcggaacatctgaagagaaaagattttgacactcgtctatcttcagcctcttcaaatggatcagttgcctgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgccattctgcacaattttctagacgaagtgtttgcagataggtaagtgaagtggaaagccaagttggggctttagttccattgtaccaagatatccgtagatacttgaggttgtgatggggttcaagaccttcaagctcctcacttgctatgtctagaatatgatctaaactaggggcaccattgctatcactcatttgcaatctctccccttctgtttctgagtgcatagaaggttcggatatcatgttaccatcgcattcattttcagagctcccaccactgtcgtatctattcccgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgcccaattagtaccaatgtcctcaacttactccttgacataactttcatcaaacttttctcaaattcctcattacgagataattttccattttgatacttgcagtatgcagaattagttactatcgacaaatgacgtatactcggtgctaactctctgcactctgatccatctatagttgcacattctgtttgtgaaaccagtcgtgctaaatcatgcataagatcatgcataacaaaaactactgatgaagaccaccaactttcagcttgctgaaagaaacccgagttcaccaactcagttagatattcccatcctttgtgctcgaacttctcactggatttttccacaaatccttgagcaatccatatttttatcagttgtgctttactgaaagagtaacccttggggaaaagagaacaataagagaaagattgctgtagctggttaggtagataatcataactgaacttcagcacatgcatgatgccatcagtatgtttcagggattgccattctttgttctctataatgttgatccaatggtcttcagtaagatttcttcgtagtaggagcccacagtttttgctgccaaggggttgccttttagctccttaattgttttcctcccaagattctctaaattttgattactaccatgttgatcagtactaaatgcatatgctttaaatagtgcccatatatccccatcttccagagcttctaaatttattgatcctgccgttccacacctttgagcgacagtcagtattcgagttgtcacaatgatcatattacctgtcacttttgatgcattcacatgattaggtcttaaaggacccagtagtttgttccaacagtcttctgtagtgacatcccagacatcatccaaaacaatcagaaacttcttagatttcatgtgtttctcaagatcctgctgaagcatgttaaagttgcttattccttggtaacttcggttggagacacaccctaaaatctcccttgtgatcctaaccacatcaaatttatcagatacatggacccatatcttgatctcaaactgatttccgatttccggatcattataaacatgttgggacagagtggttttccctatccctcctatgcctacaattggtaggacggttatgtcattggatttatttcccatgattagatttttgatggattccatctctgcatctctcccatacattttgggctcaagaggataagatgatgttattgcatttggggccaggggtgtactctcacacctctgatttaaacttgcatacccacatagcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaatctttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaactagttgggcagcccgcgcaattgcgcggctagcatcaatttaaaatcatatatttttacatataattttatttaaaattttattcccttgattctaataattttatattttctttaaaagccatgctagtcgctaccccttactcttttgacactttttttttgcttactcgatctacctctgtttctattcatcctctttagaactttataaattaggccttatagtttttagagtttattgtcttggtgggtttcgttttcataatttttagaagtatctttaaacatcaccaatttactactctacggccgtccactaccacctctctttattgtcatttggattttaaaattagaatataattattgtttgtattccttttttactttttataagtctcatcaaatcgttagtggcttcgccactatactcatctacagcccgcctgctgcctgccctccttattgttgtagagattttaaaaatccttaattattacttgtcggttccatatgttttgat

SEQ ID NO: 64752 - DNA, 12487 bp, Oryza sativa
aaatggtatattcaaaggtggttagaaaaacatctttctcccctttcaccataatgcatgacgttgagaaagagtacggatatgagatatcgtacgacaaggcttggagggcaaaacagaaagcattggagatgaggtttggaacttatgaggattcttatcacaattttcacccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgtggcacattaaaatgtgtgttgttgaaaacagaccaaatgtgtgtgttctgcatgaccgacacaccggtttgctatcagcgatacagaagcttcaagaagatgtcacacagtccgttccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctataattgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccattgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcatgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagatgatgagtacggttcggcgtcgacgcatcacggaatgcctgcttactcccctcgcacagcattcattgaggacttcttttccactgatcctccccagggggaagtagcgatggattactggcacgcagcacctcaggtcacacagccgacacaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacattttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcaaaaccctaaatcatatacatataacattacaaaaatattttcctttcttacacactaaaataaattacatattattaaaaaaaataacttattacaaataaatggagaacacgaccctgtcgaactgcgccagttcgacggatatcctgtcgaacaggggcagttcgacagctgcctgtcgaacgggggcagttcgacagccctgcctgtcgaacgggggcagttcgacagccctgcctgtcgaacgggggttgttcgacaggtcctgtcgaacggcagccttccgatctcctcgccagtcgcgctctggccgttcgataggcgccctatcgaactgcacccgttcgacagggacctactttcgcgattttccccggttgaccactacttttgcgattttccataaaaataatattaattctcaaaaaaattcccgggacatcggctagctgcaagggttgggaaaccgagccaaccgaagtgggtcgcctttgcccgtttcgccatggcgtcgtgtgtgttcccaaccgccggtgcatgcatggggcatatgcccttttccagttagctcgcgttactagacacacccatgagtgaacgcacgcacgcacccacgaggtgcgcgtgctgattgcgccgtggactgcacgcctgcacggaggaatctactccgtccaagtccaatctaatccgccgggaggaatcaggaatggagtacgtgatcaatagtggtctgtgctgtgccgtgcgtgcaccggtggtggtggcgcaatgcacatcaggaggagggacacgacgaccgtggttgcggcaaaggtgaattcaccgtcacccgtgtccccgtcaccgtggtgaaaaaatttcaccgtccctgtccccgttcccgtcaaccacgacgggctacaatttcttcagccccgattaccacgtggtgaatttttccccttggtgaacccggttaaacaacaaattcatcaacaaatcatataaatgcaatggaacacaaatcagcagtacaccacattgatatttttccaaaataatatactcaacaaactgctggtcatatcgacggcgacgaacggcggaggaatccatggcggcggatggcgtgctggccggaggcggagggtgccgcgaccatggtctgaggcggcgagcgcgcggcgacgacggccggaggcgccggtcggcgcgatgacgtccggacgcggcgagcgcgcatcgacgacggtcggaggcggcgagtatgtgtcgacgacggccggaggcgccggtcggcgtgacgatggcaggaggcaatgggcggcgcaacgacggccggcggcggcacgcgtgcatcgacggctgggggtaggatcgcactcgcgcgaggggagacggcggccagcggcgctatgcatggtgccgtggtggctggggagaaatttggagatggggagggttgattagggttagaagatatatacatggttactaggcttcatttttatgggccaaaataactataaagtctagaactggactctagctacattacatgcgggtcaccgcggggacggggatggtgaatggtgcaccgtccccacccccaccatccccgatggtgatgagttttggaccattagattcaccatgggtggtagatatcaaccatccccatcctctaatatgtgaattcatcgtggggaatcggtgatcgggtccccattgccgcgattctttgggggcggtgcgagacatgccagcccagtcgaaacgatgagaggctctcgggctctcggcacgcgacggcccagctaatagtcgtctggtcggtccggcgcgggggacacgagcacggggccgggagcctgctcttctgctcaaccgcgcgcgtgccgagtcgcgcgtggcctgccttggtgagcggcccacgcggacaatgggaggcgtcagcgtggcccgtgcacctgccgtgtgcgtgtgtgagtgtcgcggatcgccaaggagacgtgagaggcggctttgatttgaggcccacgagagggcaaatgtcttggccggactaatgagatatacaccgctacacgcgactacgccgttggttcgtagccgcacagctggttcgggtagttcgctgctcccagcctccagccagccagcgtgtcatcggccgcatcgggtccagacaaacgagcgagccatcaatctccatcgagagattcctcgcacaagtcatgcatgacatcagctaatctgtctccctttccacccccctctactcgtgtgtcagtgccagatcgccggctggcagtacattcagtaagacgcgacttgatcgcacgattggccctttccttccaaacaagagagtgtacgaagcggttttccaacacaagaagagatttcacgcatcatccggtgaagctccggttactccccagttcacgacttcaagatttccaaaagtttggtactatatctaattttgaggaaacatgatgcatgtctcgtaaagaattcatatggatcggtgcctcttcatattttggcgcacatttatcactttcaaaacttgaataattaaagattaactgatgatcaaaacttaaccctattgattgcatgtattctaaaacatcgcttatttatggtaggcgaagtataaaaacgtaacccatctaagatggccgacagatcgacggacctgctgagcaaacttaagctgagttcataagcgaggattaggaatcctccttcccaacatgtaaaatagagcagtagattaacgtatgattaatgaagtattagctaaaaaacttcaaaatggattaatatgattttttttaaaaaaacaacttttctatagattttttttcaaaatacgcaccgcttaacagcttaaaaatcatgtacacataaaacgagggatagaagttgggaaagtgtaaaaaaacacaaccttaggttgagttcgttccttatgctcccaactccactctgttgattcccgtgcgcatgctttcctaactaatactgaattaattatgggctaatatgccatttcgtttttcttgcgtgggggattagttcttagcccacaataaagaaaccttaacctatctatgggaggtcgaccatctttccttgtggtccaccacctaccccaagtagccggcttgccatcgttgttgatgcaccagatctgccacctctctttttccccgagcttgctccatctccccttgtgtcatctagtagcacgtctgtcactgtctcctcctctgtgcacctcctccttaacttgcttcgccattcgctgttgagctccctcaaatgcctcccctcggtggcgttaagcaacatggccaccaatgtaaactcccgatgtagtcatgctcactctaacacttgctagtgagctctctcagccacctccaccttgtgccgaggctttctcatacttggccaagcttcgtcaaccacccacaccacacaccacctcacatgacatagccagtggtatgggcaatggatggggtagatggataggggagatcataagagtgggtaaagaagaagggaaagagaggatggcatgtgggacccattggagaagcagtaggagtcagaaggaaatatggatatcgactttttctagccatatgaatatttggagtgccaaaaatagtcagaatgctcttagacaagaaatgatgaaatatatgcattgggggtactatgacgatgttcaaaacaataaagtactacatcagtttcgaaatgtagctttttctagcacaatagtatgtcgaaaaagaagttatttctccactcacctttcatataaaccattcacaaccattcttcatttaatttatctatttactttttcttctcaatcaatcccaaatttccccaatcatttctacctattttttttaacatatatgtccgatttaagaaaattcttatattttgggacggatttattaaaaaagaacggggtagtattttgaaaggtttatgacctagaaactctgccaaacaaacatattgttttcactgcatagaattttacaactagaatttagtattcccatgcatcggaatcactactacaaaaatcgtttttctgtacgaggaggtcggtaggttccatgcgggccgcttgtggtggcgcctgcaaaaaccaccccccgggggcgggttgatttgccgcatgcgaagatccattatcgcatgcggctgcttaagacagccgcatgcgataataggtctattttcgcatgcggccgtcttaaggggccgcatgtattagggcatgcggctccttatatggaccgcatgcgaagatctattttcgcatgcggccgtcttaagtgaccgcatgcgaagatcgatcttcgcatgcggctgcgacggccgcatgcgcaaatggtgatatttgcagaccatttcgcgcatgcgggccggccaaccgcatgtgaagatcgattccgcccgtatgcaaaaacgctttctgtagtagtgaatgctgatcagtactgaagaagaagttgagaagttccaacgcccaactgtcttgtgaagttgaataatttctgctgacattgaaatggatacgctggacggctggaggtgttcaggttcaccaacctcactctaagattcttaggtacaatagcaagctataagccagctataaacatattttaaaaaaataaaggaagagagaaaagagcagcgggctacagatctatagccagctgtagcacggactccaagacgtaatgtgtgtatgacaggtgggaccaggtattaatagtatagtaagcaactattgtatgaattagcaattacatcggctatagattatttgaagctagcagtgtgctatactattaaacttgctctaaaccaacggtagaagagccagtggcaaagcacgggacaaccggacaattaagttgttggttatcgatgcctcgcataaataatcacaatacacgtcatcacttacgtttcacgcacgaccaacttgactgtagcaagctactccttgctaggacaagcggacacatcagctcgattggatcgggagggtgactcagcaccagtttaatttgcctctggacaagccaagcacgccgtctctgatcgctatctgctaatttagtcactacagcaagcaagctagtgactgacgaaacgcagaaaaccttatcaaaattatctcccaaagctaatgtacatgcagaggtgaactgagctatcttgagcaagagatccccgccgtgcagtcgtgatctatcaacatgtaaatatttggaactgaataaaataagattcggagaggagaaatggagggagaaatgcaggagaggtagatagaagttcagtttaatttggtgacgatcatcgcgtcgccatctcgacatcgtacaagctcaatcagtgatttaagatcgtcgaaatactcgaatgcatcaaccaaccaaccaacaacaataccagctggttagtagtacttcactagtactagcattgataaatatataattaaggttcatatcagatgattaagcagcgtagtgtttcccttaaaaatgattactgaagtgagttctttaacatcgtcttcagaaggtgcttacagagaaccaacaaccttgactgcaggagacaacaccatcgccggccgtcgtagtcaggattgccccacgacgaggtgtccggggacctcaatcagtcgatccatcaatctccatgataaggcaataggataagcagccaatagacgtttccagaaaggagcaaatggcacactcagccaatgttttaagtactgaaactctcaaagcttacataaatgaaaaggcagttttttttttggtgaaaagaggataaatgaaaaggcagtactatctgacgatgaatcgatgataactccctgaactgaaaggttaactcagtgattaatttagttgtgttttcctatcagacatgaaaagatggcgacctactatgctataaagaacatcgttactacatgatacctacatgatacagcacatctctcttgcaaaggtaaacaagttgtcttttcgtcatgaacagcaatgggttgttcattcgactgatcggacttcgttgggagcagtttcttgacctgcgacacagttagccagttttgtagctagctggagcagaagttcagaacagttcattttgtttccttttttccccccttcttcttcatttgcgattaagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctccagtggcatcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggcggccgccgccgcgcccgcgccggagaatgccttcgccgccgccccgaagatgccgccgttcgactacacgccgccgccgtacgacgggccgcgggcggaggagatctcccggaagcgggccgagttcctcagcccctccctcttccacttctacgaccgccctgtacgttacgccacgatcttttcaccgctcccatttctttggaacgatttggggggaaaacactgtagtattacagatcggattcttgattgtttataccttaaattagaaagaaatactgcaattttgtctctataacaagacgcatttttccattttacatccaaatgctgccacaaatgcatcggcgttcggcgatgttcagagatgatcaggctcgtagcttaaacaaatctccttaatttgtttgcaaaggctgttgttttctctgtttttttatgatctcttgctggtggcttattagtgtatcttgttacaagaaaaggcagcccttttggaagtgcaacgtctttttctgtcgctattggataggtttggttggaatgccattttacctgttcttacttcttactctgagcatttcttacttcttaccgtttggagtgggcttaccgccacccgcggtttggcagttatcgcgattatcacaaggtatcccgtggttttaaaaactgaaaagattaccgtatactgtttggtaaacctcacaagatgctctgcagaatctccaagatagtcgtactactaattgtagtatggggaattgtgaatctagtacaaaaatgtagttgtcttttctctttcccataacatagatgttctgttctgcttagtaaaaacgtcagcctctatgttcttgtctgcaaatatgcatagttaagaagaaataatttttttttatcttgtgaatagtagtaggtcagtttgctcaactacgtcttgtgctagtagtctgctagatctcaaacatatgtggctgcgccaataacatatgcatatgtctctctctaaaatagcttcataactgacacctttccattttaaaattgcacatgcattgccaagtactctataaacaatgttaaagattggattcctgaaggaggatatagcaccaaccaaactgtgcacctaacattgtgtcttgctgactcctctcatcactggagatcatgcacattgctaaactcctcgtgaaccatctgaaaaatactttttgacagggacgtttatctggttgataaaattggtaggaagaaaaagaaaacaacaatagctctttgagatcaccttgaattctttagaagagggttattaaaaattttctaaaaagggaaaattctcgttctaaaacatatcaatatgtgataaagatatggtttttggagatttcaagttccaaaaactgaccatttagtatgtaacaaacatttcagttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggtagcttgagaaaactggactttctctatccgaatattgctaattgtttagaaatacatgaagattgttttgcctgttga

SEQ ID NO: 64753 - DNA, 6364 bp, Oryza sativa
tcattgttctttaaatcatatgtacgtatggagtactttttttggttaatagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaagggcaaaatgactatcttgtccttcttcttaattcatttctcctccccttcctcagtcccttttacatctttccttttccttgccagtgagctgcttaggctccggcgagctccccgccttgtgctcctccctccctcactcgactccctacatccccagcccctcctctattcctactgccaacgtcatcaaggatcagcgggcatggctgtccggcaatgtgatgccattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtaatgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttagattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatttggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagaccccacgttcgctgtgggggctagaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttaagtagtacgatcacggtggttggctggatttctagaaagtaaaaaaataaacctcaatgatattaaagagggaagacaacaagggtaaaaacaataaacaaaaccacaaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgt

SEQ ID NO: 64754 - DNA, 1019 bp, Oryza sativa
agtgacttatttaagcaatttgcaagatgagtgactaaactataccaacctcgcaagttgagataccaccgatgcattttactctaacaaaaaatacggtgaatttactctttataatcgaaaataccttaaatggcacagctactatgtggcattgtgtatttttgctcgaggtagcattgtattattgacatgtagctttgggaggcccgcgcgacgagctattagctcagtggtagagcgcgcccctgataattgcgtcgttgtgcctgggctgtgagggctctcaactatatggatagttcaatgtgctcatcagcgcctgacccgaagatgtggatcatctaagacacattagcatggcatacaaccccactatttcatttatttatatgtttatctgaatagtttattagcaaataaaaattatttgtaagtaaacttttataaactatgataaaaaaccaaaaagtcaaattcaaaatcaagttctaaatattaaattttggttttggcttataatcataagcataagcgaaacaatgagtcatatagtcagaaaaataacatggtcaaaaatcttatgcttgaaaattttatgtaatgcatgcaacgtctatttattttgtgtgcaaatgaaaaattaatataaggtacattatgaatatatattatcttctgatattccgttttcagttggtggacaaacctttgcaggggaaacttatccagaaaaatgtagggtatgggccgtatatggtcttaaagaaaaataccatgccgtatctcttatttttttgttctttgctgtttctatcctcttctctttggttcttcggtatgcttctatctagctataaatcctgtggcttgaaacattcatgtaccttccataattgtcctagcttggaccatatcacctttggtctgcgtgcacattaggcatagcacctctctagttggctcattcctataagagatggttatcctataagttaacttatttttttataagatta

SEQ ID NO: 64755 - DNA, 12393 bp, Oryza sativa
  unsure (1)..(12393): unsure at all n locations
cctccgcgacaccgtcaagtccccgcctactcctcccccaccactgatcttgcttgaaccaccatccgcaatgagcttactcatgtcgcgtaggataaggagagagaagttttggaaaagataatttttaggtggattttagttcaaactataatctaaacataattatagggcgttagcgtagatgttatctttcttaaaaatattgtgttctaaatgtctaaatattaatcttgccttcgcttttcaattctttgttttaacttacatttatgtgtgtttattttcatatgttttattgatgtgtgttatttcctctattcaaaacatgcccttaagtgattttgggaggaatcctaattggcgcgtacgcgccggcccacacgatccaataggcagattttttccatatatgtgtaaactttcaacctatatttgaaaactttcaactccgacttgaaaactttcaaattcgaatgaaaaatttcaactcatatttgaaaactttcaacttagatttaaaaattttcaactcgagattcaaaaactttcaactcgagatttgaaaactttcaagtacaaatttgaaaatttttaagttaagatttgaaaaaaatatgaaaacttttgactcagatttaaaaactttcgacttcgattcgaaaactttcgactcgagatttgaaaactttcaactcaaattcgaaaactttcaactcaagatttaaatactttcaaatcagatttaaaaatttttaagttaagatttaaaaactttcaactcaaaacattttttaaaaaataagtgtgctaaagattaaggaaatactgagaaaaaaggaaaaaaatgctaaaaaacaaaagaaaaaatcgtgaataaaagagaaaaaaaaggccgataggctttgtgagccgggggacagctggcgcgcgcacgccagttagtaacaccctgattttggttatgtgcttagagaagtagccaaaatccattatatttttggagggagagtaacttgctatgatcaattattttgaataggctctatatattataatgtgcaccatatccattacttaaaaaacacaaacacgaatgtggaattaaaggtcactagtgtctagtagagcaatatgagtcatcacacagggcttcgtacagcccgtacttgctcccatgaagaagatattgcaatctttgcatgtggtgtttatcaagtgggttcagcacaaaaacttcatcagaggaaagagctagcagaagtagagcactagagcgcatctcctatgtgacgcttgtcagctgacgattaccagaggcggagctgtgcacaaacacgggcatcattgggagcaccactggtagtagttgctgcttgtaccgctccaattctccatgttggataaatcggattataatgtcattttctgctgaaaagggtgagataaaataaaaacagcacgcgccattgacattgaggcatgctagaaactgtggcgtgttaggttttcaatgcagattctactggccagcccgcataacgcagggtggaaatgggtttccttttctcggtcgcgcaggtcgcaccttcagaaaacgaaagctcggaggctttcccggattcaggttgatacaccaccttatcaggccctgctggaaactccttgtgagtgagtgttactggttcttatccgtcttaatctcactgtcatgattctggccaaactgtttgaactttaaacgctaaaggaagctaattctgctattgctgaacattgctctttccaaattagttatggtttttatgagctattttagaaaagagcccaggttttgcaccactgaatactgatagaaagctcttgtgattagcatttaagaacacaaagagaatatatgagttccgagtatatattgtgtgataaagtttggcactaaattgagtgtataatttgtgggactgagtagtaataagtgtgacatgtcatagttaataatgaatcaagcactagataataaaatatgatgtgcataaggtttggcaaggctgactctagctatcaaaccaacataccctatctttctcagacaagcaatattaattaatattggtcatgtttagaaagtttctggtagctatagtttcttttaaaatatccagctcctaaaaattgttcagatctcattcaatttctagtttcttactagaatttgaagcttcccaagcaggagcaaaagcagaggagctactgccgcgacgctttttcccttggatgatttccaaccgtcgtatcaagaaagaacagctgcccatattatgtcacaacagataccgcaagtagggattatccgtttctctgacgatatcatctgccagtgcgcgctccttgatacggttcctggacaagaaggattcccaatgtggtcagtgctgctagctgcctagctgcttggtggagtgtcgagtgacaagtgtgcgcgcgtggagtcgtgtcgcgtccacccggccatccccatgcatgcacacatggctctgccccccaacccagtggtgccgcaacctcgtcgcgcccgctggattatcagctccgccgccgctcgaatccacacatttccacccggcgtctgtggacgggccgcgacactccatcattccgccgtggaaaagggcacgccggcggctaaataaaagatccctccttctcccttcgcccggtgtggccgctggggtcaaccgaacaacggagtgcgtgcgtgtcgtcgtgcctgcgtccgtgcgttcctgtcactcgacccgtcgatttgcctgcgccgttcggcacgacgacgggcgatgcattcgcgggggggccatctgcccatctcggcgatctcgcgaatccggctcgcgagcgtgacaggcggacagcatctgtgccgcgcactgctgcacgatggctaattttaggagacggcataaaggcagcagcagcgtatctctggtgtttcgttttcccggcggagcaaatcgggtgctgtgtactagcggtagaggaggggccagggggaccccgggaatttcttccctcatcagcagcacatctctcttttttaaggttcagtcggtcagacttcggagcggcagcctttgtgatgagagcatctgcagacgaatcgaaactttccgagatttcggttgttgttggctcacatcgcccacgctaaaagtcatcacaccactgtttttgaacacaagacatggctgtttaattatagtgatttaaatcggtccatcaaatgtacagcgtgtgtagtgtatagttgtctacactacacggtatccacaccaagaaaaatgggaaaaaaagacttactagttactaacagatacagatgcaattatgcacgtatccgtgatccaggccaagtccactgtccaccggctcgcgcacacgtacaccacacagactgtatgggttctcgtggatagataggggcgcacacatgctttttgccgcagttcgtggaaaaagaaaatccgagtgccaccgtgattgatccagccaccgtcttggcgtctttatcgacggcgagaaagaccacagctgcatgcaacgtacaacacagctagtgccgttgggcagtgattctgcctgtctgtgcatgcaccgcatccgccgctcgatcgaggaggctctggccgcgggtatagatggccataaggcccgcccggcacggcccggcccaggcacggataggcacggcccgagagcgatcgggccggcacggcccgattggaatttcgtgccgtgccgtgtctgcccatgggccgcacgtcaggcccaggcacggcccagtagcaatcgggtcgtgccgggccgacacgaaggcacgatcagcccattgggcctgggctagcccaggcacggcttaggaccagtggatcagtggaccagtaattcagtggattgacaaattcaatggatcaatggattgaacatgcaaaatttaaatttaaacatgccttagttaacaaattcaaatttcacaacttacttgacaaattcaaatttgaacatgccttagttaacaaatttaaattacacaacttagttgacaaatataaatttgaacatgccttggttaacaaattcaaataacacaacttacacaacttagttgacaaattcaaatttgaacatgccttagttgaattcacagttctagattcacatatcacctttacaaaaattcacagatcacagatcaaagattcacagatcacattgacaaaaattcatagatcacttgactaagatcacatatcacatggacaattcacagaagagtttcaaaaatcacagactcacagttgtagattcaaaaatttcaccaagtcaaattacccaaaatcacaaattttcacccaaactttcacccaaaaaacttgacttagatcacagatgacatggacaattcacagaaatcacagttctaagattcaaaagtttcactaagtcaaaaattacccaaaatcataaactttcacccaaaaacttgacacgagtatttcaatgaataaagtagctgtgtagtgcaatggctgcctcgttaaaaacctttctaggtaaaaactcacacctcgtgagaaaaccctagaaaggaaaaaagagtgcagcccacagcattaatcaaatattcataataaagtccaagtccaatacaatcatccagtcccaatggcagtggttacttcatcaagaaacaaattgtcaaaagagtttataagctctaaattctccatggtatgttgcatctttgcatctgcttgctcccaatctttgattagtgccaaagcttgcaccatgtcaggagctagacgccgtcgtcgctcctcgatgatcctgccagttaagctaaaagcagattccgatgatatagtagaaacaggaacagtcaaaacatccctagctaatatggaaagaataggataggtgtggttgtgctcatgccaccagttaaggatattgaagtcatcatcgtattggttgacagtgtcactgtcaagataggcaaacaactcagatgcactcagagtagttacggatctgatcgaatagagaaaataaactaaaaaaaaagcttgtacctgcgcatccggagcaccggagttgccgttgatgatagagatccacagatctacgagaagacaagaggagagactagatttggggggtggatgagtggatctgagtatctgacgaagagaaacgatgagggttgcaaaaaaaagtacagaatggagaggaaatcgacaatgcgaccgtcgatccggtgaccggagaggcggagacgaagagctcacggtcacagatcagccaaagagatgaaagaaaaggatagagaagagacgaccctcaagcccccagcgggagcccgctgaccctcggtgctagatccggcgaggcatccatcggagacgccgacgaagagggatggaggcgtggagggctgaggggtcggagcctggaggtggaggcggagcgggcgagcggcggatcggtcgagactccagactgatgtggctagggttagggtttgtcggtttgatgcggtttggggtatttatacccacccggcataacaggcctcggtcgggccgtgcctgccgttggaccgtgccgggccgtgccggcccaccgtgccgacctctttcgtgccgggccgtgccggcccaccgtgccgagggagcggcccaagcacggcccggttgttgggccgggccggcacgggcacgaccccagtcgggccgtgccgtgcctgggccgggccaatttgtcgtgccttgggccgggccgtcgggccccgggccttatggccatctatagccgcgggtcgatcgggggccgacgatggcgacgggccgcacgcgcgcgacggccgatgatgcggacgaggcgtgcgtgtcacgaccagatccagacggcgtagtaggcgagcgccgcgtgcttgagctggcgcagcatcagcaggaagcagtgcgtctgcgcgaatcccagcgcgaacccgagcgccgcgcccaccgcgtcccccgccgaccggacaccctcccccggcacggcccagaacagcgccccccacgaccacccgcacccgcccgacgccgcgcacgccacgaagaacgtcgccgccgccgcngngtacgcgccgcctcccccgtgcatctccatggccaccgggatcaccacctggtggcggtacagcaacgtgcatataacgccttagtcgaacacgtcgtaatataaggacacgtacacagatactccagtagctagttcacctggcagaacacgatgagcacgccgccgatgacgcacatgacctcgcggccgtacgtcctcgcggcgagcgccgacccgaggacgccgccggcgttcgccagcaccagcacggcgtgtccggccagcgccgccttgccgcagcctgtcgcctgggacagcatgggcaggaaaagcgtggtgacgttggccccggtcaggcgcaggaacagctgcagcgtcgccaccaccacggcgtacgttacgcaccactcgtacttcctcgccaccatgatccaccagaacgagcggccgaggccgtcccgccgactcggccgcttttccccggagacgtcatgcccctgcttcgcatgggcctccccacgtccacaaccgccgctgctgcaaacgcaccccagcaccaggacggcgtaaatccggtcgctgtcgaggaaatccggcgtcggagaatgctgccagtagtcgccgaggtcgcagttcgtgccgttgacgacgagctgttcaccgcaactagccctgtgaatcgcactggagttgtagagatcgtatacggaagagcagacagtatccaagaacggcgacgtgctacgccaggagaagtggagtgccatggcacggcaaatcaatttactctgccaaattgtacacttttttcagtttgtcttcatgaacataaatcaaatcgatacgttcattgatcatttcaacagagaaaaggaaacaggtagatatgatatgcaatcatgcatgcagtaatccaaaattcgactccaaagtcttccattaacaccgagagattcgcgttcattcataatgtgtgagagcaacaaacctggacaacatcaaacatgtgcagcatccagcacgcgacgagaattccatagttgatggcaataattgggatcgccccaccaataatgggaacggcgcggccaatcagcacgagaggcgcacgccccatcgcgtgggtgacgtggcagctcgtgcgcgcgatgcccgctgacctggacgccacgtgtgcgagcaccctgtacaagcgatgcatctctctcaccatgttggccttccaacgtttgagtatgttgttgcagactcctttgcagaagaaatcacgaacgcatcttttttttttttaacggaaaacagcactagattgccttttcattgaatagagcaggagaaaatacaaatccttaggggtaagaggaaaacggagaaccactatagctgtacactatacagagtgcgggattaactcacgcaaccgcttagctcctgctaaagcccaaaggctcgcctcctctttgattttcattagtaggaagttcgttgccacctctttgtgatcaaaaatccgccgattcctctctttccaaatttcctagacgactaacaacatgagcgatcgaagtccttttttcaggacactaggcgtgtttacaatgttctcccgccactgtttgactgactaggcttcctcccattccgttgggtccatctgctgatagcccacccatgcagagatgaggtgccagatcctcttggtgtatctacaagtggcaacgaggtgcaatgccgtctcagtctcgcggcggcaaagagggcaacaaccattgttctgccatcccctggtcgcaagccggtctgaagtccagactctattctgaatgatgagccaagcatgaaatttgcatttccccggcgcccaggctttccaaatcaaggaattgaagtttgtgctcggcaccccgcagcactgtgcatggtaagccgaggaggccgtgtagtgcccgttgtttgtgaacttccaagtaatctgatccggttctccaacgtctaagtgcacatttcggaccgcttcccacagtgcgactagctgttcgacgagatcgactgtgatagatgattgtgaatcaagcttcaaatcttgcacccaggcgtcgtcctcctttccttgccgaagggattttcctctgttttttgagatcgtatagacaagcggcatgaggtctttgggtcttcgcccaccaatccacgcggactcccaaaatcgcaccgtgtttccgtcccctattgttatgtttgttgaggcggcgaagaggttcctatctatttcatcacatggcgtctccagccccacccaaggtttggtctggtccttccattcatgccacagccatctcaacctcaaggccctcgtgaatttgtccagatttaggacccccaatcctccttggctggtcggcatgcacgtctttgtcaaattgaccttgcatttccctccggtaatatcacccgtgcctgcccagaggaagcggcgccgctgcttgtctagctgctcgagggattcctatgtgattttcagagcggtcagaaggtagattagttgcgccgttagcacagattttacgagcatagttcttccagccgctgccatgttttttactctccagcttgctacccttccgaaaattttgtcaaagacaggttgcaagtccaccttccgcagtcttcccagagctagggggaggcccaagtacttgatggggaaatttaccctcaccacagggacgccctcaagaacctcattcaactcgatgccgccgcatctgatggccgccatttgggatttctgaaaattggtgacgagcccagttgcagcgccgaagcgctacaggatgtccgtgaaggccgagaaggcaatttgcaaggtatcacaagtcatttgtgcaatggatatagtttgtgccgacgaatatatccaaaacgcaagtgctaaaatgaatccactgcttttttatccaaaaagatagcctacttttaacaagttatcgtttccaatagattcagtgttaagatactggtgattggacagtgataaggtgcttgtgtggttggttggctcaatttgctctggtgagatctgtatcaaatgcccctacctaatcaaacaagatgtacttggtagcattaagaaaaggatgaccacatctatctcagtagtatgtggcatctagcaagaaagttcacttgtctcattcgttaaagaaagttcactaatctcgccatgacaccataccttacctgacatgatctgagctgaagtgctgtggccatcaataatggcccaggaaaacagttactattaaactcagaattcacttaacaccagatctcttctatctaaattcttaatcctgacaattcgatcgtttactgagtattcctctgttttcatttcctgacaagatattgttcagtcttcagtgaaaaaaagcacacaagatagagctatatttgcggggaagctctgagaaactctgaaccgagtactaggccccgcttccatcaccaaactccacaatctagcctactcagaaaaattcaggcgcacgaattctatcgattcagaaaatacatactctgcttctgtatctacctactccaacaacgtttgcggagtaacttcggccaacaccaccaccagggggcatcaagcacatccagttcgctcacttaattgcagacagaaacacatgaacaacagaacaagtaactgtcactcaccgtagcggctcactccgtcggttcggccctgctccacgaacacgccggcgagacgtcggcggcggcgagcttgctcttctctaactgcagctcgcctgctgatcactcgagcagtccatcgctgtggtttgctgcatataaaaactgtacgaaacaccatcgccgtcaggacgtagactggattttctaatccacagtgcacatttcacgtgccaaattgatcacatggaggaggttgctcgatgaagccacctgctactcctacgtcccaaaatatatagacattttcaatattgacacggatattaaaaattagatgagaataattgaaaaatggttgtgattggttgggataaggtaggtggagaaatagtttcattttgagataatgtactgtgctagaaatagttagctactccatccgtctcaaaatataacaatttcagcccttatgatttgttccaaaatataacaatttctccaccaaatttctcttaccaaccaatgacaactctccaccattcatttttcctacataacttcactactcattcaatcacaatcctacactactcacttttacctattttcttaataaccgtatccaaactctaaaacttgttatattctggatggatggagtatattttgaagcggatgtagtacggactgttcaatcgacagatactccaaatttcgttgtggcccagtgctcgcaagatacaaaactgcgaaaagccccggtgatgcgacgcgatgtactccttcatgtacatgacgcgatcgaccgatcggcatgtgtgaggttgggtagcccatgcctccatttgataacgatcgaggccccgcaagcgttgaatgttcttccagctgctgtagaacacacgtgtccgtcagacagtggtgaacgcatccatcatacagtatcatacacactgcatttgagcagtttttgttatcagagtaggggagttccttttcttccccatatttaacttcgagagattttttcctgtctctctcgatcaatataagttcagtgcagaatattagttggacaggctagtgaccttgtaacaagtcaaacaggtgtagcacatgacatcatcttcatagtacattcatactctacatgactgaagttgtgtgtcactacggtaggtatcagaaactcaggatgaataacgtggcaagacttacaaattactagcaaaataattttgagcatgaagaaaatgaactatgtatcgatcggtggctaggtgatgcgctgtgcacccacttcggtggggttaaagttaaaatccttaaccatcgcactcatgttcatgtccaccaattttagcaaagatgcatgccaaatattcaatttttgtcttaaggtccaactgtcaaactcaatatctttgaacttgacgtttctcttacttagattttaaactacgaatcgtttattttaattttgattcatatttcaggtgtgcatttttacttccttttgcttgtctttgaactcagaaaattttggacatcccttcttttgtgatttgttatttcacttgcgacggatttttgagcttatatctttcacttttttatccatagaatcttccatcatgatttgtgttcttgtatatatccattacactcagttacataacacttatacttagttatagtgcatttcactacaattagaatttttttaacaattttttctctagttttacgtatttgacatgcttattttttttatttaatttaaaacaggctatatctattggttaaaaattatgtaagattcaaaactttaataggtagtctttttttttctagttttgttttctgaaagctctggtgggctgaggcctccactctggagccttgcccagtacagatagtacatgttaaaggaaaaagtccactttgactcccttaaaaatataccgaatctaatttgtacccttcaaccagaaaaccggatagaacgactctctgaactatagaaaccagtgcaatttgactccccaacggttttagaggacggttttgctaacgtggcggtgttgacctggtcttagtcccatgtggtgcttatgttgtattagaattaaaaaatatttgtgagacccgtctctcattcacacacacataattcatggggcccacatgacatcctctctctccaacttttctttatgtcgacggtccagtggcagcccgagccctgcgccgacgccggcgccggcgatggaggatgcgagcaaacactgggcgccgcgcggcgcggtgctgacggcgttcgtcgtcgggatcaacttgctcatggtcctcctcgtgttcttctacttctggcggttcttctccggtaagcgtgggccaccgtcgtcgtcgtccatggccggcggccccgatgacgaggaggcgtcgtcgtcggacatgtcgccagcggcctctccgagggcgtcgtggcggcggctgcggaagtggccggcggggctgcaggaa

SEQ ID NO: 64756 - DNA, 9238 bp, Oryza sativa
agtgccagccataataacaggaaatgcttgtaatattccactcatatgatataataaaaagatgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaagtcttacagaagggctaagggtctttgttttgtctgtggtgaaagatgggggagagaccataaatgtgctacttctgtccagctccatgttgtccaagaattattggaagcaatgcgctctgagtgtaattctgatgacatcctgacagctaaagaccctattgaatcagtagaggcaattgatggaggattgatggctatatctcagcaagctttgtgggggtacagaatcatccaaatctattagattaaggggatgggttcaaggaacacagattcttatgttgattgactcaggcagtacacactccttcatagatgagagcattggcacccagcttgtgggcctcactcctttaagtagatctgtaactgtgaaaatagcacatggtggtactatgaagtgcacacagcaaattctggggtgtcgttggtggactcaaggtcattatttcaagagcgacttcaagctgttgaatttgggctcttatgatgctattcttggcatggactggctagaacaatttagtcctatgcaggtggattgggttaacaaatggctagaggttgtgattgatgggcagcctgtcagactgtatggtgttactcatcaaaccgacagatgctcctctattactcctgatcaatgtttgggaatggctaaggttgggtcactgctatttatggtacagttgatgtctatatctcattctgaaaagactgaaatccctgatgacattcagtcaatcctagacccaagggattacccccaaagagaatatgtgatcatcacattcctttacttcctgggtccaagcctgttaaccttcgcccttatagattcaatccagccctcaaggatgaaattgaggcacaaatttcagagatgttgcaaagtggtgttatccaaccgagtcagagtgcctttgcatctccagcccttctagtcaggaagaaggatggcacttggaggctagtaattgattacagacaactgaatgccatcactgtcaagtgttcctaccccatgcctgtgattgatgaattgctagatgaattacctggggctaaatggttttcaaaacttgaccttagggctggttatcatcaaataaggatgaaggaaggagatgaatataaaacaggctggttatcatcagataaggatgaaggaaggagatgaatataaaacagcctttcacactcatactggtcattatgaatacaaggtcatgtcctttggactgacaggagctccagcaacctttcagggtgccatgaatgagacatttaaatcagtcctgaggaggtttgctctggtattttttgatgacattcttatttatagccctgatttgccctcacaccttgaccacctcaagcaagtgttaaccctgctgcagcaacatcattggcaagtaaagttatccaagtgttcttttgcacaacagcaacttacctacttaggtcatgtcataagtgcagagggggtatctactgatccaagcaagattcaagagattgttaattgggaaacaccaacaaccaaaaagaaactcaggggattcttgggtttggctggctattacagaaagtttgtgaaaggatttggattaatcagtaaaccaatcactcagttactacgaaaaggggtgccatataaatggactttggagactgaaactgccttccaacaattgaaacaagctctggtttctgccccagtgctggcattacctgattttagtttgccttttactgtcgaaattgatgcttcagattcagggattggggctgtcctgtctcagaacaaacacccaatagcctacattagcaaggcacttggtccccgaaatcgagggctatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaaacaataaagatctaagcagcggaaaaataagataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaaatgcacaggataacaaaggatggcatagtagggtttcatttgcaaaagcagcatttagcaaacatttcagaatttaataaaacagttaagtattaaacaatattaatccaacgctacacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgggactaatcacgacagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaataccccttgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcattaaataatagtgagtcataagttatcccaatagtgtgctaatgtttctaatcagggctaagcaattatatctaatatctagttgaaccaataaataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggatctaagatgaattagttatgaatttttaaagattaaatcggattaaaacacttaaactgattttaattgaattatgacgcaataatgaattattttttgaaaaggaaaagaggatttattgcgtcagcgggctagggtttcggtggaccgagcgcacggcggcggttcacgcgaacggacggccgagatcgacttgatccaaaacagacggccgagatcgatcggtccacgaccggctcacgggagagggcgacgatgacgtcggcgatgacgtcaccaccggcggcggcggctcggcggctcggacggcgcacgctcgccggcgaacggcggcgcttcggcacgaacggaggacaccaacgggtagcggacggcacggcgaactcaccggcgaccaaagcgatggcggaagaggaacggacggtgacggcgacgaggaggaagcggcggcaaacttcgggttgacggcggcgacggtgctccggcggtcttcggcggcggcgaaggagtggacgaggacggcggcgacttggcgaccacgacggcggtcttcccgagcgacggcgacggctggaacggcggcggcgcacggctggagcgacggcggcgacggcggcgctagggcacacggcgctagggcgtttccgacgacgagaggcgaaggcaaaggtggcggcgggtagaggagacaccggggagccttttaaaggggctaggaggcaacggcgaaggcccacgtcggccggcgacgagaaggaaagttcgggaaaatcgaatccgaaacaaactcgaatccacgaatttccaaacgatttagccgatgtttccaaaggagaaaaggtagaggagatttcgaagatcatttcccttctatttattcggccggagaaggaaaggatcggccgaattggaaaacggcggcgacgcgctagggtttcggccggaggaagacgacgatcccgacaggtgggacccacctgtcagcgacagcgcgctcgcgcgggcggctgcggctgcggactgggccggctgggccgaggagagagagagaggggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccactttatattggaatttattaattaaaattagatcttcttttctaggcttttaaaataatttctaaaaattccatttaaacaacaatttatatattttgaatttttagggtgtgacaggctatcaacttatgagaaggaatgtatggctatcttgttagcagttgatcactggaggtcatacttgcaacttggggaatttataattctaactgatcaccatagcttgatgcacttatctgatcagcgtttacataccccatggcagcacaaggctttcaccaagttattgggcttaaactataaaatttgctatcgtaaagggaccagcaatgctgctgcagatgctctatcaagaaagtttcaaagtgattctgagttgtccatcatctctagttgtgttcccagttggttgcaagaggttgctaaggggtatgaacatgatccctattcttctgatctgctttcagccttgtctgttcagcttgactgcaaacctggatttcagttgcagtctggaattattaagtacaaggggcgcatttggattggtaatcatccttctctctagtcacaattgattgctgagttccatgctagtccaatggggggacactctggttttccagtcacttacagtaagatcaagaaactgtttgcttggcagggtatgaaatctcaagtaaaggattttgtacagcaatgtcaaacttgtctgcaagcaaaacctgacagatctaagtacccagggcttctacaaccattacctgttcctgatggatcttgggaagtcatcatcatggactttattgaaggtttgcctaagtcaaagatcttataactgcataatggttgtggtggataaattttctaaatatgcacatttcttgcctttggcccaccctttcactgctcttgaagtagccaaggtgttcatgttgaatatttataagttgcatggtctaccattggtgattatatcagatcgtgacaaaatttttactagccagctatggacttatcttttctctgcttctggaacaaaacttaatctgagcacttcttaccatccccagtctgatcgacagacggaacgagtaaaccagtgccttgagatttatctgcggtgttttgctcatgccaatccttctaaatgggtcacatggttgcacttggctgaatattggtacaatacttcttaccattcctctttaaagacttccccatttgaagtcctatatgggcactctcctaggcattttggaatcaatgtggacacttgtgaaattcctgatttgcaagaatggctaaaggagaggaaactgatgcaagcattggtgcaacagcatttacatagagcaaatcagcaaatgaagcatatggctgacaagaagagaagtttcagatcttttgcagttggagattgggtatacctgaaacttcaaccttatcggcaatcctcagtggcactccgagctaatcataaattggccttcaagttttttggtcccttttaggtgttacggaaaattggcacagtagcatataaacttcagcttcctgcaactgccagtgtgcatcctgtctttcatgtatctcagttaagggcggctaagggttataaagagctttcatcacttcagttgcctaaagctaactctgctctgcaagttccttctcagattcttgatagcagggtggtcaagagggctaccgatgctgttcttcaagtgctgatccgctggtctgattctgcagccgaggatgccacttgggaaaacatggaggactt

SEQ ID NO: 64757 - DNA, 21675 bp, Oryza sativa
  unsure (1)..(21675): unsure at all n locations
aaaagggcaagaaccttttcagcatcacaatccacatgacctagcttcacttggcccttcaagttctttgcagcctttttccattcaggtgccaatttcttgcagtgcccacaccttacaaaagaccagtacagttaatgagtcaaataatgtcttcattaacaggatttacttattatcttgaacaacataatcttaagggcaatgatctaaaatgtacacactacaatactaacatgtgactaaattgtatgaaattttgtgtttttcttcactttccttctctacttttggattcagagttaagttcagaaacaacagtaaagaataaatcagtcaacatgaaaaccataaatgcattaagccacataccatggtgcaaagaactcaacaatccaaagatccttgcttttggtgacaagtttatcgaagttttgagaatttaattctattgacgcacttggttcagttttctcacttgaaccacctgatttcttgccacctgaacctgctgatgtctttccattcaaccgatctctaagaagagccttgacctgtaggatacagattcattgtatttaaaagtggaaactcatatcgtgtgtcacaaggctgaaattttttacagagaaatacccaaaaaaaaaaggtaaaatggcaacccactgtaacacagcagcgacagacagtgtattttttaacgaaaatcatgggtgctaccagaagcaccagctgtgcaagagcaggtacataaagctccaccatggtaagaactgagaagcatcactgcatcacctcatatccagtatcccatataaaaagttgataagtttgaaaggtttagcatttgagggagatatatagcaaaatcaattagctacctaggacattagtatcagttgatatatgatatctgttgtttttcccccctagtaatacttcatgttaagataaaagttatttatgtcaacattcagctgacaattgcaatctgaataagtttggtctgtgaaaatccaggaagcacttaacatcttcagaaaaggatttgtagttgtatacactagtggagtggcagatagaacaggagcaataaaagtaaaaacaacatatcatttttatatatatcaaatagggcaagctgcaacaaacctgtgaaagagcaaattcaacaattggctttacatctcttgctccttgataatctactggaggctttccaggaacaaacaccttaatagttggaaatcctcttattccatattcctgcagaacaaaggcatcatgcatcaggaaaaacttgatagcatccagtcaaaatatttacaaatggcaatggtggaagacgttctaatgtgcagtttttattgatttagcctagacagaagactaatactcaccaaaacaaagatataacgtagctaaaaaatgcctcttggtcaataagcatgatactgtaaaattactgtaaaaaaaaatatatgtctaaatatgacagagactcaaaatcaccgcactgcaggtacaatggcaaaggtacataactatctttcactcttgcttgccttctctcaggatagatgcctttatttcatttgatgagtgactaaattttcagttagagaatctgggatacataacctaattttctgattcaccaataaacaatgttgcatcagatattgtaaagttgcacaacccattggcttccacggtttcgtccttcataaaagtatgcatttcccacatctaaagtcacatatacacttttattggcaataaactaaccaaggccgctctcaccttcggatcaaaagaaaaacagataaaaccctaattaacaccaattaaaatgcttaattcgttcaatataattcaaaatccaggttattttttttaaaaaaaagagaacagcatccaatcaccatgctgaaaaagtgaaaaaataaataaatttactgtatgaaatcaacaatgcaccacattccatcaatattaatcccagctacagcattttaatatgcattaattcggtattgtataactcatatccgatgttaatgccctcctttaaaaaataaaaacgacgcccctttttgatcagtacgtgtagacaccaaacattgatcttcccatatttcctccaccaaacaaatgtggcattgtactctctgatactgagagctacacaaaaaacccataacaggtgtaacttttttttttatggagtcgagtttgcacattgcatatacgcagttatgtcctagctcgatcaaattacgttgacgcaacaactgatgcagagatcagatcacaccaggaaaaggtagatcagccaatcccaatgaaccgagatgccaaacaggacgtttgctcacctgcgcgagctccttgtgcgcgtcggcgtcgagcgcggcgaccgtggcgacgcccttgaggacgcccgcggccttctcccaaatcggcgtcagctgctggcagtgcccgcaccacggcgcgaagaactccaccagcaccaccccattcgagttcagcacctgcacccccaaccgaaattcgaactcagcgagagcccccaagtaagggaagccgatccggagacggaagggaagagtgtgaggggggagtcgatcgagagaccttggatttgaagttgttggggttgaactggaggacgggagagccggcggagtagagggcggaaaccggcgaggccgcgacggcggcggcgacgaggaggagggcggcggcgaccgcggggcgcatggcggggtcgagaaggttctagaaggagtggagaggggaggaggtggaccttgcgatcggcgccggggtgcgactgcgattttaagttcgctcgcgaggaagacggacggacgcgtgtgcggaccaatggagagcctccacgtcggattcaccgccacgtcggagcagtttggctcgcttggcgtgaggggattggccagagagcgtggagtttgtggactcggagcaccgtgatacatcggatataactgggcccacacacgcttggaggtggtcccaaagttcagtgagcctaggctacactcagttgtttggaaacacgatgtggccattgtggccggtgtgatggaatgttcacgaatacaaattctcatacggccttgctagctcggaaagtccgttgactctccctcaactatactgagcctgattgtcatccctcaaccgtgaaagtgaaacagatgtatggtcttcctcatccatcaaaaccgacttattttacatgattttatcgacgggctgaacccacctatgagatatttgtaaagtataggaattgttggtaccaaggtatacgcgaaactgaagcaaaagagacagtagacatggatttttatacaagttcaagccccttaattgacatatctaaccctactcctgttgactgaaccagtgctgcctttatatatatcaatatcacatgagtacaatatttgagatgatctaatctattatctatcaacctaatgacgtggagctctcacatgtgatcgacggttagcgtagtctggttcctcgaatatgaactcgatgagattggagatagctctagctagatcccttttgtcggcctatgtggctccatattggcttttttaaggcttgcctttggtatattttggtttgtcttggattggctagatccgtcttggcttgtcttcgcctctctcgatggtcttgtatttataccctcggatgtccccttatttaagtagaactagagaactaacggggtcatcgtttaacttatttagggaataagctaaacggtgtgtttgcaaacaaaaataatttgttaataaaaactgttatatacgtgttcttagcgatctaaaagtaaaggctagaaaataaaccacgatttaaaaaaccccccaaagtgaactccaaatttaaggttaaaaattcaaattttggcttataagcatatgcacaagcgaaaagataaggttgtaagtgtagatataatccgagtggtccttatcgtgccgaagcgggactatgtttctcttttcttatccaaaacatctaatgtatatgaggcttgattgcttataaaacttagtatgtggtaggcttcactgagcttaacacaagaattattaggtatgatttatccataacattgacatatttgaacagtggttttgtcttacatggcgcctacatggcatgttgacctaacttcgaacaacgtgggacccacatgtcagtaaccaaacatcttcttttctactacacacaccctccttactctcgtccctattgcaacagtagaagtagctggcaacaaggtagtgcttgagctcccggaaggtggtagtcgagtgctctctctctcctatccggtcatagagctcgaggatagcgatgggcggagtagtagcaacaggctagcttggctccttggcggcacaacatcagctactgtcaacatctcctcttcgccattatcaatccgccacctctatctaggtactgcccaaggctctatgcctagatctaacatcgtcgtcgccgccaccgtcttctaggagagcttgagctcaagcttcgctaacgctgtctcctcctccctaagaagttgatagaagctggcgagcatgagctggaaaagctggcaaacctcctcattgagccattgtctctccttgcctcttccgccctaaggggaggcgatgaggcataggaggtaggcaagataggttcccgccgacacgagctcttccgctaagtcggcaacgaagaagggggggattggtgatgccgccattgccttgttgttgatgccaccaaagatgcaacaaggcatcagaaaaaaggggaggaaaaagagaaaacatcttacactaacacgtggagcccattgccttttttgttttttcccttgctaaatttgtcataatagtggagaaagctacaaatcacatctgacacatgcatacatgcaaggctgcgtctgtgtctgtagcatgcacgtagtgaggagaaaggctggcgcatgcatgcaagcaggagcaagcaagctagctgccaaaatggcatgacaaatcaatactttctctctcttttaatcaaactttaaacaaaattttcttctaaaatatgtgtccaatctataactagattataccattttattcatcgtaattaaatctttataacaagatctcacatgaatttattttgataaaaatatatatgtgttccagaaaaatcaaacttatgttgcaccatatacaaaaaaaaaaaaagtcacttgtggagatgttttaacccacttcataaaatgttccaaagagatgcaacatataaaagatactgactgcaacagtaaccattatcacatgaaacattatgtcctaactagtgaaacatttttatatttagcttgaaacatcaaattgtaattgttgaaacataaaaaagtatttactgaaacatataaaaataatgggaaacagggcaaatgcattagtaaaacatcaataaatacttgctggaatattacattaacaatgtgtgtaatatttaaaaagttaaagaaaagttatcggaatgtagtcatgtgatatcttgttataaagatttaattataacaaattcaatgatataattagtttgaaattcagaaaaatagtttaagagaaaaaatcatttaaactttgaaacatacttgcatgcacattccccttggcatatgagtacacctaacaaacttctttgtcatgcacttgcgcttttgctctcttagggcccatttgaattgcaggaatgagaaaacataggaataggaaaaacatatgatcttgataggaatacaaatataaaacaaaggattgcaaatcacaggaaaaacataggaatggtcgtttcattggactgcagaaaaaaatacaggaattaaaggagagataaagactcagaccccctttgatttgtaggaaaagtgtaggaaatttgaaggatttcaatcctatggaaaaaattcctatgaaagcttttgaaacaaaggattgaatcctattctatcattcaaaattcctatggaatgtttaatcatatagagattttgtaggaaagttagcaagaggtccaacctcttggaaaaaaaatcctttgagtctatctctctcattcgattcttgagtttttcctgtggttcaatcaaacaatcattcctgtgtttttcctgtatttttctatcctctgttttacacctgcattcctgtcagaatcctgcgtttttcctattcctccgttttttcattcctacgattcgaaggggccctcaaaggaaagtttccatgaggttctacctcatgttagaattcctctaaaacttgcatggcattaggcattccataggaattttataggatccattcctttgattcaaagaactgtataggaaaaattcctatgggaaagaaatcctctaaaattcctataaatttcctttgaatcaaagggggccttagattgagacgtccgatttttttatttttggccggacggccgatggtaagcattatcggagtttatttgcattggttttgattgttgggaggtgatatactgatatatttgcttgaaggtggttaactggactcggcacatagttgaaggaggcgatataaagttttcctgggctaggcgatgagtccgtcccggggcagcccagttacacggcccaattaaacttcgttcggtagctgtagttgtactgcagaacacacgcagcgtcagtgcgtcacacgaggaatttcagtttacagtgtcaccaagttgtcaaagtagtacgtaattttttgccaaaaaaaaatcaaggtaataatgcatccaaaccaagatacaggcaaggtcacgaggagactgcaggcagtgcttagtactagtagccaagaaataaacagggacttgctatgacacggatcgaaataagaatccgacacggtacaaactttcgagctcgtcgcgagtagtaatctattcatacctacacggctacacctggctagctgcatgctcttttattcagtacagtacgaaccactctgacgaatcctatgtaggagtatcacaaaacgacgacgaaaccacagttcatgcacacacacagtacacagaacagagcgagcgaggccggggttgctaagcgatggcgatgcggttggaggtctcggtttccatggacttgaacgcctcgaacctgggctccttggcctcgaacttgtggcgcacgtacagcttcatgtagtcctcgaacacgaacttggggtacgccacgacggcctcctcctccttcaccagcgccggcgcaggggagatcacggcgtcgctgccagggttgtagaacgacgcgatggacatcctgttgccgtcggtctgcgccaccacccggtggatcacgctcttgtacctgccgttggtgatcacctccagctggtcgccgaggttgacgacgatggagtggcgcatgggcggcacgtccacccactcgccgtccttgagcagctggaggccaccgacgcggtcgtcctggaagagcaggatgatgccgccggcgtcggtgtgggcgcggaggccctcgacgaggtcggggcgcgggcacggcgggtagctgctgaccttggtgccgaaggtgggtgcgcccgcggggccacggaaggccttggtgaggtagcccttctcgaggccgaggttctcgcagagcaggtccagtagccgctccgccagcgtctccagctccgccgcgaagcgcttcatgaggcgcctgtagtcgtcgtcgaggtcgggtatgtcggcgatgttggactccgggaggtggcggacgaagaaggtgctctcccagtccagcttctccgccttattcacgtcgtcgcagccttccttgagcgtcttgctcgcgaactcgaggaacctctgctcgcgcacacgcttgtagtggtccttggtcatcttctccacctcgtccatcagctccgtcgagatgccgtggttcaggatctgcacgatacgcaccgcaccaacaaaacgccagagttagttagagatgacatccattatccagcatcgaaatggaacttagtttgtctgttcaatgttcaatgtgtccattattatagattatggttttagtactatgttgctagtttgctacatataaccacctcgaagaatccccagttctcgcaagcatcatccagctgctccatcgccgcaggtcgctcctccccggcgagcaactccatgttgatgaccgggaacgtcgaagtcggtgccatttctagctctcaaagtccaggtatcacactctactcactaattaatcacaactatatctgactatagtatgctgttgtgaatgtgacgcgtccagtgctcagtgcaagtgtgatatgccgaacaccccgggcaggtgcaatttatagactcgcatggcaagctagctgctctgttccactctgctccactaggctgatctgtatctcagaacgatcgaatcgaagtcagggattagtgctcgctggctgttgcattgaccggacggagaccagcccatgtgggatacgcgtgttggctcgtggatcggcccagcatggaattatttggcccccaccaataataatctcccacatgtttcccgtaatcatttgggagagatagatagatatagatcatgttaataatcaccgttggtcccgtcccgactgatgagtcccgaccgaacagacatcccattctgccaggcagcagccagtcacgtcccgtagattaactattccgccgcgttcatcaggtgttgcgcgcgcgaaaacggcgaatccaccgcgccgccgtcccactctaacacctgttcaccgctcgatcgggcgattcggcgttgcccgcaccggcaaaaactacgtgggggctacgtacgcgcgccgcccggtgaatagcctcccgcgcgcgcccgtgagatcgccactggcgccacacgttgcaatgccgacgtacgccacgcagcggcggctcagatcagtgtcgccgtcccaccacgtgcgcgcggggcgccgtacgtctccggccccctcgacgcggagaattctatggcaaaggaatggaggaggaactagcggacgcagcccagcgcgcgcgcgcgagcggcgaaccacccaaccaatctcgggggggcggattgcctgctcccgttcgattcgacggatcgcatggtcccgcgtctcgatgatttgaggcccaagggggtaggagtacagcttttttgactcgtcatcagcttcgatgatccgtcacgcgccgcgcgccgcgcggtgcagatctggcgagcgagagataagaggaagaacattccgcttacttttctgtagtgacatgtagtaccgtcgtactggtagtgtagtacggctgttaaatgaacgcacgaacaaatgtcggttttacacaccaaataggagtagtatcagtgcttcttccatccatataacgagatatttaactatttataactcttaaaagattactggaccatatgtcatacatatataaggattcacatattatagacttaaaagtggcaaaaagttaaacgccccttatataataaatcgtttaaatatttttctagttaaaatattttaagtttaattaaatttatagcaaaagatagtaacattatcaacacaaaacaaacatattagcgtaatatattcaatactaaattaatgaaactaatatggtgttttagatattgctaagttttttataaatttgttcacacttaataaagtttaacttatagacaaatcaaaacaatttataatattgaacgaagggactagtagcaaatatgcatacttgtacgatgtactactacataggctaacaaaatggtagaggttgtagctcttacagtgatgtctgccgtgggggaaaaacaatggtcataggccgcgcacattgtgctggctttgatggacgatgatcctctcggagatggatcctaatcactccatggatatccaccagtttattatgttaactaaataactataaaaaaattgaaacaaatagattgttgtgcagtatattgtcagggttcctagttatgcacgatcgtgatcgaacctactattcggaatatcacaatcggatattgccatgggattgttgtgcacgatcgtggtcgaacccactattcggaatatcaagatcgcgcgagttctgatcgatggcggcagctcgattaaccttctcttcaccagcaccttggacgcgatggggatcccacgaagcgagttgacacccaccgatcaacccttccatggaatcactcctcagtcatcatccaaaccattgagcaaaattacgttgtttgtgactttcggccaaacaaataacttccgaacggagcagatcacctttgatgtcgctgaattcgatacaacatacaatgccatcattgggagaactgcactcgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacatgcccagctaggggtgaaaacggtacgaaaacagacggaaacaacctttatcgttttcgttttcatatttttttcggaatcggaatcgaaatcggaaaccccggaaacgaaaacggaaacgaatattatcgaaaacgaaaacggagcgaaaacgaatcggcgcggatacggtaacgaaaatttatcggaatacagaaacccctcaaactgagcttcacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtcggcggtgtggccagtggccggcgtcatcggtgtcgtccgcgtcggcggcgtcggcatcgtcgcctcgtcggtggtggtggtggctgcgaaaatggtgggggcgaggacggagcgagagagaggaagggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagtgagaaagacaaacaagacgccgaaactggactccgcaatcaagatcgttccactctctagtgccaaccccgacaagaccgtcaagatcggggcatcactaggcgagaaataggaactcgtgctcatcaccttcctccgtgacaatgttgacgtgttcgcttggcagccgtctgacatgccaggggtactcagggaggtgattgagcacaaactcatggtgcgacccgacgccaagccagtaaagcaaaaactgtggagatttgcaccaacaagccatacgagaagagctcgacaagcttctcaaagctggtttcatcagagaggtactccatccaaagtggctagccaacccagtcatggtgcggaaggccaacgggaaatggagaatgtgtgtcgatttcaccgacctcaacaaggtgtgtcccaaggatcacttccctcttcttcgaatagaccaaccggtggactcaacagccggttgtgagttgttgagcttcctcgacgcttactccggctaccaccaaatcagcatggcgaaagaggacgaggagaagacaacattcatcacgcctttcggggtattatgctacgttaagatgccgttcggactaataaccgcaggaaacactttccagcgcacggttcagggcgcacttagcgaccaactcggaaacaatgtcgaggcctacgtcgatgacattgttgtcaagaccaagacaagcgactcattgattgacgatcgacgggaaacgtttgacaacctctgacgatatcgccttatgctcaatccagagaagtgcacgttcggggtaccatcgggcaagctgctcggtttcctcgtctctggcagaggaatagaagaaaatcccgagaagatcaaggcaatcgagaacataaagttgcctacaagactcaaggaagtacagaagctaaccggatgcatggctgcactaagcaggttcgtcgctaggatgggagagcgaggacaacctttcttcgctctactgaagaagcaagacaaatttgtatggacacaggaagccgaagaggcatttattgcactcaagcgctacctatcaaatccccctgtacttgttgccccctaacctaatgaagaattatttctctatatcgccgccacgccatattccgttagcactgtcattgttgtcgagagagagaaggtgcaacaactagtctactacgtcagcgaagctctccacgacgcaaagacaagatatccacatatccaaaaactactctacgcggtaatcatgacatcaagaaagctacgccactacttccaagcccacagggtcacagttgtatcctccttccccctcggtgaagtcgtgagaaacaaagacgttgttggccgcattgcaaaatgggtagtcgagctaagccaatttgatgtccactttgtgccacgaacagccatcaagtcccaggtactcgtcgacttcgtagccgattggaccatgcctgataacaggtcagacaaccaaatcgacaacgaaacgtggacaatggcattcgacggcgcactcaacagccaaggagcaggggcaggattcatcttgacatcaccttcgggagatcaattcaagcatgcaattcacctcaacttcggggcgaacaataacacagccgagtacgaaggactactcgccaagataagagctgtagctgcactcggagttaggcgactggtcgtgaaaggggattccgaactagtcgcgaaccaggtgcataaagattacaagtgctctagccccgagttatccaagtatctcgcagaagtcaggaagctggaaaaaaggttcgatgggatcgaggtccgacatgtataccgcaaggacaacatcgagccggatgatctagcacggcgtgcgtccagacgagagccactcgaacctggcacctttctggacgtcctgacaaggccatcagtgagagaggtaagcggcgaagatagcccagtcgtcctcaacaacagctcgggggctacagaggcaaaatgcgccgttgccgatatcgaaaccaaagacgactggcgcaccccactcattaaattcataggtagcgaagagttgcccgaggacgatgcagaagctgagaaaataacccgtaaagcaaaaatctactgtatgatcggcaacgatctatacaagaaggcgccaaacggggtactcctaaaatgcgtctcgtccgacgacggcagacatcttctcctcgacatacatgaagggatctgtgggtcacacgctgccggtcggacattactcggaaaaactttttgacaagggtttttctggccaaccaccctcaaagatgcctgcgacatggttcagcggtgtgaagcctgtcaattccacagtaaacacacaaagctaccagcgcaagcactccagactatccctcttacttggccgttctcgtgctgggggctagacatactcgggccattcccacgaggacagggcggctacaggttcctattcgtggcgatcgacaaattcactaagtggattgaagcgacacccacgggggaaatcaaggccgacaacgccatcaaattcatcaaagggatattttgcagattcggattgcctcaccgtatcataacggacaacggctcccagttcattagtgccgattttcaggattactacatcaggctgggagtcaagatctgctttgcctcggtttctcacccttagagcaatggacaggtcgagagggcaaacggcatagtactacaaggaatcaagaccagcatctacgacaggctcatgtcacacgacaagaagtgggtcgaggaacttccatcagtactatgggccgtgcgtaccacaccgacaacgtccaacaaggagacacccttcttcctcgtatacggctcagaggccatgctccccaccgagctacgacatcaaagtacacgagtacagaagtattccgatgaggatcaggaggagctgcgatacgacgatgtgaatctacctgaggaacatcgcgaacgagttgccgttcgagcagccagctaccaacaggcccttcgccgttaccacgagaagcgcatccgagcacgcacgctttcgatcggcgactacgtcctctgacgggttcaaagccaagcagggcgaaacaagctctcacccaaatgggaaggaccgtacacgatcacacaagttctgcggccaggcgcattcaaaattgcagacggcgatagtcgcgagttggcaaattcctggaacattgatcaattacgtaaattctatgtataagtcaatagtatccatacttgtaagacatcttacagcttcaataaagcctatttttcaggtacagattacaatcaaagtgttccttcccgatgatcccttacctagatgacacctagcattgaaacttatcctcatgtccctttacgccgtcttgacaaggcctctgaggaacctaagggaacttcggttggggacgcccagagccgataaggccttgtcggatcctgtagagacgaaagaccatgtaagatctggtcgtgtaagagttttcgccgtgtgtattaaccaagccgtgtaatccgaaattaactttccaacttcacggctgggggctaggatcagttcttgttcaaccgaggtaggtcaaaggtccaagagccttatcttccaagaagaattctccgatgacaaggttgggggctagggagagtatataactcaaacgactgatcgaagttgcgaagtaagaagacactcttacacactatgtccagagtaagaaagcttagttagatagatttcttttttattttacaagtacttcttacaattccgtaaaaatccaaaattatattacacttttccctaagacatttgtcacaggacacgaagactaccaggaaggccaacgccagtccatggactggaagaccttctccgccagcagcgccatcgacttcgccaggccatctatctccgtaggagttctccgagaacgagaaaacccttcatggaggaactcgaggtgcagctgcggacaatgatatcgtatgcaagccaatacatgcccccggcatatcggctcgatcgacggcactcctgcttcagggcctcgtcgatacgctggccgatgccttcgagctgggcgcaaaccccatttagccacgagatgtatccggccgccgattcctcaggatccccacggggtactcggagctctctacagacccttgtcatggatgtgcaacaactcttcagatacgagctgaaccacacctcgcgacctcggagtgtttccacggcctgatccttcttcacttccagcataatcctctcgagttccgcgacctcaaatttcgtcctccaatactggatgcggcgatcttggtcagcaagcgcactcttgaggtctgctcagcatgtaaatgactaaggcaaactgctcttctctcccaagaacacaacaaagcaagtcgatccagacggaagagtaaaggagatgaaaaaaaaaaccaacctaaggaagtcgtcgccatgcccgtttccacaggcatattttgatctacatcgccctgcggcacatatggcttgaacgcaagtgccggaacgatcactggcaactcaggctgcccacgctgctggacatcctcgacatcaacatctctacaaatgacaacaaagtactcgagatcaacatgctaaagaaaactaaggtgatgactgcacacacaaaggcggttggaaccaatgagagttttacaaatcatgactaaagatcctactcttcaaaaagcgggagaacggactcccccagatcgccgacttcctccatcatgtccttgcgcgcgtcgctagccgccccctgatccaagatcttccgcaaatagagttcagggtgtgccagcctcatacacgcgaggacatggcatgccccggtatagatcaagttggacgtctcctctccgatcctggccgcgtgcttggagggggatcgcctccatcgctgtcgccagttctgcaagcgaagacgtcagcgagaactcgtcgggattcgccgggatggtagttttgacgccacactccccggcgagctggtgcagaccagtataggtgacccgcaacgagccacgggtttccgacaagttgttctcaagctccgacatacgatgctcgagttcttgtcgttgtcgctcattgccggccaccagctccgtcatcttctggaggtcctcgcgaacctccgcaaaatcacgcgtcagccggtcggcacgctcattcaccgacgacgccgccgccgccctcgcctccgcgatctcgcggctaatgccgcgagcaccagcctcaaggaggagccccatctcgacctggagctcctcctaggtgaggacgacagccggcgagccccgaccagccgcaagatcgctggctgggccactaggcgtcgcctcgcggctcctgggcacgaccacgacatctgtcgaggccacagcaggagacgcgctggaggtccctccagatctgtcttgcgccgccttcgcccacgccgccttgtggaaggctgcagttgagacaggctgcaagagtttgacgaagtgacaaaacctcaaattcatccacttacttctcgccaagcgtcacaagccactgccgtcacggaggcggaggagacgcatccgaggcctggagtataacgggtatgatgtgaggtggaagttttccgactacgcgataaaggaccaggaaagcttaccgagggagtgggcgccttccgacgatttctgatcacggaggagaatttcctcccccttttcgaaacgttgccgccacttgttgtggcagcagcggcagcaacatcggacgcctccttggcgacgtcctccttcagcgacgccgccgcctgataatccacgagcagcccgatgatatcagtcagagggagagcctacgctttatgaagtcacaatgcgatctcggaagaaaagtgcaaaagggctgctgagtacacttacattgatggcagcttcgcgttcagctgcccccttctcacaaagggggacggggactttgctcgccgttgtcgcgccgctgatcatcaattggccgacacggcgctccatggtttcgctgttcaaacctgcagattgagaaccagaattcgataagtcaggaggaacacgcacataaggaagtcaatttaaatacaagaaaaataccccgagaagaaacccgggtcgcgtcctccggcccaaaatagtcaaaggatgggtgggctcgagcccggagcggctggatccgcctaccaatgaagtcggcagcgacttcataccctgacaaacctcgtattcggaggtcatcgatggcatcgatgaagggctgaagagaaggggttaaggcgggttttgcggtccaagacgaaatcttgtctggttgttcctcaggaacaacgaagactggatccgaattttctatctgaagatagaaccacctcgcccgccatttgctacgagaggaagggcactggaaagggatatagcacgacttcaggccatcccggagtcggaaaccgacgcatccggataccctgtttgattccatctaacgcaactcgtagtagaaacgaaagaggtcaagaaacagctctaccccaatgtaggtctcacaaagatgcgaaaaaatactgagaaggccatggaattggggttcaaatggagcaaagaaaggccgtagaaattcaagaccaagagaagaaattcagaaggcggaggaagaaaaccacagagaatatagtcctcgatcgcaaccatgcgacccaggacaggctggggttcaatacctcctgcttctctctccatggtcccgcgaccgggaagggcgccatcctcctgtagtttcttcagcgacgcgctggtggaggtagacttgtcgaggtccattgcgggagcagagaagacgaggaacgcttggaggctggagagttttttcacaacaggcggacttcaaaatggatccccaaaactcacttaaatagtcgcacttccgacggtgcgaattccaaggaaaggaaagagatggccgccggaaatttatgggtccgttacgcacggcagtttttcagacttcaatttaaattcactcatgaccgttgagcttcacttggcgttgtcgattactccttatctcttggtcctcacacctagaacgacaacaacctcgacatcagaagtcacgatcagttacatgagttcatttaagcagaagtcgggggctactgtcagggttacgggtaaggtataccctctaccttcgatatacgtcacatatcgatatggtatacttgcgcgtatacggacgttttcggcgtacgttaaggaaattcatcatggagttcacagatggaaggagtcctactcggacagaactgggtcgtcattgtatcgtgccgggtccgatgtctccgagtcctacttggagaccagttgacctgcggtataaaagggacccccgggaggatctaaggcatcgaatctcatagccaacacatccacgacagcctacggagttgaagcccacaggagccaagtcgccgggagatctaatcgaacctgttcgattacgacctcgtcggtatcatcgagttccgcttttccctttgtaatatgtggtttccatcatataattccatatcaactggattagggctattacctatcaaggggcctgaaccagtataatctttgttttctgcctgcttgatgtcgtattacgtagatcctcgtaccagcgtacaccaataccctctatatccggtctacggatatccccgtcgacatatatcacttcacaaacatataaatttaaattcaacttctataagttataataaaaatatcaaatttaactgtaaatatatgtgtactaattagagtttgatttgttatttttgttgtaattgatagaagtcgaatttgaacttacatgtttatgtttatagagtggcatatcacattattcacatgtgaatttatcttgtcaatttttttaaaaaaataaaaataatttagttaacatacaacaaatgaacggatgttcatataactaattaaaagtgtttccctgatcctttgatgttagaaggtcagagttgtcctgtgctcgcgtggttgttttgtggcaactcagaaaattgaatttgtatgaactatgtacatgtgcctttgattgctgcaaaggaaaatgttttgcctttaaatttgtttctcctttgtttttctaaaaaaagtaaactggtaatcggaaaccagctagtagctgtttttttgggtgctatgcagagtaaagagaccagaacaactcagcactcgtagactcgtagtcacctgtcacgatcctcttaactggaggcatgcatggatctggccggtttcctgcactccaatctacatccatggttgttaatcaggtttgcaaatcaatgtctttccattgcccttattccggatctccgggagatgtttttgtactaatgaagtagtgatgattgatggcggcctgtataacctatcgctacgcccacactcacaaatcttcatactccataccaaactattgtactccacgtcgattttcaattttaaaaaatactttcttctacaaagagaagatcattttgatataacacaaaatannnnnnnnnnnnnnnnnnnnnnnnngatgcttggcaagaaaaaagagtaagagagagggagagaaagaaccggaagaggcatttttgtttgttgccccttgccaatttttttgctaacttgagcagtacattactagaaacgatcttttatcttaggccctctttgtttaggcttataagccaacttataagtcaaaaagtctaagccaaaacaaacaagcaacttttttatttggcttttttgaagccataagccactctaacactattaagccaaaagctaggttggagaagcttttttggcttatatgagatagatgtatgactccaccactaaacttaggacattaaatccactggcttataaatcatataagccaataaactgacttaaaagttaggccaataagcctaagcctaaacaaagagggtcttagtcccctaaacataaatatctcggttagattaaaaataggtactaaagatgcattactaccggttctaaaaattcaagcccctataagatagtaccggttgataacactaaccgagactaaagctaaaagatctttagtgcgggttagtatttttaataccggttggtaccaccaactcggactagctaaagctatttttaagtaccggttaatattaccaaccggtactaaagatgcctcagggttagcttaaaaggaaaatatatttattcaagttagatgtgtgtagtaggcgggatggtaacgtgtgtgagggttgagatgagagatcttgagtttgaatcctatatcccacatgttatttttgatttagtacgcatctttattaccggttctttcaatcggtactaaagatcgtgttacaatcgataataaaagaggttgttaaccggtagtaaaaatgagttctccgatcgtgatagttgttttgattggatacaactttttatcaaatctatgtagttgagacaatctaatataaaatattggtagtattaaactgtctaatatattttatcctatcaaaattttagtaaggcttcaaataaaaatggcttcaaactatgttgtccataggaagaaacttctctgacataggtcgctgacatgtggaccataagttatgtgatttacatatcagctactttaaagttagagagcagtaaattagatgatccattttggttgttcacgtgattacattgtatcaaattcagtgtaactatattcagag

SEQ ID NO: 64758 - DNA, 844 bp, Oryza sativa
agtagtggtaccttctattttaaaaaataataattgataacctggatatgatttaaatcctaatgagtaacatcataaatatgtccgtatgattggtcatatcaataggccatgcatatcgatgtaaagttagcacgccacatgcatacactaagtgatagcactttccacgccctctaatcaacgcgtattcctccgcttgtgtcaaagcaaaatgcatggttccaatccctgcccatccgtcgggtgcattcggatggaagggttgggatcttcaaccactacattcggatggaagggtagtgattgatttttatggacaccactccattttgtttccatactatccataagtttaattctgccttgcacgtagaacatgataatttattagcacataattaactaaatattatctacaaaggattttaaaaatagattgacatgattttaaagttttgtaatgaattctcttaaaaaatacaacgtttaatggtacggcaaacatgctaatgaaaaagtgggagtagctacaagatactccctccgtcctattttaagtgtagccattatttttcacgtccaactttgatcgtccgtcttatttgaaaagtttttgaaaaaaatgaaaaatataagtcacgagtaaaatacgatttatgttttattatctcataacaacaaaaatactaattataatttcaaataagacagacgatcaaaattgggtatggaaactcatagttgcaattaaaatgggacggagggagtatttctgaacgcagtccttatcacacggcaacctccatatcagaatgatgactggactgtcacgcgcgcgcat

SEQ ID NO: 64759 - DNA, 5001 bp, Oryza sativa
gttggggcccgcgtccgcaggtggtacgcgcactgggaggtgcacgcgccacgctggagctcgcgcagcgtcaggccttcgtggagcgcgtgttccacgtcgccgaggaggacaacgagcgcttgtcaagaagctccgcgcccccattgaccggtaaaaaaaaaaaaaaaccgaaccaacaaccacccgatcgagtgaaaatggccatggatggcacggctcgagtccggccagtgattgactagatgcgacgtgtccgacgacgacgcctcctcgtcatcggcgccgccggccatggacgacgacgacggtggcccacgcttaccggagaagaaccgccagaagtagaagaacacgaggaggaccatgagcaagttgatcccgacgacgaacgccgtcagcaccgcgccgtgcggcgcccagtgtttgttcgcatcctccaccgcggcgccggcgttggcgcagggctcgggctgccgctctggaccgtcgacataaagaagacttggagagagagagaggggatgacatgtaggccccacatgttagtgggtcctacactatatttttgtgtgtgtgaatgacagatggatcccacaaatattttcttaattctaatgccacataagcgccacatgggagtaagactaggtcaacacagccacatcagtgccacgtcagcaaaaccgtcctccaaaaccactggggagttaaattgtactggtttcaatagttcggagagtcgttctatccggtttcctggttgaggggtacatattagattcggtctactttaaggaagtcaaagtggagttttttcaacaaaaaaaagaaacctccatgacatagatgcacaagcccaataaatactttggtggtggctacaaaggaataagttcacttcacatcccttaatttgtcgacgaatctaaaattcgtccctaaaccgtaatgcatccctcagtttttaaaactagcgcaagtaaagtcccaatgttagagataatataatcacgtataaacaggataagagaaaaaccgaactagatagagataaggttgttgttgttacatgtaaatagggattcggttttcctctacctgtgcacacagctatatgtattactcccgcacgtttgagtgcgctaattaacacggatcgtcgtatcaacgacgttaacctagattagtttcttttcatggtatcagagccttcctagcatggctagctcatcttcttccacctcctccaatccagtctgcggcttcaccatcatggagaagctgaccaaactaaaccatgcagtctgggcggcacagatgctcgcggccatccgcggcgcacgccttgtggggcacatcgacggcaagaccgcggccccaagcaccaaagtcaatcaagagcaggcggacaagacggtgaagaaggtcccaaatccggtgtatgaagaatggtatgctgcagatcaacagctcctcggctacatcttctcctctctatcacgagagatcctcaaccaagtcgctgattcaaggacggcggcacaggcatggcgtgcgattgggaagctgttctgctcccagacgcgcacgcgctccctcaacaaccgcctcgctctccagacaaccctaaaaggtgccatgtccattactgaatattttgggaagatgaaggtgctctctgatgacatagctgcaacgggaaagcctctagatgaggaagatttgattgcttatattctgaacggcctagatggtgattatgattctgttgtttctgcaatcggcatgaaatctgaaccaatctctgttatggaagtatactctcagctgttaaattttgagaacagacttcagctcaaacaggaagggatcgctgctgcccatgcagcgagtcgcggccgcggtgggtttatcccacgcagcggcggcaatggtggtggcagcggcggctctgggcgtggtcgtagtgcaccgccagccaacaatggtggccgtggccgtggcaatatgccgcgcggccgcggacagcagcagcaacgcacagaccctcggccgatatgccaagtctgctataagcgggggcatgtcgcggctgagtgttggcaccgttttgatgaaaactatgtgccggatgacagacatgtagctgctgctgcccaagcttcctcctacgccattgacacaaattggtacattgactccggagcaaccaatcacatcacgagtgaacttgacaagcttgcagtccgggagaaatacaaggggcctgaatagatccacaccgcaaatggtgcaggtatgcgaattaaacatattggtcatgctttagttcatacccctcgtacattgcatcttaaaaatgtccttcatgttccacaagccaccaaaaacttagtttcagcatctcgtcttgccgaagataattatgcttttcttgagatttactctaagtattttttggttaaggatcttgcaacgaaggacataattcttaaagggcgatgccgcaaggggctctatcctctctctcctggaacctccaagcatgtctacagtgttgcgccgtcttttgcaagatggcacagtcgtctcggtcatccatctactcctattgtgtcaagggtagttagcaagaataaattgccatgtcaatcaaagtctcctagtgagtcgatttgtgatgcttgtcaaaaggctaaaagccatcaattaccatattctaagtctgttagtgtgtcctctcatcctttgaaacttattttttcagatgtttgggctccacctcctagttctgttggaggaaataaattctatgttagttttattgatgatttcagcaaatttacttggatatattcccttaaacacaaatatgatgtttttcaaaagttccatgagtttcaagctcttgttgagaggctccttggttataaaataattgctatgcaaactgactggggtggagaatatcagaaactccattcttttttttttactaaaataggcatctcgcactatgtttcttgtcctcatgcacatcaacagaacggctctgctgaacaaaaacatcgccatattgttgaggtcggccttgctcttttagctcatgcatctatgcccttaaaattttgggatgaagctttttatacagcatcctacctcattaatcgcactcctagcaaagtaatcaactttgaaacccccttggaacgattgtttcatcagccgcctaattactcctttcttcgggtgttcggatgtgcatgttggcctaatcttcgcccctataataaacataagatgcaattccggtccacacaatgtgtgttccttggctatagccaccttcactaaggcttcaagtgccttgatgtgcctactggccgtgtttacatctctcgagatgtcacatttgatgaaaatgtgtttccctttgctcaactacactgcaatgctgaagcacacctccgcaatgagatatccctcttaccctcctctctactgccaatcacttattcagggggagaacaaagtattacctctatgtttaattctgtaccaaatgctactaatttatcttgacggagcgtggggctcctcaccgggagaccgcgtaggcccccctttgccggttcggccgggggcgctgagtgagtttcttcaccctcgatctgtggaacgttcgcgagagagcaaatgcacaagacacgggcaatgtatacaggttcgggctgctgagaagcgtaataccctactcctgtgttctggtggatttgtgtgtgaaggaattacagagagccggagagcaagagagaagctggagaggaagagagttcaggctctagaaccctccttcctctttttcctcctctcctagttctcgttctggattttgatcttcttcccccccactctctttggtgggcaaggtcctccttttatatctcaaggggataccacatgcaccacttctacctactcttcttttaagtggggaccctccctattttgacccaaacttggcttgcttcttcacctggaaactaaatcacagcttgttcttgagtgaggcccagcgccatcactcgactgacacaggggatcaccctgtcattccttcattaatgggtggagatttgcaatggccgccgtccgaatgaccctccgatgggatgggtcatatctacctccactttgccggaagcagatgcaacgtgggggcacgttttgtctgccgatgacgtgaccggcgtcagaccagtcacagaccggtcattcttgtcctccacgtgtcagattagcatgcctcacgtctgtctttcttcatacaatgacttccttgcaatggttgcgatgaagcctgggatgtatctggccgggattggcgtgtcaactccaggagttaacacgccggctccggctagggacgagtgcctggaggctctcatcattccgatgggacggggcgaggcgcgtgacaggccgcctgttgccacctaacccgcgatctgaccggtctgtgaccggtcacatactgcgaccggtcacggaccggataagtgagcgcgctgcactgcattaaatgcggcgtggcgcgctcgtccaacccgcaataaacgcggttaggtgagccctgctgtgctcacctaactcacacacgtggtgccaacaccacagggggtcggggcgccccaaccctcggggccgaaacgggagtggcccgacccctcggggagacagagggaggggtggccacatcaccctcgggcccgacccccccagggggtcaaggcacgtgggtgagcgcggccgcccaagcctttagtcacgatactcccggtcccttgtcaccgacagtagcccccagcgttatgccagggcgatcgcccccctcgagggaagcgctcgggcgtaacgccactccttaggtctggtgacaggtggggccggtctctacaagcgggcagaaagccagcgatcgcaaatcgtgcacatcgg

SEQ ID NO: 64760 - DNA, 714 bp, Oryza sativa
ggtatgtacctacatactttttcttctttttttttcgtgaatattgtgtacaaatttaagtacatacatgttttttctttctctgcctttttctcttgggccatcggcaggagaagtggaggatatacgtaccatatatatgggctaacggggaagaagagtgtcacgcccagaaattcacgaaccagaatttctaagctgaatgtgcattaaacccctgtccaggactagccagggtacacaaacgacaattgttgacatacagatccacgtcttacaaaaatataaaaaagattactaatgcagcggaaaagataaaagcgagctaagcctgaagacttgactcctgcagcgggcgactccattccacaggcatccttgacggctgcgacgaaaccaacctcttcgagacatcttcaactgagaaggacttcaactctggtgtgggggaaaaaagagcaagactgagtactacccactgtactcagcaagtcataccggaagaggaggtaggatgcaggatatacccaaggtaggctaaagggctcatttgcataaagctagcattaaaagcagtagttgaaagcagtaaaacagttgtagtaattaatcagtattaaccagtcactgtccaacgctacaccacgttgcaacaggcccgaccaaccacctgaactacgccagttcattaactaactaggggtgagactaatc

SEQ ID NO: 64761 - DNA, 681 bp, Oryza sativa
acagggtttgcaatttcggtggttgccgaaaattttgtgatttccgggtttttgatcgaaattatttgaatgtttaacatattttgactgaatttgaacaaattttgaccaaatttacaaatatttgataaaaaaccaaaaatttcggagagatttgtgtttgccagtgggagccgaaattaccgaaattttcacaccatggtttacaatcaatgtcctatgtctttgtttaagcattctagcacattgattaattagtaatgggattacttctaacactgaaaacattggatatttcaggtatgcccgctactctggtcacgcttgaccttggctacaatgcactggatgatgttatcactgcagaacacttgagtcatctaaacagattaaaacacatagatttatcttacacctccttaaagattcagattgtctcggaatggcaacctccctttcgactggagtcagcatcttttcaattttgccagatgggtccacgatttcctgcttggcttcaatcccaaaagagtattgattcacttgacatgtcaagtacaggtcttagtggtaagcttccacactggtttgctactacattttccagggcatctgaattgaacttttacaacaacagtatcactggagaattaccaaagaaaatgagaaatatgtcattgc

SEQ ID NO: 64762 - DNA, 20143 bp, Oryza sativa
cccatctcggctgccacggctgcacatccgcctcgtgcgccgcaaacgggcgagcgggattagtggaggtgtgggcgcgagaaacgagggggcgagatagtgggcgcgggaaacgaggagtcgggcatagcgttggcaagggtataaagacgtcgaggaagagattcacttccttcctctcgccactattccccttgccttcgccacttgcgctctaactcttcgtttcttgtgccctaccctcgccgcacttgctcgctctcaagctcctcctccgccggcgtcatggcacagggctccgcaccgctcgacggtagcgtgctgccgccttcccgcatcgtgagcgagaggcaggccgggctgccgcgccgattcatgccggaatctgccaccggccgggaggtggtcgagctgggcgagggacgcccggcgccacactacccggggcggtccgtcttcttcctctctttcgcaatggcagggctggtcccgccattctcttctttcttcatggatgttctggagttttatgatctccagatggcgcacctcacccccaacgcggtaatgacgttggccatcttcgcgcacctgtgcgagatgtttatcggggtgcgcccatctcttcggctgttccggtggttcttcaccgtacagccggtgatgccgccgtcggtagttggtggctgctactttgtcacgcccggaaattcactaataatttccgaacttatttgtgcataaaatcctcgtccaggaatcagccgaggtacataaactgacaatttaatattcagattcatcaaattaactaaaacgataaatacttacttaagaggcacttagtcctcaccatgaagaaaactgcagcggaaaaataaaatctagcgaagctccggctccactcccacaggcagctcaactggggtataagccaaacgtcttctccttctggatccttttcttcaactgaggttgattgattattgcaagaatgagcatatgacatactcaacaagccacacagcaagtatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgaacagatctaactccaaaccaggagctaagcaaattattaccagttaatcatcaataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcccggatcatagtcacccctttataaacaaggcatgaactccccagcgacccccgtggacttctcgccacttctcagtctggcgcactataatgaatcacgctatacaaaggataaagccgttgcccatgctggcttgtggttggcacgataaatgtttcacaaccgtagctcgcgaaccggtccttaattgccatgagcacgaccttcaaaaccatgtgctcacaacccaccattaatcatattttaattaccaattaattatcataacacgattaaccatcgtgagctaccattaaatataaccttaaataataatgtagtatatatgattcatcccattagtgagctaatgtttctaagcattgctaagcaattatatatatacataacatttagctgaaccaaaccaatacataaggttcaagctaatcaattttattaccccaaggtatcaaggaatagggcattcaatgcaaattggccataacaaaggaataggttcacaccacccgatgacattcgaaaataaatgcacagttgaaacaaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtatataaaaaataaacaaacatgtagatcataattttagatgaattatgagacttgaacggcctcattctgacttcaaatgaatttattatgaattttacaagattaaatctaattaaagcccatttaaaaagaattaaataaatttaattcaacttatggataattttaatatgtagatctttattttagaaaaatttagcaacttgaaccacctgaaacggatctacggttatttagttatgattttccgaagatttaatctacgggaaaaagataaaccgatgacgtcatgctgacatcacccatggccgaaccaagatggcgacctcgccggagatagagcggccggctgcggaaaaggagggcatgtacacgtagaggacgacgagacgaacccgatggtactcaccaacgcgacgaacgacgacggatgacggccggcgacgaagaagcgacggcggcggcggcttgcacggtggcgacggctctacgggtcacgggagaggacgggagagggggcaaatgaaagaggaggactagggggtcctatttatagccttggattgaagagatcggactcctcccgcaagaaatcgatccgggaaaatcaaaactcggttttggagataaactcgaaaacgagtttaattcggataaaatacccaacgatttgctccgattcttgggggaaaagatagaggaggatgagaggatcaaaacccctcaaaaatccggaagaaacggggtcggattggagcggatttggaggcggaaaggcgacgcggcgcgcggctcgggctcagctaggcagccggctggaggttagggacgacactgtagcagggaggcaaactagacttttctgtgtggtttcctatgctaggcccgattgaaggagggaccacaaacagactttgacagagagagagaagagggcggctcggctgcagctgggccgattgggccggttcggccgcgcggagagagaaagagttgggccaaaatcggcccaacgacttagggaaggatttaaaaactttttccaattaaaataatcacttaaatgatctttcaattgttaaaaatacttccaatgctcaaataatttcaagaaaaatcctgaaaatacttggacactcaaagtacttaacaaaattataattagaccatttaatgattaatttaatatttaaataattgctgaactgctctttgtaagataaaaattaataattgagctccgaaaaatccgagaaaattccagagagtataattaaccatggagaatttaataaaaattaaatccatccatgctttatatttaagaaattttatttcccacatttaacttcacttgtaaattaatgaacatttaatataaattctattaataatttattaaataatttataaatcctgaaacaaaaatcaggatgtgacatactttcagccgcgggggccggtgctgagccgctacattccctgcgtcctccgcaagaaatgggacgactggaagagcgactggtgctacaccaccctcgctgacgaagcgcgcctccgacttccgagccagcccccggcgcaggcctccaactggcgggcaccggtagatctgggagacggctacgacgccgttcttgaccgcctggcgggtctgcgatcccaggggctcacgggggccatggtgtacggcgactaccttcgtcgccggattgcgccgctccagcggcgcgcccggggcgcctgggagtacactgggtccgaggattacatgaggacccaccaggggggcagatgggactgggcccctgaggacttcaagatggtggtccaacgggtgctgaatctcagctccgtggaggcatccctcatcccccaaggagtcctccccctctgcagcgatccagatcgtgccaacatcctgaccatcatgcaggcggtcggggcatcggaggagcgggctcctcgaggccacgatggcgcgggcgggagccgcaggggaaaacaatctaccccgggagggggtcacgcttctgggccccgcgacgggggcccggggggcagccgccctgccgacgcccgggggaagaggaagcaggagggcacgcctcccccatctcctccccgagggggcggggcagtgcgtgccagcagcaagcgcccggagggtgccgtgccgacgccgcagcccgagggggagcgaaaaaagaagcggctccgcaaaatgggggggaccgagccatgccgggggaacctcatctcgcccccgcggtggtcatttagccgacctccccgcaggttcgtctctgcgcccaccgcggccgtgttcattctcccatctcccaagacgagttttcactcacccgtttctttttgtcctctggtttttcttctgccttagcgagatcccgtcacgcccctcccgccattccaagtccggccggtccgaggccgaggagacggcgaccgcggaggcccggaggcgggaggctgaccggcaagaagccgcagaccgcctccgggaagccgaggaagctgctcaggaggccgtccgggttcgccaggctgaggaagccgctcgggaggaggccagactccgccgggccgaggagtccgtccgggaggcggaggtggcgcgcgcacgctaggcggcctgccaagcccccgacctaactccgcccgaggcgacgacgacttccgaggccacccacgacgaggccgcgggcgcaccgctcgggctcgacccctcgagcgacgtttgggacgagccagcttcgagggacgcccctgggtccggcacgtcgatcagcgggccaagccgcgtggcgcccataccgaggcggttctcccctctgccttccgctgccccactgaacgcggagcccctcctgcaggccttagccgccgcgaacaccacggtgctggacgggctaagtgcccagatggaggtcctgcaggcagagcgggcggagctcgacgcggcgtgggcgcgcgtagaggaggggcggcgctcggtggaggccatggtggaggcgggccgcaaggcacaccaccggcacgcctccgagctcgaggcccatcgtaggaacctggcggagatcgcccgggaggtggaggaggagcgggagactgccctcatcgccaccgccgtgcttgacgaggtgcgggacgacctccacctccaatacgggagccgggcggcggagctagagaagaagctcgacgccgcccggggaatccttgacgccgccgctgcccgggaacggcgggcggctgaaatcgaggcggcgtcccggaaacgcgaagaggcccttgaggctcgcgccacggcgctggaggaacgcgcccgcgcgaaggagagggacctggcggatcgtgaggccgccgtcgctattcgggaggcaacactagcggcgcacgaggccgcctgcgccgaagaggagtccgcactccgcctccgcgaggatgcgctcgccgagcgggagcgagctctcaaggaggccgaggccgcggcgcagcggctggcggacagcctgttcctccgcgagacagcgcaggaggagcaggcgcgccgcaatctggagggcgcccgcgccgagagggccgcgctggatcagcgggccgctgagctcgaggcgcgggcgaaggagctggacgcgagagcgcacagcggcggggcggccgcgggccacggcgacctagtcgcccgcctgcagccgccgaacacaccatcgccgagatgcagggcgcgctggactcgtccgccggggaggtcgaggccctccgcctggcgaacaaggtagggcccggcatgcttcgggacgccgtctcccgtctagaccgtgccgggcggcaggcgggcctctggggcgagcggaccgcgaagtacgccgccaaccggggggcctcgcccagcgcttctcagagatggccgggaccctccagcggctccccgaggagctcgaggagacgatcaagtcatcctcgagggaccttgctcggggggcggtggagcttgtactggcaagctaccaagccagggaccctgacttctccccgtgggcagcgctggacgagttccctcccggagggacgagttccctcccggaaccgaggacggcgcgcgtgggtaggtccgggacgccgccgaccacatcgtccacagcttcgagggtacaacccctcggctcgcgttcgccctcgacgccgacgaggagggcggtgacgacggtgcggacgacaacgacgacgaggctggggacccgggcgcgtcggaatgagcccccaggcccctgccaatcttatatagttttttctttcttcttccgaggccttcgggcccccttcttgtatagactaacttaatctgcaatcaaataaagaggaaatttctgtgtcaattctatttgttgtgtgtatgagacgaggatggtctgtggcgcggtccttctgtgtcttggcttgaacaagggctcgtgcccgggtcccagcctcaaacggcgcgggtcggagctagtgcctggggagatccacatgtcgagactgaccaggccgggagcgtggtgaccgagggttatggatgacccgattgtgggcctttgccgattcccccccggagttcaccacgccccggggcacggctcggttctgggccccttttggcgattttagccggcccgggccaccgaggacaggatcgagcacgagcatgctaattcaagccaagattcttcaaaagaaaacaatggcacaaacacagtccttaggaaatcgaaaatgcttttattgaaatacggaagagaaaaaagacaattatctgtatgtggtatcccctggccaaccctgcacgcccggggggggtgcggggttggcccgagctcgagacctgacacccgacccccactaggggtagaagcgacgaaggtgttcgatgttccacgggttaggcagctctgtgccgtcgcccgtggccagccgaacggagcccggccgggggacgccgatcactcgatatggaccctcccacattggtgagagcttgctcagtccagcacgcgtttggacgcggcgtaggacgaggtcgtcgacgcagagtgatcgggtccggacgtggcgctgatggtagcgccgcaggctctgctggtagcacgcggctcggagggccgcgcgccgccttcgctcttccaagtagtcgaggtcgtctctgcgaagctgattttgatcagcctcgcaatacatggtggcccgaggggacctcagggtgagctcagatgggagaaccgcttccgcgccgtagacgaggaagaaaggcgtttccccagttgctcggcttggcgtggttcggtttgcccagagcaccgctggcagctcctcgatccacgagtcgccgtgcttcttgaggatgttgaaggtcttggttttaaggcccttgaggatttccgcattggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtacttatcgatcttgacgaccggataagcctcgggccacttagtgaacttgtcgatagcgacatatagatactcgaacccgcccggggcccgcctgaacggacccaggatatcgagcccccagacagcaaacggccacgaaagaggtatgatctgcagggcctgggccagctggtgggtttgcctggcgtggaactggcacgccctgcaccgccggaccaagtcgaccgcatcgttgagagccgtcggccaatagaaaccctggcgaaaggccttgccaaccaaggtgcgtgaggcggagtgggctccgtactcaccttcatggatatcggcgagaagcttgacgccttgttcccaagaaatgcacttcaggaggactccgttagccgcgcgccgatagagggtcccttccaccagcacgtagcgcttggagatgcgctggacgcgttcactcccttcgcggtcctcgggtagagtcttatctgtgaggtacgcctggatctcagcgatccaagcgatcaatctaagggagctgggagcgctcccctcgggtcccgaggcctggactccgacgggcctcgggggccgttcaggcgcgtccgtctcccctagggggtcgggtcgtgccgacggctgggcaagcctttcttcaaaggcgcccgggggggtctgggctcgcgaggaagcgagccttgagagctcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccagttgggagtcgcctaacaccaggaggcggaggatccccagtccagctgccaccctgagtcccgcaaggagtccctcgtactctgccatattgttggtcgcccgaaagtcgaggcggactaggtatctgaggacgtctccgctcggcgaggtcaatgtgacccccgcaccggccccctgaagagacagggacccgtcgaactgcatcacccagtaggcggtgtgaggcagatgcgaggggcccgagctggcctcggggacggagatgggctcgggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccactgtgacccgatgcgcctggaaataatggcgcaacttccttgaagccatcagaatagcgtaaagcatcttctgggcctgagggtatcgggtcttggcgtcccggagggcctcactaacgaagtagacgggccgctgcacctttcggcggggccgatcctcttcgccagccgcatctccagggcgcttttcgtccgagaggccgcgcggggcgcactcggcttctgtgtcgacgacctcggggtcggagggcgacaggcgtggccttcccgcagtgaccctggggccatcctgggggtcggggacgcctggcaccttcggactagcgggcagagggccagctccggtcgtcgggggcctcgggccgccgttcggctcgggggcctctcctccctgctctctcccgggtcgagtcgacacagggtgctcttcgtccgagaggccgcgcggggcgcactcggcttctgtgccgacgacatcggggtcagagggcgacaagcgcgaccttcccgtagtggccccggggccatcctgggggtcgggggcgcctggcaccgtcggacaagcgggcagagggccagctccggccgtcgggggcctcgggccgccgttcggctcgggggcctctcctccctgctctctcccgggtcgagtcgacacagagtgggggtgcgcggagcgagggttgtcctcgtcgcgctccacgaccaacgccgcgctgaccacctgcggggttgccgccaggtaaagtagcaacggttcatctggtttcggggcgaccaggaccgggggagaactgaggtacgccttcaactgagtgagggcccgttcagcctcctccgtccaggtaaacggcccggaacgtttgaggagcttaaataggggtagcgccttctctcccagcctcgatatgaaccgacttagggcggccatgcagccggtgacgcattgcacatccctaagtttgctgggggggcgcatccgctctatagctcgtatcttctcggggttggcctcgatgcctcgggcagtgaccaagaacccgagaagcttgcccgcaggcacgccgaatgtcacgcccggaatttctatccaaaattccaaacgcttacatgtgtgttaaaccctcgtccaggaatcaaccgaggcacacaataacaaattgataatagagtacaaataaataactatttaatgttcgcaaataataaattactacagaggtagatagttcctctcaaagaataaccttctacgcagcggaaatataaaactataacaaactacggaacagctatggcgactccactccataggcatcttaaccagaacaagctcaatccttcagatcatcaccttcgctgaaatactcctcttctgatgattaaatattgcaagaatgagcatatgacatactcaacaagccacacagcaaatatgcaagtgcacaggataacaaaggatggcataatatagctcatttgcataacagcatttaacaaatatttaagagaatagtaaaacagttgtataattaatcaatattaaataaacaccatacaacacacccatgttgcataggcccaaccatcctgaacaaccatacccggctgtacagatttaactccaaaccaggaactaagcaaattattaccaggtataacatctataattattgtgagaggtgtgagactaatcacgaaaaacattgctcaactcacccataaccgcgggtacggctattcgaatagattaaactctgatcagaggtgtaccactgtacccacaagacacaatcccacaacatgttaccatgcgccttagtaccaccacgatacctcgaaaaggaattgtgacaataccccttgcacaacacaactcaccacagtgcaccgttcctggatcataatctccccctcaaaaccagaggcaatggactccccagcgacccccacggacttctcgccgcttcacagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaaccatcgtgagctaccatttaatgtaaccataattaaaataataatgtaacatagtttataattaatccctttagttagctaatgtttctaagcatggctaagcaaacttacatatggcatttagctgaaccaatccaacatataaggttcatgctaatcaaattataacccataggaaaataagatcatcttcagccattaatcaattgggaaaggttcaccacccgatgacattcgaaaacaatgcatagttgaaattaaataatagctttaaatgggttcaacatgctcaaagggttgtttgggatctgtgtgacttgccttgggcttccgcaaacgcttcggaaccttcctcaatggaaacgctctcctccggaacgtcggaaactaaagcaattaaacaaaaattaacaaaacagtacaaaaacaagcataaacagtacatgtggatatttttaacatgtagatcttgattttagaaaaatttagcaacttgaaccacctgaaacggatctacggttatttagttatgattttctgaagttttaatctattagaaaaacgggaaaaagaaaaaaaccgatgatgtcatgatgacatcatcaatggtggccgaaccacgatggcgacctcgccggagatagagcggccggctgcggattaggaggacaagaacacgtggaggacgacgagacgaacccaacggtactcaccctcgagccaaacgacgaacgacgacggccggtgacgaggggatggcggcggcggctcggcttgcgcggtggtggcgggctacggcggccagcggcggaaaggagagggtggccgagcttccctacggcgtggtgaagcccacgacggtggcgacgaccgacggcgacggcggaggaggcgcggcggcgcggctggagatcgccggcggcgacggcgaggctaggcggcgtcggcgacgagctacggggcacgggaggtgtcacgcccagaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaaataaacggcgcagacggctccactccacaggcaacttgaccaaggctacacctactcctccacaccatcagcttcactgaagaactcttcctctgatgaatgattgcaaggtgagtatatgacatactcagcaagtcacgcagcaattatgcaagtgcacaggataacaaaggatggcataatagggttccatttgcaaaagcagcatttagcaatcatttgagaatttaataaaacagttaagtattaattaaacaatattaatccaacactatacaacgtaccctgttgtataggcccaaccattctgaacaaccaccccggttgcacagttctatctccaaacaaggaatataccattccaaaccaggagctaatcaaattattaccaattaaagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacatcggaaaagagttgtgacaatacccctcatacaacacaatccactgcagtgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcattaaataatagtgagtcataagttatcccaatagtgagctaatgtttctaagcagggctaagcaattatatctaatttctagttgaaccaatataaataaagctcaactagtcaaattataataacccaaggtatcaaggaataaggtaatcaagaacaaaagggctataacaaacaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctctggaaacgacggaatctaagcagaaaagagcaaaatcactaaaacagcacataacaagcatgaacagtacatgtggatatttttaacatgtagatctcaattttagaaaaatttagagacttgaaccaactaaatcggagctaagatgaattagttatgaatttttgaagattaaatcggattaaaacacttatattgattttaattgaattatgacgcaataatgaattatttttgaaaaggaaaagaaggtttattgcgtcagcggctagggtttcggtggatcgggcgcacgggcggcggttcacgcgaacggacggccgagatcgacttgatccaaaacggacggccgagatcgaacggtccacgaccggctcacggcggacgaccccgatgacgtcggcaatgacgtcaccgacagcggcggcggctcggcggagcggacggctcgggcggcgcacgctcgccggcgaacggcggcactaggacgcaaacggaggccaccggcacgtagaggacaacgcggcgaacacaccggtgaccaaaacggcggcggaagaacaacggacgacgacggcgacgaggaggaaacggcggaaaccttcgggttgacgacgacgacgaagctccggcgatctccggcgatggcgaaggggcggacgaggacggcgacgcgacggcgaacactacggcggccttcccgagcgacggcgacggctgaaacgacggcggcgcacggctggagcggcggcggcgacggcaaagctagggcacacggcgctagagttcttccggcgacgagaggcgaaggcgagggtggctacgggtagaggagacaccggggaagcttttaaaggggctcggaggcggcggcgaaggcccacggcggcggcaacggcgaaggaaagctcgcggcttgaaggaaagaggccgatccgaatcgaactcgaatccatcgatttccgaaccgatctagccgaagcttccaaagaagaaaaggtagaggagatcccgaggatcatttcccctcttttgattcggccggagaaggaaaggagcggccgaatttggaaaggaacggcggcggtggcgcgctagggtttcggccgggcgacggcggctcggggaagacgaacctgacaagcgggacccacctgtcagcgacagcgagggcgcgcgcggctgcggactgggccgacttgggccgaggagagagagagcggttttgggccgactttcggcccaaagccaaaagaagacttttaaaacctttttcaatttaaattatttcttaaatgcaattccatttattaaaaatacttccttaggtcaaataaatcccagaaaaatctaggaattatagaattaagcaaagtatttaataaaattttatttggccccattttatattggaatttattaattaaaactagatcttctcttctaggcttttaaaataaattctaaaaattccatttaaacaacaatttatatatttatgattttcagggtgtgacaaacctaccccccttaaacagaatctcgtcctcgagattcggaagaactggcgaacagatgcggatgagctgacttcaattcatcttctcgttcccaagttgattcttcttccgagtgattactccactggactttacaaaaacagataactcgattcctggttcttctctcatttgtttccaagatacggattggtttctcaacataggtcagatcctcttggacttctgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggaactcctcttctggggttgggaaaaattgagcaagactgagtacaaccaccgtacttaacaagacacacccgcaactgcagaataaatgcaagggagtacaagggaattatactataaagggttagggttgcagtaaacagcatttaaagacatttagttgctcaaagctattttgtaaacacgattctagaactatacactattattcatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccccagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatacggtccttttgtccgtctgtctgcggatgataagcagtactaaagttcagcttagaacccatctcttcctgaagtttcttccaaaaatttgaagtaaactgactgcctcgatcagacactattttcttagggacgccatgcaaacacacaatccttgccatatacaattccgctaagcgacttccggaataggttgtctttaccggaatgaaatgagctactttggtaagtctgtcgactatcacccaaatagagtcatgacctgatgacgttctgggtaaaccagtgataaaatccataccgatttcttcccacttccattcaggaatcttcaaaggctgcaacaaaccggcgggtttctgatgttctgccttgactcgctgacaaacgtcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacagattctctcacccaaccatacagttccgtgctcatcctccaagaaaccgatagcttttcctcttctcatattcttcttgatttcttgaatatcaggatcattaatttgggcttctctaacttgatcaattagagtgggcttcgcttctaaggctgcaacgaaacctctactgacaattcccaaatttaatctttcaaattccttgcataattccaatggcaactgtcgtccttccgtagcattgcaatagcctttcctgctaagagcgtctgctacaacattagcctttcctgggtgataatgaattcccatgtataatccttaattagttccaaccatctcctttgtctcatgttcagatccggctgagtaaagatatactttaaactcttgtgatcggtatacacctctgtacgagtaccgaaaagataatgacgccaaattttcaacgcatgaaccactgcggccaattcaagatcatgagtagggtagttcttctcatgcggacgtaactgacgagatgcataggcaaccacctttccatcttgcatcagaacacaacctaacccaagttttgatgcatcgcaatacacttggaaacccttctttggatcaggcaaaatcaaaataggagctgatattaagcgacttttcaactcttgaaaactctgctcacattattctgaccacttgtacttcacatctttctgaagcagtcgtgtcatgggcttagcaatcttggaaaaattctctataaacctccgataatatcctgcgaggcctaggaatctgtgaatctctgaaaccgtctttggttgtttccagttggttacagattccacattactaggatcaacggcaactcctcctgctgagatgacgtgaccaaggaacttcacttcagacagccaaaattcacacttgctaaacttagcatacagttgatgttctcgtagcttctccaacgcaaggcgaagatgttcttcatgctcttctttggttcgagagtagataagaatgtcatcaataaagaccaccacaaacttgtctaggtattccataaacaccttattcatcaagttcatgaagaaagcgggggcattggtaagtccaaaagacataacagtacattcgaacaatccatacctagtggtaaaagttgtgttaggtatatcttcctctttgattctcaactggtgataccctgatcgaagatctatcttggagaaaacagtggcacctttaagctgatcaaacaaatcatcaattctgggtagcggatacttattcttgatagtcacatcatttagtgcacgataatccacacacattctctgggtatggtctttcttttccacaaaaataaccggagctccccatggtgacgaactcggtctgatgtatcctttctgaagcaaatcgtctacttgcctcttgacttctgccaactcattggctgccattctataaggtctcttatggatcggagttgttccaggtaccaaatctattctgaactctatatcccttttaggcggcataccaggtaaatcatctgggaacacatcggaatactcccggactataggaatctcttccaaagttatctggttcagtcttgaccttaaagactcagaagacaatgcatgaacagttacaactcgaccatcattgctggtgagagttacttttctgttggcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattatttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagctgcaacatgattgacacgggccttcgatgctggtgcggtagagttgctctgggcagggacaaccttcacgcgtcggggcttcggacacttgtcagcataatgtcctgggtctccacagttgaagcacaccacgggcttgctgccttgctccctcttggcaggctgtttgtcgcgaccgagaaaattgcattttcccgaacgctagtgtattaatccccgtcccaggaaaagccggggtacaccatacaaacatgatataaaagacacatctttattatatcaataatatttacattattacaaaggcacttaaggcctgacaataaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcataattaatgcaagggagtacaaggggataataacataggggttaagttttgcagtaaacagcatttaaaagtcacttagttgcccaaagccattttataaagacgatcctagagctacacagtattattaatcaaggccgtgaacccacacgagcctgccttaacccaaggcctacgatgattcagaccgaactggcaacccgaccctgggtcccagctcgtcccaagccaacccaagccaactattccacattttagttgttaagcaggttttaagaattaaaacactaacttgggtacattgctcggcttgcccctaaccgagggcgcggctattcgaataggttatactctgatcagaggtgtacatcttttcccacaagacacatcttcctcacgtgtaaccacgtgccacataccaccacggcatttggacggg

SEQ ID NO: 64763 - DNA, 7405 bp, Oryza sativa
ccgaggatgccacttgggaaaacatggaggacttacgcactcgatttcctactgctttggcttggggacaagccaaatttcaaggggaggggattgtcaaggagcaaccactgtccgagggcgctaagtcagttgctaaagacgctggagatgatgctgattccggaaggagggaagatgaacttgaagcagctgaaggagaagtggtgcgccgtgcaacaaggcccgtcaagataaaccagaagtactatgggcctaactaggccaagtaattaagtctaattcctgtaatagttcttcgtgcgagagggggaagaactgagtaggtgaggaagataagagagagagaacacgaggtgaactctgtctttggcgaccatggtggcataggcggcggtggctccattcatgtcggaatcggagaaatatctcagtaatagagttgccaattccttcgtgctctaatccgtgcgttcgttctggattgcttttcctgtgcgagttcgttaaccgtccgctccaccgccaccgctttccctgcgcgctgctcttctcctgtgcgcgagggtttttttccactccatatgggtagctgtttctttcccaacctaggacgagggggaaaggccggatcggcctcgattcaatccgcgacgggattaaccgaatgcaaacttttctgtgggccgggtttcaatccgcgtctatccaatccacggggattgcagcccaatcccggccaaacccgggccaacctaacaaggcctcaaagggatgcccactttacatgtttttacacttttacttctcaaaagatgttacatacttcctatgtcccaaaaagaatcaacctctagctgtgtatctacgatataggctatatccgaatacatagccagaagttggcattttttgggacagagggagtatatatctatatatttatctataaaagtgaacggtaaggacccctttgaatcgcagagttgaaaagattggaggaatagaaaaaacacaggattctaataggaattgaagtgtaaaacagaggattgcaaaacataggaaaaatacaaaaatgatcgtttgattggaccgcggtaaaaacacagaaatcatatgagagagatagattcaaaggaaattttccaagaggttggacctcttgctaagtttcctccaaaatctatatgctatgtgtcattccataggaatttcataggatttgaaaagtttcaatcgtttgaatcaaaggacgaaatagaaaaattttgtatgaaatttgaatcctataaaatttttatataaatcctttgattcaaatgggtcctaaatcttgaaacttcaccagattgttccacgtaatcaccattggatagagaaaaaggagatggcaaaaccgttggatttggtgggtaaaaagcagtaaaaaaatgttctggaaaattccagtgtattccctcaaacatggaagttaggagtagcaacaaacgaaatactaaaaaaagaacaaaatgcagcgccgagaaaattaactgcatgaccaaggatgggcctacttgtaaagcaaatatactgatgtacctatatagtagaagagttgactttctttgaaaaattagctatataattcattgttacaattagtccaattaattttttactgtgttaatctatctacctattatatatttaaaaaactaaaagtccattaacatcctacaaacgctattaaactcccatgtggctctctaaaataagaccaaaggaaaataacaaatccagtctatttaaggatatacttaaaaatatgaaaccgcctagtcgctgtcttcacggtttttctttgaagtcagtttgatcttggtaaactttcatacatgaatcgacctctttccttaattgaattcactaaaaagccatactaaattttggtgttaacattgggtattggcaaaatttgctacaggacactcaaagtttgtggcgtttgctgtaagacacccaaagaacgtgtattctctcgtggacactgtaaaaatgtggtaattagctgctagacactcgtctcattattttattattttcgatagaaacggagagagacattggttaaagacagatttgtccatgagcccacttgtcaatccctctttctctgttcatcttcttcctcctgcggcttcggatggggcaacggcgaagtgggcgccgccgctgcagcagcaactagagcacagggcggcgcggagctggctgggctggagcacggggcggtgcgggactggctgggctggagcacggggcggcgcgccgctgctaggagtcctccccagggctccgcttcggatggggtagcggcgaagtgggcaccgccgccgtcggccaaatccttgcgcgggacgcatgccccgtccgccatttccgccacgggtggatcgacagggatggctcattttttcattttttttcccttttgagatcccctcttctgttcttcctctccgtccttgacctcgcaaggagcagtagtgcgagcgaaatcaggggcatactgcatacctactccccttggggcccttcctgctcctgctggtgctgctcgcactcgctaaggggtatcgaatcaacgccgttttccagtttgcacacggctcggcttggcattgctgctgctgcaggtgtcaatacatacgttccagaacgaggccaacggggacatctgctacacggggctagcatgtacctggatgccatcgtgcttgcccttgccagatggagccgttggtctgctgtggcatggcagtgtgagaggagaagaaagaagaacagaagctggaagaaaaacagtgtcaggggtgttttggtactttcaatgctctttctctctccatttccaccgaaaataataaaagggataataaaataatgaggcagatatccagcagctaattaccacatttttacggtgtccacgagaaaatacacgttctttggatgtctcacagcaaatgccacaaactttaggtgtcttgtagcaaattttgccttgggtatttcaccactagtggagcagaaggacaccagttcattcaaatattacaagcagattggaatgagttattgcaacatgggagtatatcctttatctaccatgtgccatctaccagtacggcagtaccaactgaccaacttctaatataaccaaaaccctcattctcttgggctcaagctgtcattgttagccatggccgatggcaagctagagctggacgacagcgtcgccgtcgcaaggctggtcgacgagtaaccaacaacctccgacccaacggaggtcatgctgtcgccgtagtacttcatggtggaagccgcgaacggctgcaggtacactgccaccggcatcctcggcggcagcaccggcatcctgaacttcctcgactgcaacgcctccgccgcctgcctgatcgccggccgcgccttcgggtcggggtgcgcgcaccacagcccgacgcccaccacacgctccatctcccaccggtcgaacgcgccgccgagccgtgtgtcggcgatggcgtcgagcgacgactgatcatcatcaccccggccgtagagctcccacgcccactccaccaggcggaacacctgtccgccgccgtcgtcgtcgtccttcccaccacccgcggtggcagcggctgcacgaggtgtcactaccattggtcgcctcccgcttgccacctcgagcaggacgatgccgaagctgtacatgtcggactcggtggaggccttgccggtgatgacgcactccgggtcgaggtagcccggcgtgccggcaacggcggtcatggtctggaggctcatgccgtggtcgatgaggcgcgcgaggccgaagtcgccgagcttggcgttgaaggattcgtcgagcatgatgttgctgggcttgatgtcgccatggacgacgcactgatcccattcctggtggaggtacagcaccgcggaggctagtccattaataatctggtacctgacaaaaattagtcacataatatgatacacagatacagggaaagtatatttgattttcacagagaatttacatatgagtttacgtgcaataccgcgcttaatttcggatttttttagatcatatgagttattgtgaatttatagcattctttttagagaaaaactccaaattaactcctaactattacgatagtacgaatataaatgtgatgtggtaatttgtataatacatcaccttattactaactgttatgcgaagataaaatcgaactttcgatcagagtactactcatttttccccgtcctttccaatttgatctatcatatttgcaaatgttaccgagatcaacgcaaaaaatatcactccttttagaagtaaacctcatcggtcatgatgttgtactaggcatgtatgtggatatgaaaacgtgtagttgaattaatgtgaggtatgcaacgatgtcatttactcatacacagatgaacgaacatatatacaacgatgtcatttactactgcacacctaaacgaacatatatagaacaatgttatttacttctacacgaataagcaaatagataacagttagataatgatcgatttagaaactaagacgtacaaattttagggtatgattaattgggatagagccatagaggcagtagtaattactcccacctttcaaattataaggagttttgatcaaagttaaactactctaagtttaaccaaatttataaaaaaatagtaacatttttaacataagacaaatatattaaaaaaatatattcaattatagatttaatgaaaataatttggtgtcttattatattgtttataaacttaattaaatttagagtaaaatgattttgatcaaattcaaaacgaattataatctaagatggagtagtttatggttctcgtaggacaagaatcatcaacatctatctattatatactaaaagttcattaaacttcctacaaactcttctaagccgccacatagcactcctaaaaacactcctaagtcgctatgtggcgctttaaaaaattttaaaatccgataggcccattatttctagccattagatctattataaaaaatataattaaatttatctcaaaaactcgcatagtacgtgcacgtataggtattcccaaaaacaacaagtacgtccatactttgatacgtacactgggcccacatcattcctttttttttcttttttctttctcacttattagatggaaaaccaaactacctatatttataatcgtctcactttccagaaaacactggtggagaaatgctttctagtcccggttcataaccccctgtagtcccggttttccaaccgggactacgaatccgggactaaagatcgctatctttagtcccggttcaaataaccgggactaaaaatcaatctacctcatatactacggaattgggccgaccgaccaaagatggtttctccaccagtgaaaagacaaaacttaattatctacctcatatactacggagaaaaacgataaatcaaaaaatatatcaatatattaatagtaaaatcggaaagaaatactaatcaacaaaaatcataaacaccggcacttattgttgtcaatagcctttcaactatgattttgttaaaaataatactatacaaaaataagtagggggcaaaaattataactattttcatcacctcctcctttttgtccctccatgtccttcaatgcagcgtctagtgtttactatgccatcgtaaatattacaggcatatacatatggttgagttaaggtggcgtcagtaaaagatcactataggcaatgtatctaaagtgacattcttactaatgcaatcctttgtgggtgtgctcatagtgaactaagtgttaaaatggtgccataggctggtctttagggtcacggctacgtcgatgtggaaccaatgtttcagggcattatataagaaagctttggtagatacagtcgatgatgtggaaataagtgatgaacatcgagttaagtagtgtagattattttttagtgtattaataatatataatttattttagtggtactaatacagtttcatttattaaaaatgcacatagcttttaaaacaataacaatagaggagtttatatatgaccacgacaaaatgatttttatttaaatatgagatgtattcttattcttatcatatttagtagtatattaaaatataccatctattttacggtaaatatatttcttttttattgtaagaaaatttacattcccttacagtatatatatatatatatatatatatatatatatatatatatatatatatatatatatatatagtgatgtatgatttattttaccattcttttttttgaacaacaaataagatgtcagtgtatctctgggggctttattttcagtttatattttgaaaatgttttctgatttatattccatccttatagtgttttgaaatacaatctacgatacatgcccacgtaaatgggcgggctcccttccttgttaatcataagagatttactcccatccagcagctctcctctgtcatttactgattactataatttgagtgacttcaaatgttcaatacccttccctattctcttttccggttcccaatttagacgactagatttgattttgtaccttccgatactattacctaccggtacaatccgccggactggagcaatcatctactcataattcatgcacccggacgccgggactcggggacacgtcaccatccatggttaatgtattttcatcagtccagccaaattgccctgttgatggaatctacaggcagcgctatcgtaaatgcggccaagatgtgggccccacaaaagccacttcgtcaaggtaggaacacgcctgatcgatggtaacatgggcacatacgtacgtacctgagcggccaggtcaaggtctccttgttgctgtaaaggtggccgtcgaggctgccgttgcgcaccagctcgtacaccagcagcagccggcgggggccatggcaccaccccatcagctgcaccaggttccggtgccgcagccggctgatcaccgtcacctccgacctgtactccttcctcccttccatggacgccccccgggtgaacaccttgatcgccacgtcccgcccgagctccctcacgtgcccgccgtacacagaccccgacccaccctccccgagcttgccgatctccgcgaacccgcccgtcgccgccgccagctgcgcgtacgggattcgccgtggccccgtgcccgactccatgtcctcctcgtcgtcgtcgtcgagggagtcgtcgtaggagacgccgtcctcgcgtcggcggcgttttctcgctc

SEQ ID NO: 64764 - DNA, 1893 bp, Oryza sativa
atgctacgtagtgtgtctaatttgtgactcaaaagtgctatatattgtcaatgttggcttaattaattccatctctgtttgattttttagcttcataaaaggtgttaactgcataatatcggcaaaagaaatgtaacacagtactcttctgttaggcactcattgattttaagaccaagtacaggatcaatattttttgctgatgtaatccattttttggtgatcccaaaccattaacaatcaacggtgctaattttcacagattacttattgacagggttagaaggtgtgcagttctttactttatggagtatcaagtttttgcaagtgcgcatgacagtagatatattaccatccaagaaattcatttgtatagcttttaatagtgtatcatgtattcgtgttcatgcctaaacaattgggctgcaaacccgcatgggcattaattttatttatatatattcttatccttttcacaaaagatatagatgcagttcttttgattgctctgaaaaacatataattcctgcaaagaactatgctggaaaaatgtaaacattaagcctagtacttttatcagattcacttgcgaagcccattcttcatagcaggcatgaactctatctttctgtaagatataaacaacaccggataatactaacacacacatagcatttgattggtgataaacagagagttctgactggcagatgcaacactggaacaggaaagtggaaaatcaaaatcatgtatgacgttatattttactgtgaagtactactttagaacaacaaagtaaacaaaggggagcagattcgcaccttttgttggtcaaaaggggagcatatgccctaagctttcattccttcctgccttctctcttcccatatactccctccgtttcacaatgtaaattattctaccatttctcacattcacattgatgttaatgaatctatacatatatatctatttagattcattaatatcaatgtgaatgtgggaaatgctagaatgacttacattgtgaaacggagaaagtatattgctacctttgcaatctgcaaataagaaggcaggtagggtctcctcaacacagccaaatttactctcagatatttaacatgcttctacactacctgcaagactgcaaccattgtgttcatagcacgaaaatgcatttcattttccagagcgctggccgctgagggagctatgaacttttttccccgatctaaaactgaaatgccattccagtaaagccatgctacagtaaatactagcacactaaatcgacagcacggtagatcaacgcgatgaagtcttagttcttcctcaaatccaacgatagaacgcaggtcaagccaaggccgtgcaccgaagaacggattccggacgagtcagtagcggcgaatcggagggcaccaccgaggcaatcaggaattgggggaaatagtaacttgctgcgcagaaacgaacagcgggttttcacctcgcgtcggggcctcgagggagagaagatcacctcgtcggagaagaagcttccgacctggtctgtagcggcggagtagctcgccgtcgccggagttccggtgccctggacccggaaagcaaaagctttgatttaggtctagttttgtttgggccttacggcccgctcgctgtaatggatccgacccatctgcaaggagaaaatggacatttagcccagttcaaaacagggtttcgctagattgccatcccaaaaacgtgtttccctaaaatgctaatatgaagcgctcgtactcaccgccactttgccattttagcttttttgtgcattttcgaaatcattttcgcttcttcagtgggtaatgagacgaaattacttccatccttccccttccgtggtgg

SEQ ID NO: 64765 - DNA, 8676 bp, Oryza sativa
ccgctcgggtcccacccgtccatgtgcgtgtcgaactcgacggcgacgaagctgccggcgcttgaggcgttgcccatggtggcgctcgccgtgttcctcgtcaagctctggtcgaagaggccgaggcatccctcgtagcactcctgcggcatgtcgggcatgaacggcgcgaggaagaacgtcatgccgtggccggcgagggcgttgcccctgccagccaccgaccggatggtgaagttgaagctcgcggcgaagctggcctcctcgccggtggcgccgtcccagagctgcaccggccgcttgtacagcgcgcgtcccctggcccgcgccgcgaactcctcaccgagcagctcgatccggccggcggtgaccatggcgtcgtcctcctgcctgaaatcttcggagacgaaggagtccgcgtcatagctgaaggtgagagaggtggcggggacggcaacgagcagcaagtggagcaagagtagtagtagctgctgctgctgcggcggccgcggcgttgctttgctgcttgaggaagacgaagggtttaggaggacagccatggaatggtgctaccgtacgtggttgcagtgcagttgcactgccacgatgacttgttcatacgccctaattagttaaccaggcatcttgacttactgccacgatgattttgatcgcagttagacagttctcagttgggtcccacataattattaatttccaacaaaagttggagattacttctgtccggtcgcctgaggtcgacaccaaaattcggagaccagaatgctcgcgtgcttgcataatgagtctgtagagtactactgctacggagtagcaaagcaaatagacaaccttattggtgggtgtaagggcattctcaatgtacatgtaacaatgggtagtaatataacggtcgggctcagtgaaaaagaactagctataacaaactccacaatggttaaaacctatgggaggaaataagatgggtcccacttagtcaaaatacagtgcttctttgaagtcttctactacctccatccctaattagtgatcactttgacttttttcttataatgtttggccattcttcatgtatgaaaaattaatgcaaatataaaaaataataagttacactcaaagtacttatgataataaagcaagtcacaaataaaataaataataatttcatatttttttaataagacgaatgaccacaaattataaaaaaaaaactcaaaacgacaactattttaggacggaggtagtattactcaaggaatgaattgactccctcctttgtgcagtacttttattcttttttttttctcttgtgaccaagccataagcttacggtcaactttagcatttaatggcctattgttacgttccacaatatttaaggctgagatcatttggagaatatgggaacaaatctcctacgcatagaaaacggagtggtccattagcttgtgattaattaagtattagctattttttctcaaaaatggagcaatatgattttttaagcaattcttgtatagaaactttttataaaaaatacactgtttagccgtttgaaaagcgcgcgcgtagaatatgcgggagaggtattgggaacataggctgccgaacacaacctaaggctagtcacaagctgccaactcaaccttatgacccttgttatgttcacattggatgccctatgttttcgtaaaatgattttatctcatatgttacttatccaatcgattattcgattataccgttatttttgtcacaattaaatatttacaataagatatcactcaaatatatttcgatgaaaaaatatacatgtttcgatagttgaagtcaatgtttcacctagaaactgactatgttaattgcatattttttaagttttttatgttgcaatagttatttggctaatgtttcacatcatgtgtatttagatgtttaaataaatatattatgatatttcactagagcattttaaaatgttacacgtaatggtgttatatgtttcagtaaatattttatgatgtttcaataattatatattaaatgtttcaagtataatataaaaatgtttcaattagaaatatggtatatatattattcaatatatagtcatgtgagagcttgttgtacgatttaatatcaaagaacacaatggtgtaattgggtcacagattgaatcattaatttaccattaaaaatagtttaaagtttgagaaaggtttatattagaaaaagaagaaacatgttgagttacacatgcatgaagaaatacgaaaaagaaagttgttgtattagcatgcatgcagcagaggaggaaaaatcaagaagaaagaagctgtacaaagagcgagcgcccgatatcatattgtttttattggtcgactgatttgttgttagccccacaaaagttacattatcatgagtaaaaaagtcgagtcgcagcacgccacgtgacaggcaacgaaataaaacatatcatggtagtggggtttgagtatgctatgtatttggggtgggtctagcatggcataacatctcttcatgcctaattatgtgattactttttttgtttcttcagttataaaccaaatccatgctgccacacaaattttactttactagattcgttcaattggattctttttttcaaaaaaaatattgggtgctgcatgatcagcatttttaatatctattaaagtttatgcactaaactttctaattgcaaatataaattttattatggacatgaagtctatatagaaacattttatatataaagtctatatattgaaagttcatatacataaaatctatatagaaactctatatatgtaaagtctatattttgggcttcgcatatataaagttaatgtatgaagaaagtctccacaaaaataattcatattaaaaaattccattaatagaactataaaaaagactaacaaaagaaagaaatatgaaaaaaaggaagtggaaaaaacaaaaaaggtttatatgtataggaggatcacgtgaaaagaaatggaaaactgggaatagaacaataccacttcatggttcatcctctaatcatcctcgtatagatccgtttgcgagattatcggtgggtgaaagttcactcacaagccctaccgatgtatttgttgctggtgctaaggatttttcgttggtaatttaaagtttttttcttgctaaattctaagtatccacaaaaataatttgtattaaaaattccattaataaaactataaaaaaataattcatattaaaaattccattaataaaactataaaaaataattcatattaaaaattccattaataaaactataaaaaagactaacgaaagaaataaatatgaaaaaaggaagcggaaaaaacaaaaaagcttgatatgtataggaggatcatgtgaaaagaaatggaaaattgggaatagaacaatactacttcatggcgcgtcctgtaatcatcctcgtatatatagatccattcgcgagattatcgatgggggaatgttcgctcacaagccttaccagtatatttgtggctggtgctagggatttttcgttaatacaaaaacgaaaaacgattttccattaatacaagaacgattttaatgtatttgttttgtgctaatttccattaatacaaaaacaattttaatgtacgaggacccctataggttgtaggcagatcataattggttgcttctgcaaaaatcaacctctattttcgcatgcagcttctcaagaggctcgtatgcaaaaatatattttcgttggtggacctattaaggggccacatgcaaaaatgagcctatttttgcatgcgggcgtcttaagtgatccgcaagaaaaaaaaacttcctctcgtccaaaattttttttctcccctcctctcttttcccacttagccacttcaaatttttttcacctcttctcctctctcttcttttcatttttccacaccctctcaccttatctccttactccctcccccactcatttttctctcctcctctcccacttcctactccaccgctgggtgggagtgatggtggcaggagcagcaggatgctcctcggcttctcctcttgcacagtcgggcgggagcgaggcaagagagacttgtgctggctggcgggaggctcctcctccaccgccgagcgggaatgcggcgggcgggagacgtggcaccagcggatctggttcccccctctccctccaggccggatgtggccactgctccgcccctcatgcatgcggatccagcggtagcggagcggatctggcctgggcaatggtggagcggatctggcacgtccacatgcaaaaattgattttagccaaacggaaaaaatcaatctgtatacatcactcagctttggttttaaacaaaccattgtacaaggaactaatacttcatcctcggagtattttgccttgtgggtaatggcctagctactccttcctatgttgattataccatttttgaaaaaaaaattaacaatgtaacagaacgataagtcatggtaaaaaaatactacagtgggcaaaataataatacttaatttgataggtgaaaaagaaactatagtaatagtatataaagtcccaggaccacaaaaatctagcctttacattttatattttatgataaattagtgcaaagacaaaattcttgtactacgggcagagggagcagctgaatttatccatagatgatgtggatggcctcgccttctactcttgactagtgtagcaaggaaaatttatactagtccaagtctagttttattccatagttggattgagaagtgttaggttggacttgcatgccttttcttattaacacgcgagttttttctacacgtagccatcgatcaaatggatatataccatctttgtttcttcctttcttattttctttcattttttctacaacggaggcatctgttcttttgaagggcctgaatcccgcgacccactcacgtggataggccgagagtccggatttgggccaggttcacggcctgtgtgttaaacaggttcaccctactgatcggtttataaaaaacgaataagctcatctgagatctcttaacttgtcgacgaatccgatttccgtccctcagctggaaaaccaaacacaacggtcccttaactatcaaaaccggtgcagataagatcccttggcagttttgagggcggttttagctgacgtggcgcctacgtggctaatttgacttggtcttcatctgacgtggcactgatgtagcgcctacgtggcaatttaatctggaaaaataataaaacccatgggacccacatgtcagctccacacataaaataataaaaaatggtgggacccacgtaggctccacatgtgatcctctctctcccctcttctccctatcccttctctctctccggctgatggagaggggcgagcggcggtcggcagaagcgggcgtcgcgcggggaggagctgggcgggcagcggccgacggcgggtgttggtatttcttacgtccacagataaatccgcaagagcacggaataccactgtagcacttaaccttcgggtgaccccaaaaggatatcgaactcagggaacgcgtataatctacctaaggctaaggctatccaaggacaacaactgatggtaggtaggctagagaggactttctatgagtgttaattatataagctaagcaaaggtaattttctatctgttgcttcgggcaccgacccctgctggtctgccagcgtggttccggctatagctttatgatgtatccgaatatggaggattactgggacggaatttaaggctgtcaccacctgccgcctatctctgacaaatccgtgggaaggtaatctctaacctagacaccacgtctaagttattaattactactctaatacttgcgcaggaacttccttctctatccagagtcctagtactagagcacttagtacaaatactaaacaatgaacccgcagagatggaaatcttattttacttagacaaagtaattaaataacataagaaaggaacacgaatacttactttatagaagaagttctccgaacctggagcagagtgtaccgacagctccggtactcctccggaattcctcctaagaagctacactcatcgaggtagaagtcggatgagcgccaaacttccgggcactcctcgagagcttcccctcactctctaccttattctaatgaacaaaagatacaatagagtctcttgtaattcagctcaaagttgtgtgttggaaatgagagtaggctcctccttttataggcaggtatgactgttacagcctatgcgaaataaccaagctaccccggaaccaccatcaggaagtaatcagggccgtccacgtcgaatctcgcgatcaacagcctcataagtggttcggccgaacccaggagggctccgttggacctgtttttcctcctggacactaattttgagaccctcagcccattggcatgatggttgggcccatttgcagttttttaattgacttatggggcctccaatacgtgtaaatgtatcctgaatgcacagaggtgcagtttgtcgctcgacggatgtgttttcttctcaaaatacctgtatatacatatttcaccaacactagtggaaataattagtaataatccttaccactaagttggacaccatgttttatttcattatatacaagtattgatagtcagatattatgatttaaggaaaataagtaagaaggagcagtagtagtaggaagccttaagtgacttcgttcatttacgttgagatagacgagtaactacctttttctattttagtcaccgtggtgggcagccatcacgatgagcgattgctgttcttccagcagcgccttcttcctgttttcaagaatgcggatttggttctgaacaagaactatatcatcttgtatgatcactgctggatcgacgaaagccagaaataaaggctccccgaggacacccagcatttgctctagttcgagcttagtgttttctatatcagcgatttcttgaggaatcgctgatagtcttgcagcgatatccatggctttgactctttctttcttgtcccgcaaaatatagagtgcgccgaagcttctatttataggcgagcctattctttagcagaagaatttcttattagaagtcctttttttaatagactgtaacatagataatttgcccagaattcatgtcctccattagtgcgaaaaagaatgaatcccttgagtccggcccccccccgggtatcgacacgcgggacagcgggctaggtcaggtccgcggcacgcggggccatagagcgcagacggcggcgactgccggcgttgtgcagaagggcgtcggcggcatcggcaggagcatctcctctgagtactgaaaccacgacgccgacccatcctccgccatcgccatcgccatcatcgtcgtcctttccggcctcggtggcttccgcggcgcctgtctgcatgacgacgtggccattgcagtgctcagatcatcaggaaaaagccaagataagagagatattcttcttttcttttctcaaaagagattcaccatcaggaaggatgatcacttgagcactagcactatataccagtatgcatgcatggacgatcaatcgataaagaagaagaagagaactgaacagtaaattcaggattggggtgccaaaatgtgtggtgggtgagaggggaaacctccaacctcagataaaaactataatatctatgaatctatctatccagttgacttgttgaaacacacagcaacaacacacaaaaccaaacaaaagacaagaagtagaagaaaaagagatatggatatagtcatgtagtagtacaaaagaaacaagaaactccatctacctttgctgattgattctgaatctggttgtttcagatatataactgtaatctgaaaaaagcctctgcttcctggtgatcagctcacacctgcagctctctctctctctctctgagctgagctgagctgagatgacaggagatgagctgagctgaggtgtgaagtgagtagaagtagagaaggagatgctagttgcaattgcgaaagaacaagggcactgtgtctttttaacagggcaagatgatgcagaaacagcaacagcagaagcagaagcagcgccgtgggtgaactggaggattccctgcggccagccattctcctgcagcgcctccttcttcgcggggagggcggcgatggcggcctccatctcccccatcgtcattcggattgccggcggcggcggcggctagccccggccccgcggcgaggtccgtcgcgacgcccgatgcagccccgccctgctccaccggccagccgctccgtcccgcctgtcgcccgcttttgccagccgccgctcgccctgctccatcggtcggagagagagaacggatagagaggaggggagagagagaatagagagaggagggaggagtgaggatgacatgtggggctcacgcaggtcctacgattttttttattatttcgtgtgtgaaactgacatgcgggtcccacgggttttattatttttttggatcgaattgccacataagcgtcgcgtcagatgaaaaccg

SEQ ID NO: 64766 - DNA, 2129 bp, Oryza sativa
cttagtggtgtattagtcccaggttgcttaggagtgggctaggatgcttggagaccctcgaaaacaaagcggcaagaagacttggagccgagttagactagtttaccttttcgctttgagtttaagaaaaaccgtactattaagaggggttccaagtgtggttctaagataacacaagtgctcttagtggtgtccaagtgttgaaatatttttaggagctatttttgaaaatggctctacccgggacagagagtcccacccggaggttctgtccggaacttcctggcgccaaggtgaggttgaaaaattttctaagtgttgcccggaagttcctagcacccaggcccggaacctcctagcaaccctccagttcaaatatgtgagtaacggctagatgacgtcacctagccgttatatatagccaactcgactccagctcattctttggccattccactttagttcttgtgttccctagcttgttctagcctctcccaatgtgattttgcttcccccacccaaatcttgtgtatttcttgagtgagagagtgattttgagggtggtggtgaggattggagaaggttttgaaggctaggatgacttgagcacttggggtatctcgttgggctgtcatttggagcttgttactcttggagggtgacctcctagacggttaggtgtcgcccgcgagtttccaacaaggttgtggattgacccgggcaagtttgtgagggcgttattccacctccgaaaggaaacggaatacacggggagtgaattccgagctgaggtttaggaggtcgtcttggtagagcaagcctcacttgtggtgttcttttggtgttcaagttggggatcttagtggtcacttgaaaccaaagagaagtacctaggggtgttggcttgaagaccggagacctcttcctaggccttttcttggtgaggcaaggggttaatcaagacccggctctttgaagctcctcaacggagacgtaggattctcagtggagaatctgaacttcgggaaacaaatcgtttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttagacttccttgtgatttaatttacttattgtgaggtgctcgaaagagtaactcacaactccccggaagttcctaggaagaaccccggaagttccgggcaactttctttgctcagcataaaaagctgccaggaagttccgggccttttgccaggaagttccgggccctgattttaaccgctgcaatttgaagtaaattataggaacgcctattcaccccccctctaggcgacataaaggtcctttcaaggctcgccaatagctactgctgcctctccatcgcgtcccccttcgcctccgtcaccggcgaggccatggggccgcctcgaaaccctagccaccgtcgtcgaccgcggcgaagcgacctcgtcggagaccgtcggcgaccgcagcaaggtagtcggcggaggtggcgaggtcgagggaggggaagatgtcggaggacttgccggccacctcaccatctgggctctcccatatagcaccgttctggatgccatccatggaggaggacgaggaggaagacggtgagctgctcgtggtggacatggagatggccggcgaggacaagctcctcttcctcaatggcggcggcggaggacatgaagggcaattttgtctcatcatctggtggagaagcgaaaatgatttcgaaaatacataaaagggccaaaatggcaaaatggcagtgagcacgcgtttcatagtcattttagttaaacgcgttttcggaatggcattctagtgaaaccctgttttaaacgtggctaaatatccattttctcatctgcaagtggccgttatgctgaactgaacccagttttgtaccatcacgcatttgaagtattaaatatatactaatagcaaaacaaatttcgcatgtaaactgcgagacgaatttattaattaagcctaattaatccatcattagggg

SEQ ID NO: 64767 - DNA, 8228 bp, Oryza sativa
ttttcggcaaatcaattcgaacaaattttctcctcgaaatggtaattaaggtaattatccataaaattttgtatttttcggacaactctctacacaaattattgaactgtcaaatcaaataattttcaactaaaattgtaaaattttcaaactcaaatataagaactttcatgttcataattacctggggagagttgaaagtttagtttagattaacccatcagagaaggccggcctgcattccggacgcatgcatgttacgaggaataagtccactttccggctgtaatttttatctcgaatttaatttgcatccctaaaccgcaatacccccaacttacaaaaacagttcaaattaagtcctctaatagtatggaaggttagttttactgatatggcaatttgacctagtccactcatgttgactagactcttacgtacgtgacaaaaatgaaagtggcccaacctatcattctaactctcctactcctaccttctctcttccccctgctctctctgtggtctcctctctccctcctcccctctctctcccctgcactcagtctctcctccatcaaggcatcacggtggtgatgacgaggtgaatggcggaggtggcgccatgtggtggtgtagcggtgtagattggaaagacaatggttccgacatgagtccagaccagcggtgtcgaggctgaaactccttggttgacgccggtgttggtactgccgtcaggatggtttgaagttgtattggcagatccttaagcaccaagccctccctacctggcgcgtcactgtcgacgagtaatactcatggaccggatgatttgagtattggggtacgttggaacagggatttgcgttgtatgacatcaaacaagcaaaagagacagattatactggttcaggcccctcgatgggtaatagccctagtccagttagtatgggattatatgaaaataccacatattacaaagaagtagacgaaactgacgattccgacgagattgtaatcgatggggatcaacgagatctcacggccacttggctccgagtactccggcttcgtaaactatgatgggtgtgttggcggttttggtcgatctcttccacccacgcctaggggttccttttatagcgtggatcatcttaatctctaagtcaaacctcgagacatcggatctggtacgatataacataaaccttatcctctccaagtagaactttggaaatcacttgactcgtggagatattttccataattagagataaactttcttaatgtatacgtgaacgaaccgaatgcgcgaaggtataccgtatatgtatattcgatgagtcgtaggataggaggcatgccttatccgtaagcttgacagcagccatggcggcgaggaggtgggctgagggcgtatattcgatgagtcgtaggataggaggcatgccttatccgtaagcttgacagcagccatggcggcgaggaggtgggctgagggcgtcggctgcggcctgtggcagcgacgggaaggcaagacgaggcgacgccaactaggggtgtcgaggaggtagtggtgacgatgcagcactagttgtgggggcggcgacgaggcaccaagcaatgctctagccgatgatgtggtagccatatctggcaaaggccaccaggttaaccctccccaccggtagcatgtaaggccgcagttgctccgcctcaacacctcgtttcacgcgcttcaaccagccttcacccttcatgcaggacggatccaagaggtaggcttcatcaggctcgagcctaccatctgatttttgcaaaaaaaaaattaattatatagcatctatcccatgggagtagctggagaaggcttggagaagagaagaggtgaagaactgtctctgttggcgcgaggaagaagatcaggagcgatggaggtagctgaaccggtacgcagtatgcataaaatggcccatttatcactttagcaaaagcccacttggcccatttgtctattttatccattgacttagggttttggagtctggaggctgcgtgggcgtggctgctggccttggctttgccctgtggggatttttttttgtggaaaaagtacaccgaaggtccctcaacttgtcatcgagttacaaaatcgtccctaaccataaaaccatatatatgacatctctcaacttacaaaaccgttcacttaatgtccttaaatggttttgaccccggttttatccgacgtggcagctgagtcagcgtgggacccacgtgagccccacatgttaggattcagcaccctctcttttccccctccccttccttcctcctctctctctctctaactttttctcttctccgggcaatccggctggcgggtggggagaaggtcactggagcgaggtgggaggaggtccggcggccggtggcgacacggacgcggttacatagtatttccctccggaataacgcggcggcggcaccacggactcatgcgatccacagtaggagctcatgcgggaaagcttcctgctcaattcctaagcttggggcgccgtggcgaattcgtttgatgagatggagggtgagttcttggagtacctgaacgtggtgcttcggccatggccgcgtgtggccgcctataggcggtcggcccccggcgacggcgtcggagatcgacaatcgcttcgttcagagatgttataaaaatcgatgcacaacggagacacaaattttacgtggaaaacccttacgggaaaaaaccacgggcgccgactggcaatcatcattatagaggagttgattacaaacgtaggggaataacaatgggaacgtcaccccttcctgtacggcttacaagagtatatataggggataaaagaaagacacctaataggatagacataaagtgctactaggaaactaatccgaatatattgtgggcccaaaattcggatcacatatttaacaagaaatcaaaagaacatcgacaccgtactgcgcccatcgattccgtcaagggcgccgttaccaagttcggatgaactgttgattggagagaagtaaattacatcgatctccattgctactgatcttgtcttgtggttaagcttagacagtgattagcattttgattttcttgtgatttgcccgtttctagtgtcgactgctgcgtgcagaggcacaaacaagtgcagggtgagcttgacctggtgcaggatgaggccaccgagtgccacaagagatcagaagaagcggaggccggcaaggcacatgcggtgaaggacctaggcggcaccaatgcgccttcttgatgagctaagacgaagcttggagaaggcgcaagccgagaaggcacgagcacggcaagacatggagctcgccgagctgcgtctccgagagacgcagcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctgactcagccgccacatagaataaaaccagggtcaaaaccgccgaaagacctattgtgaccggttttgattagttaaggggcaccggatatctggttttgcagttgaggaatgattttgtaactcgatgataagttgagggaccttcggtgtactttttccgttttttttggcgtcgagccgtcgacggcgtgcgattgccaataagatatcagacgattggcttaatgatttgatggtatgctatactgagcgagagatattcaaaagtattgatgataatgcaatcatgaagcgattccaagccttgaaaacccccaaaatatcctttcctcgtgaataaattgtaacagcttagtggtatgtggtatgttgcttcttttagttagcatttgtttacttctaccatttatgcaatactaattttgctcatttatatattcaggtggctgctcactttactctttgctaaggcccaagaaaattagcatcttaagtcaaggactcaaggtattcttttataagtatatttttctattaaatcatgtaagtgttacatttgaattgataatggcatgtgccttattttagcattatcaacttaaatttagacttctagtccagcctatcctcaatttttatcctggattcgccacttgggctaccttacactagtacagatccttccatctgtgacggcccataacaagactggaatttgcgggccgtcacaaggaagtaatttcaatcgggccgaagtttcgcccgattgagatatggtcgcacagccatggtatatcggcataaaactaaagcccatcacggatgacacttatctgtgacgggctatagttgaggcccgattgagatgagggtaccatatctcaatcgggccctaaaagaagcccgtcacagatgagggtcatctgtgacgggctccaactagaggcccgattgagataagtttattgcccgtcacagatgacactcttttttgacggccttttattaaggcccgatagagattacttgtatgcccgtcatggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacatcttacttttgcaatactgatcttataatatgtgcctctaatttgttttttttagcaattgatcgaagttggatgtatgccaaaaaattgaaacgtcattgtacggagtaccgaaagggcgtaataaattttatgaacgccgcggaggaggatcggataagaagaaacagtgattacatttgttgtccatgtgcagattgcaagaatgagaatatgtttgatagcggagaggacgtacacggtcatctgatacaacgaggattcatggagggctatacatgttgggtgaagcatggagagcaagaatcaggaagtggagcagcagcagacagaagtgtgtgcataatcaggaagatgaaaatgagcatgacatgtttataccttctccattgggcggtgaaatggttgatgtggatcacgatctgctgcaagacatgttacgtgatgttgaggacctagcccagaatgagagagatggaatgaaattcagcaggttggtaagtgattccgagacgcctttgtacgctggatgcaaagcaaaacacactaagttgtcagttaccttgaacctaatgaaggtaaaggcaagtagtggatggacagacaagagtttcacagatcttttaggaattttgaaggctatgcatcctgttgagaacacattgcccgagacgacatacgaagcaaagcaggttctgtgtccactggggttagaggtccgtagaattcacgcttgtcccaacgactgcatattgtaccacaagcaatatgcggacttggatgcttgtcctgtctgcaaggtttcacgatacaagcgaaagaaaagtgctgacgaaggaaataagtcaaagaggggtggtccggcaaaggttgtgtggtatctacctatcattgatcgtttcaaaagaatctttgccaacccgaacgaagcgaagttagtacgttggcacgccacggaaagaaggaatgatggtatgcttagacacccagcggattcgattgaatggaggaatatagatcgaaaacacaaagactttgctgccgaccctagaaacatgaggatatgtctttgtacggatggcatgaatcctttcggtgacatgagtagtactcacagcatttggccagttcttattgcgaactataacctcccgctatggttatgctttaaacagaaatatattatgttgtgcttgttaatctaaggtccaaggcaacccggcaatgatatcgatgtattcctggagcctgttatcgacgatctggagattctttggaaagaaagtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatccacgaaaccggtggctgaagaaatcacgaaagatggtatacatgggtcaccggaggttgctcccggtacgtcacacatttagaagaaagaagaaaatttttaatggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgcgcgccttgatctacaggacatgaatattcgcagcgaactccagcccaaacgagatgcagagataggtaaagtgtacctccctccagcctgccacacactgtcggaggatgagaagatcgcaatgttatcatgcttgaaggatattaaagttccatcgggctattcagcgaggataagtaagtatgttaaattggacgatctaaaacttgttggaatgaagtctcacgattgccacgtgctaatcacacaaatcttgccagttgctatcagaggcattctaccaccgaaagtgcgtcacacgatccaacgtctgtgcgccttcttcaatgcaattggacagaaggttatagatcctgaagatctagatgggctgcagaccgatattgtgaataccctctgtcacctggagatgtttttcccactgtctttctttgatataatggttcatctctctgttcatctggtgaagcaaacaaaactatgtggtccggcttttctaagggaaatgtggccgtttgaaaggtacatgggagttctaaagtcgtacattcgtagcagagctaaacccgaggggagcatcattaaaggttacacgaccgaggaggctattgagttctgtgtcaattacatgtccgatgccgatcctatcggagttccagcgtctcgtcacgagggaaggttgtcaggtgttggcacaattggaaggaaaagaattaggcccgatcaagcgtcgtacgtgcaggctcattatgctgtgctccaacatatggcagaagttgtcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacaattgttggggatgggaccgtcttggaccatagacacatggcaaggatacgatataaatggatacacattttacaccgtcaaacaagatgacaaaagcacagtgcaaaacagcggcgtccgtatagatgcattccaggatcaagttgggtcaaacacatactacggccgcattgaggagatctgggagctaaactacgtcaagttcaaggttcctttgttccactgccgttgggtgaatctacgcactagtgtcaaagccgacaaggaaggtttcactttagtagatctatctaaggtgggatacgccgatgaaccatttgtacttgcgaaacaggtcgagcagatattctacacaaaagacccttcaaacaagaagatgcacatcgtgagggatggaaagcgccaaattgtaggagttgacaacgtcgtcgatgaagaagaatacaaccataatcttcatgtaagacctcaca

SEQ ID NO: 64768 - DNA, 2668 bp, Oryza sativa
acataaaggcggcagtattctactagtcttgtgcatcgctcgctagtggtagtagtgggaggagtgacgtccgaataatcctccctcctaccgtgtgcccaccgcgtgcctttgctttccctccagcatccttccttccttcctctatttctacctctcctcttctccttctccttctccatctcctcctcaggacactcctctcctctgcttctcttcatcccattcgcatcagtgctcagcgacctaatcaagatctttactcgaacagaagagtataagtccagcaccggagaagcatctgattctgaattcggtttgctgctgcctggggagaggaaggttaggttcctggctcctcctgactgacttaatttcctttcgctgtctttctccaccaggtgtggtgcttgtcttttgtgttcatgtgtgattcaagtgattcttgtttggtcggtctctgcctttttgttctagagagatctcctggtgctcttggggcactctctgctcctgttatactggtgatggccttctctgttcttgtgctgaaatcctgcttgaatcaacagagtttctttaggttttttttttttgattcttgattcatgtgttgttcttgaggaagaggtcaggagagttcagttgggttggagccattggttgttgccatgcatctttctcttcttgatttttatgtgtgtgtgtgcagtctctttctggatgattctgtactggcagtttgtggtacaaacaggggaagaaaccaagatcggcttcttaatgtgtagtaaacaaatttccagtcttgctggaagttgacatggttaattagagaaaggaaacaaattagagttagttttagtaaatcccaatgattccttcagggcttgtactgcatgaagccaagaatctgatagctttcaccacattagatttaacccagatatccaataaggagaaagagcatgcaaaatcactgttctttacttcttgttttctacagcagcaataattttgccatgaaatcgcatagctgtcatggcgattctcttctcaccaaccaaatttagaacagaaacccagctgtgttttccccccttttaattttaactcttctgtgaattcaccgcatgatacacgccaagaaagtgttttaaatcgctagctaaaaaacatttagcgatcggtcttctcaaacagctaatagccgattgaatggggctgtagcggctaaattctacatgaggcgagaaatagctagagacaccctcctcgaacagctatatctgaagatagcggtagctatagccggagatttaagacctcgcaagaaacagggatggtgtcacatggcataggcaagaagagtctttcttcttcctcctactcgccgccgtcttcgtcgtcgtcgccgcctcggtcttcatagctcggctgcaatgtctgatcgtcgtgcgtgtgcgtaggattcagctgagtttggttcttagtggattcgtttgaaattggtgcagggtaaggtttgccaagacggctccgcggcggcgtctccggctaatctccggtcactctggccttccccgtggcgccgccgccgcctcgcgccgtgagtgaggtgtgtggtgctgtggggcatgcgatctcctccgccgtcttcctcctcgtctcgccgtcgctgctccggagagtctctcccgtagacaacggctaaaaggtctcagaaacttactgaaatttggaacgaattcgtctgaacagaagaaaattcgaagggatttgcgagttttgagtaggtcaagatgaccaggatgaggtgcatcccgggtctgctcgccggcaggaggaagaaacgagtggtaaatgtttgatcgaattttgcctttctgtttttgtgagattttggttttgagtttgtaatggttggtgagtgttcgacaggttgctgatgccaagaaggctagtggggattgtcccaaggtgaagccggtggagttcatcgactcgccggcctccgaatgcggcgacagaaaggtcgcgccgtgcgatgtcaaggtcgtcgtcgacgacacggttgtcaccgccttggcggcgaccaaaggaggcggcggcggcgacgatcatggcggcgacatggcgttggcgaagaggggcagcatgtcgtctgacttcgagttcgagttccacgcacacgagaagcccgacggacatggcgtccccgccggcgcctcgccggacgcggtgatcgcgagcgggaaggaggtggtggtggccgacgcgtcgccgaagctgaagcggtcgtgctccaacatcgagacgaagcggccgggcacgcacgacgcggcggcggaggcggcgccggcgcggtcaagatcctacggcgacctcgggaacctgcccggcggcggaggcggcggcatctccctggagacaaccccgcgcggcgcggcgccgcaggcggaggcgagcccggcgtcggtgaggacgtcgcgcaccgccgaccgcgtgatgctgaagaagcgttcgtcgagccaggtgctcccgtcgcggagccgcaagctgtggtggcggctcttcctctggagccaccgcaacctgcaccgcccgtcgccggcggcgcgccccgcggccgccgcgtgcacacccgcgggccaccacggcggcggcg

SEQ ID NO: 64769 - DNA, 4013 bp, Oryza sativa
aatatcccaaagtctagagttgtaaaatcacctaatgttacctaattaaactgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgatattgcgggaatttaaataaagcgataatgcaataatttaaatcaacataattttacaaactgggattcaatatgttcaaagatgatgtgacttgtcttgctcgctttcccaaacgtcggcttcaacttccacgaagagcggatcttccgaagctgcaacgtctacacgaccaacggaaaagaaaaggcttttactctaataaactccatataacaagcagaaacaaagcacaaaaatgggttcttgacttcttaagaaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccgcggtggaccaggtgcacgcggcttgcgccggccggcgccgtgggtcccacgcgtcagccgcacccgcgggcgcgggcggctgacggccgggccccacctggcagccgcggggcgcgcccgaaggcggcctcgccggcacagccgacgggaggcggcgcacccgcgccccgatggtcgccgccggtgaccaccggcgcggcggagcggcgcccgagagaggggagggaagggggaaaggaggcgacggtccacggctcaccccggggcgacggcggcgacggaggaggcggccggagcggagggaggtggtggcgcggctcgggtcgacggggacgacggcgctccggcggtcggcgaccgaaacggagaggtggacgaggtcggcgaggatgcggcgaagccgaaggaggcggcgccgaggtgggaggcggtccggggtgacgacggcggcgggccggagcttggcggcgacggcggagagagagggcgacgtcgcgagctcaaatccggcgaggaggaagggcggcgagaggcggaaccggacggaggaggtgcggggagggtttaaatagagccggggcgagagagggtggccggggaagggaggaaaccggcgcgggaggtcggccgccatcaatggcgccggcgagatttgcgggggcaaatccgcccgtttgaacgcgggagagagagagaaacggggggaaagagagaggggatcacggggaataattccccccaccctaatgcgcgcggggacggcgggaggcggcgggattcacggcggcggcggcgctagggcgcgggcggggcggcgggagcgggggaggatagggatggcaggtgggccctacccgtcagcgagggtggcgggcgggcccgcccgtcagcggcgcgcgcgcggggagaggccgagtgggcccggggaggaggagagagagggaaggagatgggccgagccggcccaagagggggagggggggggaaaagactttttagggtttttctttttacaaaatcattttaactttgtttatttcttaataattattatttgtgctctgaaaattccactaaaatttgagggctccttttagaccaaggagaatttaacaaaaattctccgggccacatttgaatttttcttatacgcattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgtcttctataacaaacttgcctaacaaaacttctccactctggactgcttggctcgatctcctgttgcaggtggaatcttcttttcacctgactcgaaccagggtgcacctttcagctgacgcagactaggttgcggtagtttaatgatgcttccgttccggaacttctcacgattcatatcttcggcgtcaacctcacacaagttatcaacttcatgtcatgtgtcgtaacctgcttgtcatcatgagaataccatgcttggcgtttccttccagcttaccaccatatgctttagactatgatatcccgcttactaaggataccatgattgacaacttgccattaactgtctcatattagctttcctggtctccggtgctaggtacttctgctattcgatgcgagggtcaaccactctaactataagttatgcttcccaagagaaccaacttatcccactggatatactttgacgtcttcccaactggctttactgctggatttgttattgtctaatcattatcctgccaaatctgaggcttcgttgttagatgtgattttaacctgacctctgtaggttatcttcgaacatatcacttgattcataactgggaatagctctcacgaacaagcaactcggattcactttctttatgttcagtttactttccactatcctctccatgttgtcatcatttagccttcaacgtattcctttgcacctttaaccttgatgtgttccttcccattggatcatctcccaagacatggcattgcctggtaaccggtgcttgcacttttcactccgtgtagcatctgataccgagttgaagatttcactccttgccttcatagaaacacttttacctaggtcatcttgcttacttaatgacaaggtgactgttgcggggcaattactatcaggggtcttccctgagcgatgcagagcatgtttctgtttatcaatcacctttcggcctacttctttcatgctagagaacatatttgccaatctcttttatcaatcttctttcggcctatctctaacaggtggtattctttaatgtggattgcggacgcttctggggacgatgaggtcctttggcttgctgcctttcagtgaaaccttgatgtggttcgtcaaaaagctgcactgactaccttcagggaaatacattgcttgctatctgtatctatgccactagggttttattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaatatagttcctctgacacaagaccctaggtctcctttgtcagtaaacaattatacacatgatcacatatccgcatcttccaaaagaatcctcttagaacttgtctgtattacacatttctcccttattacacgaacacaaggcactgccttaaacaaaaagggaaggtgcttatcatcggtacattgtatcctcaacattaatcatccataaacatagcaagctcactgtttatagacatgaatatatttatttattacatgattgctgcaaactttcgattacgcaatgataagtagcgaactgaaaaccacaagcgtggctgctcattttgattctggagagatatagctggcgttgttctagtgactgcatcatccttgattggttctgtgatgatgtgataggactgcacattgc

SEQ ID NO: 64770 - DNA, 7561 bp, Oryza sativa
atattacatgactttaaatgggaaagccataaatagctaacttgtacagctaatcaagatctacaacttttattttagtcacttcttcatccgacaaagtgatagtaccaatgtttacaaaattgacatatctgtgttaatatttataaaccagatgagagaaatgtgatttttgtgaataatataactatcactttgtcggatgaagaagtaaccaaaataaaaattgtagatcttgatgagaggatcaactttgttgttgaccatatttccatttgaaatcatttagtatttacaaatgttgattatatttgtcatattgtgaaaatcaatttcaagctgttagaaacaaagttatatagataaatgaccaaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacaggccctacggcaaagcccgattgagatgactcatcactctaatataactagggtttctcagatcggatcgaaaatttttctaagtcccgctacagtttcccgcctccttagaaccctagcgccgccgtcatcctccctcgccaagcccgccgccgtcgccaccgagcccgccgccgtcgccaccgagcccgccgccaccgcagtcgtcctccctcgccaagcctgccgtcgtcaccaccgagcctcctcggccctccattcagacctccgccgccgagcctcctcaccgacgaccctccccccgagcaggaagccgccgccgccaccgagcctttacaccgatcggaccagtgttggccttcctcgtcgtcgccgcccgcgtcctcaccgacccacgtcgccgacccccatagagcacgacgccgcccgcccggtgccgacctgcccgatcggcgtctccaccgaccggcgccgccctccaccgagcccgggcgccgccgagccccaccggccatcctcaggtgagtcctccatcgcgtcgccctctactaactgtgaatgacatgtcattgaaatgtggatgtggatgatatgtgattgaactgtgagtgagacatgtcgatgttgggatgaaatgtggtgcatttatgaattttgtgatagatgattgtagtaattgatgaaatgtggttcatttaactttatttatatgcaatgtggttcatgttgggatgaaatgtggtttattcatgttgggatgaaatgtggtttattcatgttgggatgaaatgtggtttatttaagttgggatgaaatgtggtttatttatgttgggatgaaatgagatttatttatgttgggatgaaatgagatttatttatgttgggatgaaatgtggtttattcatgttgggatgaaatgtagtttatttatgttgggatgaaatgtggtttatttatgttgggatgaaatgtggtgcattaatgaaattattgtgaaatgtggttaatagattgtaataaattgtagcactaaattatgtttttttttgtttttttggaaaaaagtagataatgtctcagcaaggcgaaccaatgtcgacgacaactagtgggtcctcaagggcacgtactcctaggacagggaacaaaattcctaaggaacggttccgcataacagcggtggacgccgtagggttgccgacatctccaaggaaaatattgagccgatttaggtctatctgcggggtcatagggaggcagaaattcagtattctgtaagacgacttcaagctcatgccggccgcagagaaggacattgcttggctaatgttcaaggagagctttgattatcctgcggagcatgaggaccgtctcaggcgggctgctttcaaggttatgggcactgcttggaagaacttcaaaactaagctagtcggcgagttcgtctacaacccggcaaatccagatccaagagagaaatttccttggatcacagaacaggtctgggaggaattccatgcgaagaagtcgacccccgagtccagagctagaagcgaggcatatcgcttgctccagaccaggaaccagcatccgcaccggcttggtaccactggatatgccggtaaggaagaggaatggcagcgtgaggatgaagaagcggaggaatcgtgcacaccgctcgtgtttggcgatatcccacaccctcgggctaggaactgggccagggctaggtaccagaaacatgatgatggcacaatcttcatgccaaatgcagaagatcaacgagtatacgaagctatagtaagtgtctagtcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcattgggtcttctgttccttggaagtatggatttccagactacgcgtggcagtacaagaagcggacttccaacaaggcggagaaagatgcacaccttgaagccaagatccaggagtcgatacgagctgagctgacatctgaattcgacgaaaagctcgagtcgatgagggccaagattaggcaagagatccgagaagagcaatagatcccccaggccgtcgttgctgctgcgcacaaagagttaggaagtcccaccgaaaaacgcagcagttgcgcatcaactgagttggcggaaaatccaacatcggtcgacagcgccgtcgaccacataacggtaaccgtgaacttactcaatacatgaaagacgtaacaaatccatatgatatataatattctaaaaaaattgattaatctatcacaggaaccaacgagctgcaccctcacagttagggtgatgccgaccttcactgttccagcagccgagggacttgcgtacaagccgaccccagagacaagagtgcatggagcgcaactcagggccgactgtgcaaaagttcaagtcgactcggcgaagcccgaatacgagctgttccctctgaagtatctaccaaacgacgaggtcctctcactaggaaatgcccgtggtaccttcatccaatggcccaaggacctcattgagatcaggttacagcgaggccaaccactgcaccaggcggtcgtccaccaaagagacccgcttctactccttcagcccctcctgctcaagatcgtcatgcacaatcttacaatgtgtagttgcagtacgatacggattttggggaggaccgaacggaggccgacagcaaggcgattaatgaacccccaccgatgaagaagagcaggaaggcacactcttccccttagagaattactctcgataaacccgaagcaaaggggtgaggaaggggaggaaaggtgcaggcctcgcttctagctccaagaaagctagatctgggcaagagccaggaagagactaagggcaaagaggtcaagaagaaatacgtcgctccacaggagttccaactaggcatgccattggttggagatgacgtgcttcccgcaatgggcaccgcttgcaaggaccttcacttatactacatggagaaatctaacgccaggaagccaaataaagctaccgatatccttggacagcacgatggaaagccattccttggtccaacaaattatatcgtggtcgacttcaaggatcttttcgacctctacaggctccgagcggtggacacaagcctccttaagtgctactccttgtaagtattgtcgcccaactcattctggtaataacaatcggtttaacttgcttacaagatcgttgatcctgtgtgtaggttaagttggcaatggtgtcagaagcatgcaccagaagttgccttccttgatccacaagtggtcactgtcacaaatctccataatgaccgtcaatgaatggtcaactacatctacgacaccttgtggtcccgccgagacaaggagtacattatgtgtgcctataatcaatagtaagtgtgttaactaaatatacacaacagcatgacacattccttgagtacttaattaactttcactatattaatgccgcagtgcccattggatccttctggtcataacacctaaatggagtacatgtcattacctgaactccagaattgataagaacgcatatgattggaccccaattcaactagcgatagatgaagcgtgggcccaatacgtgcaaagaggaggcctcaggaagacaggacatgacaccctcatccacaaaaaagacttcccggtgaagcaacaaataggtaaccagtgcggattccatgtgtgccacaacatgcgacttctgtatagagaaaaggtgaagactttggctgagtttgaggtcggtggtctcaattgtgatagactaactacattttagtacttttatatgatcgatcaactaatctggatttatgacaatgtagggcacaataaccaagtctctgactaccagctttgaggaggttcgcgaggagatagccagcttcatcctccgcgaaataattaaccccaaaggaatgtttaggcttaaactaaaatgatgaacaatgttgaacttctatgtttaggcaatgatgaacacttattatgcaactgtgatgatgtcactgtgatgcttatatttatgtatatattttatatgtttatgttaagacttgctaaataaatatttgatccaattaactcggttttacaggtaaaatatgataaatatttgaatggatgtgaaatatgtgaatggatgtgaaatatgagatggctgtgaatgtgtggttgtgtgaaatatgttgatgtctgtgtatgtgaatgcatatgtatgaatgggtgatgctggggagctggggatattggatatctgtgtttgtttctgttatttttacagcgggcatggctagcaaaggccagaggctagccaaaaaacaatttttttttgtggattatagtcatctgtgacgggccataactaaatgcccgattgagatgaggtcatctgtgacgggctctagcttaggcccgattgaggtcactagtcatctgtgacgggctctagttttggcccgattgaggtcagcagtcatctgtgacgggctctagtttaggcccgattgaggtcatcagtcatctatgacgggctatagtttaggcccgattgagatgagtatcatctgtgacgggctctagtttaggcccgataaaggttagtagtcatctgtgacgggcgctagttgtggcctgatagagataggtcatctgtgacgggctatagtttgactggtcgtctgggtcaaagctatcggtgacgggctttacttagggcccgattgagatatattcattcgtgacggccgtttgcccgattgagataactctttacatcagtgacttctagcctgtgacggacgctgtgcccgattgagatggggcttaccgcccgattgagatgagggtatccgttctagtgttagaatcttatgcctctgcgtactagaataccacgtcaatcaaaacaaccatccatgctgccttaggattttatgtaacaggttttttaatgttggggattcaacatttcatgtattggggttgaaggatataatctaaacttgatgtaaaaataaaagacttaaagtgaagttattcccatgttacaaaatactccatccgtttcacaatgtaagtcattctagcattttccacattcatattgatgttaatgaatctagacatatatatttatctagatttattaacataaatatgaatgtgagaaaagctacagtgacttacatcgtgaaacggaggaagtaggaagcatctccactccctcactggaacagcctattgcactacgtactgattcactcagcccatgttgggaaaggggaagcttatggtggctgtccaaatcttatggtaccaccaaggcaccaagcgattttttgagagaaatattttttttttgtgagaaggcaccaagcgattaatcgggatatggacaagctgaatcaactcctttttaatacagtactggtcctaaagtgaacgtgaggtccgtaggttgtaggtgcgtgtaaggaattttgctactatatataagcccattctacttaggtattttttgtaagtcgtaacataaagtcatggtgaaataaaatagaagaagaatagttggattttttttaattcaagaatagctggattgggcatgtaacaatatttacggaatatgtaaattgaattgagcccaagcgaagcttatactcctactttttaatttacttctgtgcaatccaagttatagtgacatcctggtaattaaggctaagcagatcttgcctaacaaagagcatttaaaatgcagctaatccaactcaaattaagcgttcgaaccaaaatatctcattctatttataaaataaaagaaagagctagcgtagtttgtcctaaaaccaagattaagcgcacttgaagatcacctagaagcttcgcatgattttgttctacttctccgtttcacaatgtaagtcattctagcattttccatattcatattgatgttaatgaatctagacttcattaactttaatatgaactaggaaggtagcccatgcattgcgcgggcatgtattttattgtgttcgaaaaacttacatagatcgaatatcaactcaatgacattgccatgtttcataagtactatttctccataattttacttcatcggcattgcttagataatttttccaaactatttgttagcttttaaaatatataatatttaattcattcgtataaacaattatctatgatccgtataaacatttgtcatgtttcaaagtatctatttagtttgtttggaaaaaacatatctaacaaattaaacgtaaattaaaagtaaaatattttgtcttgtttaattgaatgtttagtggctttttttaacaaatcctaaagcactattattgttagtaaacatgttttatttgtaccatcaagttagtcctctttttagttggtttagattcacacaagttgttacatacttacatataaattaacaaatacatattgtagaccatcgcttccttgtaatatgtttgacctatagtatttttttt

SEQ ID NO: 64771 - DNA, 2656 bp, Oryza sativa
ccactgtaaatgtgctacagaggatgtacaatgatttgaggtgatgcaatacttattgtcactttttttataatgctctattttttttctatttggttaccatgcaaaggatatataggtgtgtgtgcttaaatggagtattttcatttttatggagtgaaatatgagtaatatgcatcttcaattatttatttaattataaaaaaaataacagttcaaataaactaaaaaacagttatgacataagaatcataattatttagctttgtaattattgatcattttttattattttgttaattagttaaaaattataagatagaggagttgagtgagataggagaagaagagaaagtcgaatgggacaaagtatgtgtacatataattatttttttacatttattgtgttttacttattattactttattaactaaaaataaaataaaagctttattgattgattaagatctatcttttttactcgtcttttcctacatagtatacaatattgaaaatgtgaacattacaaatctactactgttatttttgctttattataatatcataatgggaggagtaaatttttggaacaatacttagtgttattaggttcattttacctttttgtcattacatatctaattgaattattgtgaacttatatacaatgataaaatatatatcattactattcacaattttataattgtttgaatggcacataaaagtcagataatataaccccaaatatgggtctttaaatgtaaaataatcaaaatacataagcaaaaatattactcgtatgatataggggatctcatgattgagatgttatagctgcttatttttttcgtataactcttgctttctaacttatatattttgggaacattactcatagctatttttttagattttatgattgtagatataatttaattcttatgaagttatgcacaatgatagagtctataataatattatttcatatttattgtaattgcttgaacggtacgcaaaagtctggaaatataatccaaagtgtcatttttttcctcaaagttgaattattgtggaattttggtctttgcctgtagatgcagtcataaataattttaagatataagcggattaaaagttagttgtatgatttagatgttatagttgttgaattgtttaacacaaaaaatatattttctaactaataaagtatatgataataggggaagaaatatgtgcaaaaatatgaagaaattgagggatgaaggggtggatgtacgttactaacgtacgcacgtactatccttaagaatccttaagaaaacgtacgctacatacagtcccaatttggatccggtttgggggttagggagttcttttaaagacaaatctaatggtggtaaataatgggtccacataatttaatgaaaattaatgtctagatgtttggttttttcttaaaatttttagaaatttctctaatttattacagtgacacgtggtgtcttagtaagtagcgcttgcaggatgccacatggtggcttagaaaagtttgttatataatagatctaacttaatttgttcatgcatattctgtgaattgatatatgattgtgtaatctacattatcaatttttccctattttatatgacagttttccgtgttatgcaaagtttaggaggtgataaaaaattaaatatttcatataggttaaagaacaccatatattttttaattgttgatagactacgtgcaaataactatagaaaaaatatggttatttaagatttattattgtttaaaaatttgtataactaaagaaaaaagaagaagagattggataggaggggagggaagacgtacctacggacgtacgaacttgagttgtacgtccagttgaaggatgggcccatggggagaggagagggtaggggagtttgtggggttatttttttaataaaattctaatagacaaaaatattggacctaccggtttgttaagatgccatatagcggtttaggagtatttgtaggagtacacatggtggcttaggagcgtttgtaggaagtttcttggacttttagtatataatagatagatagataatagatgtggggaatgatagaatgacttacattgtgaatcggagtgagtagaaggtacactagcacaaaagaagtgagcttgttcttgaaatgtcactttcactaaaaaaatagttggagagagaggagaggccccctatcacacccgagcaactaacctgggggcgacatgcaagccctaccgccaccaccctcctccccattcccaaccgtacgcagccggagctagccgccggaaattgagcggctagctaggattgcgatggtggggctcggtttttgtgcccctccggcatggagagagtgttgccggacgacggcggcagtacgagggaggtgcgtgcggcgaactcgctgaccgagcttattagcgagtgtgttggggggcatattgcggagcagctttcgacccaggtttggtggccattccccgtcgctcttcttagatctggggcttcctcaccttgtcggtggtcggtgcgagggacctgcctttctctagctatcctcctaggccgtgcacggtgtgtaagttggtggggatggtg

SEQ ID NO: 64772 - DNA, 7684 bp, Oryza sativa
aactaattctactcgggcggctgtaagtattcccaatatatactccttgtatcgatcatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaagggcagatttaacatgtcaataaagcatatagagtaaatatagttaaatcagataagatcggctgaaactctgatgctaccctaatcagcaactagaaggcaggctagaggttgattttttaagcacgacttaatagatcaaactcaactgatacagcattaagtatgaaaagaagaacaatatctagacaatcaagctgctggaagtttcatagagtggtagatatcttatataatctacgtcaacatcgaaatctaacctaatcggctgtcctctaccgacagatgttagccgattgtagattagatagtggtattgccagagattatgtaagatatatgatagttcgacgaattacataaacgagatcagagtatcacaaagatggaagcactaatcccgagaacacaagtcgtcataacaagttttaccttttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcaatctccgcctccgactttgcttcgatctaatattctttcccgatgccgatattaccaaatttggttgttaacacatgccccccaagtccggaatatttggtaatgtttcggatttgctgtaaatcgaccccgagtaagttcgcactttgccgttttccgaccgttactgccatgctttaaatattaaacgtcaccctcgagaaatctcacaccgtgacttccgttttcaccgctcaagcgaaactttgtcttctctctctccagcgattcctccgacgcaaaagcgacttccaggtgacttcatcttcggcgagatttccgcctgcagcgatgtcgtcctgcaccaacccatctgatgcgccttcagccgagtatgctgaggtaagttcccgtcggcttgatcccctttcttagcagcagatcgattttctcttatcttacattgctctctttttctctgttgttttggatttgtagcatctcttcaacctagtcgcgattcccagcctttcgcacaaaatccactattttcttggcccaatcggcaacctcgaccccactgatttcatcattggtgaaaccaaccggatcccctttagactagccaaccctaacctgggtcactggaagaataccttcaagtcttggccatctctcgaaaaacccacacctgataaaagctggaccacctggtaccaacgcgtatcgtctagtaagaaagttcactgggatgagattggaatcggccaagcgcttgctctcaccatagccaattctgctaaggatgaacctctgatggctaccgccacctacttttggtccaacaccatcaatgctttcttattcaaccaagggccgatgactccaactttaatcgacatcaccatgattactggattagatgtaacttcattggctaaccctatgagtatgaacaccaagaaccaatttgacttcaagaccaaaagcataggtggctagtctggctatgtggcagcatatatgggccaagggtctgttacccctcgggaacatgtagctttcttgctcatgtggttagaaaagttccccttctatggatctagttgtggccctacaaccaacaggcaatttgtagctgaagccttagaatcaaagaaagaatttcctttgggcaaaatccatctcggctatctgtaccaaacattgaacaacgcatcggctaaaatagccgtcggctcaatagttggagcaggcggaccatggtggctgctgcaaacctggttagtcctgatagtcatgaaggttgtcaatcggccctctatgacagaagctgaattcccactgccagagccgattgcaggagacgatggagaagagcgcacccatcgcagatgcatgtcatatggagaatatgcatccacaccaaccgatgctggagcgaagctatcggctgagctacttaagaattggttctgcagctcctatgaaggttttaagaaagatgcacgaatctggtttccctatgaagactcagcagaccttgaacttccatcggactttagatttgaagacattaatcatgaaaaattccaaaaatccagagaagttcttatagctacaatcagcctatgcatcctccccgtcggcattcaccaagggagaaacatccaagtctcctacgagttttatcacccaatgagctcggccagacaacttggattgggccaactcccaatcggcttattctttgccgacaagattcaatgccgaggacaaatcacatccactctaatgatggatcggctacttaacctaccaagaccccctctgggcagcattgataatattgagttggcaggatttagaagcaaaaactttgacagatggtggggtgaatggaagctgcatctatttcatcaatcggcttcaatgtatatgacagatctattccctgacgtcataccccaggtaaactttgtcattactaaattgcataatcagttagccgattcattacttgactaatctttttctcctattttgcagacaacagagtcctcccctcctcatcaaagtaatagtggcaaggacattgaatatgctcaaggtctaattccgaatggaggtggactatctccccctgttatcagctaccatgcccccaagacttcaacttttcttcacggcctaaccagggaactagccgatgcacgcaagaaaaggaaaaccagatcatcggccatgagtaccttggtcttagctccaaagaaaaaggccaaattcaagaaaactaaaccgactgataagtcggctgatgatctacccgccttggatacatctattgaacaagctttagatgcagaggaaattggtgaagatgttgaccaggctgtagccgaaatgagtgacacagaaagaacaccatcggcttcacccaagcaaacgcctccaactccttctgcccccattcattttacaagagtaagtatctctctttgacatcttctaaaattacttccctcttcggctaattactcatagactttgtggttgcagaaaaagaaaactgctgtgaagaaaaagccagcagcaacgattgccaagtcggctccaccagtaagatgactttaattcttttacttaatcaaactcaaccggctctatataacacttgtctattctacagcctcctcttgcttctcctcctgtatagcaatcgtcaagtgaccagactccatcggctgtggggagtcatcacatcaaggaggaagaacaaccagctgctcctgctatcccagtaagttttcctttgtctcaacaattagatcggctataatttacccaactcttactttttccgaaattgtctctgcaggttctagccgatatcttctcttttgatatcagagattaccttgatgaggcagacgaagacacttcaagcaaagccctagctcccctatccgatgatgtaagaaaaacacttgaagacatctctcatcggctagaagcctcttctttagatagcttggtagttgactgtggatcaattaggtcacggctgcatgaaattcaggctctgattcccgaagatttggccgatgtcctaactccagccgcttatctcgagcaacatcagttcaagctggaaaaagccaagctaagactagccgaacgccgtgagcgcaaagagattgaggtcacaatccaagctaatcggcagcttgtgcatgaggaaaaaaccaaacttgatcagctatctgaaggtccgatcaaatccaatattgatcagcttgaagctcgcaagattgagctcttggtgcaacttgaagaatgcaatgccgcgctagatatggaacacaaaaaactagtcgatctcccaaaatcaattgaagaacaaaaaacaaggctgaaatcggctatcaagaatgttgcgaacttgaccaagtccctaaaagtcatccctggaactgatgctcaagatgcccaagctattgaagaagtagaacaaattaggcaaagggctattttggctatccagcgatacttgtctcaataacttttgtgtaataggacttagaaattttgtaatcggctaagacgttctaatactttactgtcttgacaatcctttgtgccgattaatatgatttttaatatgactttgaaattcgctcaaaaatttgcattgcattttgatatatatatgtgcccccctaattttacagtgtcaaaagcactggtaaaattataaaacaactaagggcgatataacaatatcagccactgtacatcggcaaaccacaaccgattacaccatgaaaaacaactaagggcgatataaccatatcggccgtctcaaggcgatgtaaacacatcggctgtcatgcatcggcaatgctagacgatcatgcgttaacccaaacacttgggtaatattgcttcaaatatttgccattgagcgctcgcccatagacttcaccatcaagcccttacagcatatatgctcccttagacacaactttataaatttggaacggtccttcccaattcggcgaccacttgccaaatttactatcacgagtaccaatcggcaaaaccaacttccatacaagttctccttccgaaaaatctttaggtaccactttcttattataatgccgagcaacacgttccttatccttggtaacctttgcaagggctcgcaatcgtgactgaaccagatcctccctctcatcggccataaggttgtaatactcatcgactgttaaatcgttttggaactccgttcttcgagagccgattctaacctcccacggcaaaacagcctcatgcccataaacaagtttgtaaggagggacttggatggatccatgacaagccatcctagaagaccacaacgcttcggccaaccgagcatgccattgccgaggataatcagaaattttccgcttaatcaatttgatcaaaattttattagacgcctcggcttgcccattagtttgtgcataataaggtgaagaattcaacaatttgatacccatgctatcggcaaactgaacaaactcatcggacacgaagattgaaccctgatctgtagtaatagtttaaggaataccaaatcggtagattatatgttcttgaactaattgaatggcatccccagaatcaactttcttcaaagcaatcgcctgcacccacttggtgaaataatcagttgccaccaatataaatttatgtcctttactcgatggtgggtttatcataccgatcatatcaattccccaacctccgaatggccatggcttaataataggattcatagccgacgtcggcgctcgctgaattgctccaaacttctgacaatcttgacaccccttataatatctgaaacaatcctccagcattgtcggccaaaaataccctgcacaccaaagtaaccacttcatcttatgagccaattgatgagtaccacaaattccttcatgaacttcgccgattgcaactttagcctgatcggcactcaagcacttaagtaacactccatcaatcgtccaataataaacctcatcatccaacagtgtatactttaatggcttatatcttaatttcctagaagccgattgagatggattattcaaatattgatgcacatcatacctccaatcatcggctgtcatcgctgcaatttcaactttaacatctttgatcatcggcttataccccgacgccccttgagctaaatcattagcttcaacattttgttctcgagagacatgctttaaagtaaccagccgaaactctttcattagttcgtggcacttctcataataaactatcaatgtatcattcttgcatccatactctcctgccaattgactgattattagcaaagaatcccccatgatttcaatggcatcggcttcaacttccttgagtaattgcaaccctttgagcactgcttcatactcagcttgattattagtcgcatacggtttaatagtataagcaaactcgaagcatgccccctaggggaaattataaccagaccgataccacaaccatgagtacacaccgatctatcaaagaataaagtccacggcactatatcaactgagccaattgaatcattatgatgttccacaataaaatcggccatagcttgtcccttaattgccttcaacgactcataccgaagatcaaactcggttaaggaaaatatccacttttcaacccttcctttcaatattggagccgatagcatgtccttgacaacgtgggccttgcatataacagtgcactcattggatagtagataatgcctcaaccttgtacacgaaaaatacaaacccaagcataacttctccataggggagtaccgagcttcagcatccaagagtcgaccactgggatagaataccacctggtcctttcctttcaactgctgaatcaatactgacccgatggacttctcaccggccgataaatataacctaaacggttttcctttttggggaggaatcaaaacatgaggagagctcagatattccttaatattatccaaagccttttgctgctctgcccccaagtaaactgctgatcggctttcaatctcaaccaatggtgtaaaaggttctaactttccagacaaattagaaataaatcttctaacaaaatttatcttgccgatcatctcttgtaattctgtcttattctctggaggctaaatcttcttgatcgcattaacactcctttgagttacctcgatccccctttcatgaacaagaaatcccaaaaactggctagccgatacaccaaaagcacatttcgtcgggttcatcttcaggccatattttctggttctctcgaaaaccttcctcaaatcggttatatggtcctctatttctttagacttaacaaccacatcatcgatgtagacttcaccaaccagccgattaaattacgatgtatgtaattcatggctctttgatatgtagctccagca

SEQ ID NO: 64773 - DNA, 83580 bp, Oryza sativa
ttctcccccgcgggcagggttctcggggcaaacagggcttcctcaacagaatacgctaccagcccaaggtggcaaccctatcagtttaaatatatgtaaggaatccatgcaccaaatcaaaaaataccagaagtttaccccaaaagcaaaagagttcacatcccccccgaaataatttcatactaaaaataactcggcaagcgtgattattattgtagtttggacttttcatgattgccgtcatgatttaaatatttttactctaaaatttataattaaacattaggaatttatatgctccaaacaatcactctttgtaactttcttttagctaacgtgcattaggaatttagtattacaattatgggtaaagtgttacccttaaattcattatattttagccacaacaaaaaggttaaaaatcctgacggccttaagagtataaatgtattagaattttgttttttcttcctcccaatatgacaccgcacgcgcgcggccgccatcacgtccatctggacaggacccacgtacgtacgcgcgagcgcgcgtgcttttctcggtctctcttttggccgtgatcgccgacgactggcttgattgattgccatcatcacatatgcttgctgccgtgattttgctcccagcgattatgcttgattatggtatagtaatttcacttcccgttagaattcaggttgcatgttcttggttagctcctaagggagtgttggagagaaagggaaaagagaatattgataaaatatacaaaatgaggcgagctattagcgcacgattaattatgtgttgattattttaaactcaaaaattgtattaatatgatttttgaaagcaacttatatatatgttttaaaaaaacgtacagtttgataaacgtgcacgtgtaaaacgagagatcttctcacccaatctgctaactcgaacacaacctaagacctcaaggcctgtttcgatgtgattaagggtgtctttggttgggcttttgaacctgcttttgcagggctcaagctagctgcttctacccaaaagctacttttgttatagtacaaactaaaagcacctcctaccttgcttccagtggcttttaagggaaaaaattacccatctgccattggttatgagaaaacggttcgatttctttcctcccgtccccttcttgcgaccttcacatgcggtgcgcagcagtggtgcccctccgactggctggccgccgcctgtacggtgccgcccctgctcgtccccgcccagcgccggcttgcccagggttggggcgcacggaggagaggacggcggcgactccacaccgactccgccgcgcgcgtctgcctacccgccgctgccggcgtgtcgatggccatctctatgtctttctcctcttttttttccctctttttacccctctttttcccttttttccaatgtgcgtatgacatgtggggcccgcttgtaagcggaactagttatttcaaaagtcacaactgttgaacctaacgagctttttcaaaagatatagcccatattccacagctgcttttcgaaaagtcacagcctacggccacttttcaaaagtcacagctcaaccaaacacaccctaagtttgtcacaccctaatttgctaactcaaacacagcctaagtcctcaatgcatgtttcgatgtaacatttgttaacaaattttctctaaaaaatttagatgtaaatatagtataatcgtagtataattacattataacttatatggaacttttaaaaatccctccataacactctattcccgtgaaacataggtcgttggaccaaatccctcacccatgccagcactgtaattgttcccttcccgcttgaaggcccgctctggcgttggctcactgtcaactgtcacgccgaggtgccgtggtggaagtcgacgctttgctgggggtgacaactggtttatcgtccagggtcactgtgcccgaggcgtagccatagatctcctccaagtgcacgtacatgcagtacttcactgcgtgctgcgaacgctcctgcggcctctctcggacaccgtcacagtcagtgtggagcacattgccacgcctgctgctagtgaagattatccacacacgtttggggatagaggactggtttagttcctaactttttctttaaatttttaactttttcatcatattaaaacgtttctacacacaaatttttaatattttcgtcacattgtttcaatttcaatcaaactttcaattttaacgtgcaccaaacacacccagagtttgggttgctagtccacgctcgaatattgatccagcgtgtgttggacgaatgaatgaagctcatctcgatgttcttcaatacacatgtgcgcgctacagtcagcctttcaggcatgatgcggaacaccgtcaaggtagagatggacgcaaaacatcaaggcgatgctgaggacgctcttgtgccacttgaaaagaatgaagctcaagcccacggcgcttgggaaccccttcttgagcgcctcagcatggcgccgccggtgctcaaactttattaggaaagattttgggtggtgttggagatcactgcctcgcatttccttaggtggagcacctccacaaacattgcttttatgtcctttgctgttgttgacgccgaagccttgaccacccagatgatgatgaccatggactcccattctttcagctcagctctacctagggtttacaaaaccgccggtaactgcgcggttaccgggtttaccgcagagtacggtaaaaaaaaccgcagtaacctccttaaatttaaataaattttaaaaataatttaaaattttgataaattttacatggtttcatacggtttgtcacggttaccgcggttaccacacaataaccgtacttaccgccggggcacggtaaccttggtcccggcggtttgggaaaccgtggctctacgacctcggtggcatgcgaggttgggatgaagcattcctcttcttccgaccaggttgacagtcaccaaggattagtatagctacaaagagtcattggttagcctggtgtgatatggaggttaatttattggtaggattttgttgtgctaaaactttgaatagagatgtgttaatgcggaccaaaaaaacatgtaagagagcttcacactcaatatataatcttgttttgatcttaatttcttttggagtaaattgcatcgccgatacacgaatttgttaaatgggtgcaatcttgtacacgaacttgtaaaatactcgttttggtgcatgaatttgtctaatgcgtgcagaggaaggcaaaaaggaaacaacatggctaatcttattgatttaggggctcatcaggataactatgtaaacatatatctgagaaggttgctattagataaacacctcttcaataaaaatagaatgggatatagtgatggtagaaaatgataaaaaaaaaccgagcaatgatataagagttagaaatatatgaaattcatcacttccatgatgatggataaagtacatatcaaatttataaatattacatgtcttatacatagtcatatgcacgtcacatcctaatcaacatcagctttataaaattaacattgctttctaaaaaaaattatcaacgttgctttgtaaatttatcaacatcaatgataatataacatgtgacatttttgaaaaaaaaaattgggaactaaacaaaaggatgcatggaggattaaattaacatcccaaaaacgtcacatcgaatttttgggcacatgcatagagcattaaatatatataaaataaaaaactaattgcatagtttatatgaaattcgcgagacgaatcttttgagtctaattagtccatgattagccataagtgctacagtaacccacatgtgcttatgaaggattaattaggcttaataaattcgtcttgtggtttctaggcgagttatgaaactagttttttcattcgtgtctgaaaagctcttccaacatccagtcaaacgttcaatgtgacacctaattttttttttcgtgaactaaaccaggccggagtatgtatggaagacatcggaagcagtgctgtttttagtgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgcgaagcgcttcccaaaaaccttattgccgccttctcccggtgcaggatgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctattgcgcgtaaccgaaccggataagtcgcgcgtaacttatccggactccacgccatttgcacgcaccggatttttcggaacgtttccaaaacaaaaacgaatccgaatttgcagcaaaacaaaactgggtcggtttatatagagaagggtcgcttgatcagggcgcccgcacgatctctattgcgcgtaaccgaaccggataagtcgcgcgtaacttatccggactccacgccatttgcacgcaccggatttttcggaacgtttccaaaacaaaaacgaatccgaatttgcagcaaaacaaaactgcaaaaagaggctgcatctgcgcaagggtgaggagccaatttttcggaccattcgatgcgtacgtcgtgcacgcgcgccgcctgccaggcgaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacatttagcccatgaacttttgcatattacttctgttttcaaatattcacatgcatatttcaaaatcattatacattgatgttatttgtttacttatcgtgcttaattatgtgtgcgtgatgtgaatagtgcttggtaatgtaaaattgaagcatgtcagtcacaactcacaagaaaagaagcacgaagcgtaagtaaaatttgtgcatgggcatctacattgaaatccaactgcacactttggctggacctttcagcacctacaagaggaggacctagtaaaggttgtgtatttaaaatgtgacatttttttatagccaaataggtttttgacaagtgtaatattatatagtattgatggtacaatacatgacatatgtattatgtgttgaataagacctctttttcagttttgtactccctccttccctaaatgtttgacaccgttgacttttttaaacatgtttgaccatttgttttattcaaaaacttttgtgatatgtgtaaaactatatgtatacataaaagtatatttaacaataaatcaaatgatagaaaagaattaacaattacttaatttttttgaataagacaaacggtcaaacatttttaaaaaaatcaacggcgtcaaacattttgggatggaggtagtatatgcgtacgcatcatatactatttcgatctacctattctttttataaaaaaaatgttagatattcatcggaataattgtgctaagcacttgccagcttattccctgctcgcacattcggccgaaatgtttcaacagcagccatgctaaatttctgattaaccgcttccatactctgataaaaatggtaaacccgttaattgcaacactaggctatgcctgtacgacgtcaaaccggcaccaaaatcgtcactcagatgaactaagcgctgagattcagctacatggatacgtgaactagcaagaacagagcaaactacatctgagctgtacaaatcaatgccctgaaataagcaggtggcaatatatacagatcaaccataatatgcgactaggtaagcaatagtaataagaaatgattttataatttatttaattagtcagctcctagatcagcttgctagcacacaacttagtcaatgcctagctagcattggctcttttcagcaggtaagagaatttagtgcttcatcaatctcaaaatataactataatatagtactatgttaaaaattaagtattgggatgaaagaaccaaagtacacctcattaatccatggtgaggtgatggcgatcaaagatagtatgtgggaggtgtggattttgagggctaataggggtgatagggctcatggtggcatgagaggagtaatgtggtaaaagtcaccttctatgtacctatattcaagataaactttgaatttcaaggtagttatattttgggatggatggtttaagagactgagtattctttcctactaagaataatgtagatgtttcaacagctttgtctaggcttttcatctttggaccccccatattttggcttatctatggcacctcaattatagatttccatagtttgtcgtggatgagcaaagcttaggagatgattcttcatttaactaggtaagaccccgcgcgttgctgcgggagtttagtataataataataagtaaaaataatatgtaagatagctagacaacataagattatataagttaacgtggtttatgataatttaaatttacaaaatatatacaatgatgattcaaacgtaaaagtaaggtgatatgactttatgaaagaagaaaagtattgagatggtttggaccgtagattaatcatcttaaggctaaaaataattgagatggtatggattaataagagaagaaaataagagagataatttagaccatagattaattgtttgagcactaaaaacaattgatgtgatatggcttaatgagagaagataaaaataatattaattaagtgaggacgaactatataggtacatagcatattataaaaaataataaagatatatattgaaatattatgtgaattaggtgggatgatgatttaacatgcttgcatttttaaagctctaaaatttaataaattataaaattatagataatatagcatgtttgtattatgtttaaatttaatgattgttagtgaaagatgatgtagtatctttcaatgttaagctttaggagttaatgagttataactttatagtaagataggatttgatggtaagatcgatacagggaaccttaccaactttgcctacctcctgtttatactacgcggtcacatcacatgtggtaacatgtggtaatggtatctgcacaaatcttaccaagtgaaaagacaatctgatcatgaaagctggaagagccacagcatgtggtacataatgggcatctgattgaaaagcaaacaaaattaatgaaatggatcacaaccgcacgatcaaggatatgtggaaggaaccagaagctgatcaatgaaaatgtttgcataaaacccatatattctcacatatctacaataaacaactttcatagtttgatttctcagtacatttcattattgtctcccccatcatcatttgtgattgaaccatgtaattatgcaattaagaagaaaactcgcacaagtctattttcaagacaaaattctacgctatatcttaaaacaagtttaaatttaatttatagctttatttatcccattaagttttagcatacataactattatatatatgacacgttataacgtttcacgtaaagagctaggtaatagtcacaattatttttgtaacttattccgaaatgtatgtaagacaaatatgtttcttaaaacatataacttattttcaaacttattatcagtagcacactttaggatggttaaagtcgcgtgaatgtgcaacttcataagctagtagtgttggatttaatatgtaagtagagggggccttggccccctcaaaatttacatctcacgtataccagaattcacttgactttataatttaatatatacgagttataaatttatcctgtaagttagtataaatataatatatatgcatgccaccggtaaaaatttattgtgctttcacccctatgcacacatccaaccaagcatcatgatgaatgtggtcaatgcattcttgatttcttgtctagggatggaactgctcttcttgtagttgaccagaattgttagtgctttctaggtggatttttgccgccgacaacaactcgtagaagttggggaccccctccaataagagaacattagtcattgccaaaatcgagagcagacaactcagggatcacatgattcttgttcttgaatgcataacacaagacaactcagggatcaaatgattcttgttcttgaatgcataacacaatactattaaattcctacaaggtacatgttatctgcttaaatgtcatgcgtggatattccatggccgttaaaattcacgttcatatggattaaatagtgtggcacataattctgccgagcacacatctcttctagatagtttgtttatcgggccaactatcgttctatctcaaacatggttggtacaagtccaacttttatcacaaaagaaagagtaaattgcattagcggtacataaacttgttagttacgtgcaatgtagtgtataaacttgtaaaatgctcgttttggtgcatgaacttgtctggtacatgcaaactaagactaaaatggcacgacaagaccgatttttatatgttaaacattataaattacaaattagtagatgacttgcgtgtacatagtagaaaggttatgaattggggcctaaaattgctaggtatgacccttacaaatcagcatacatgtcaaaccaggggaaccatggactcttcacaggtatactgaccattatttctaccttactagttagtacacaatcacaagccaatgagcttgcaaacatagacttcagcacgacactaccaggccaaatctctgttgtctagctcaactctcaccggaagaatgtgcattcctcaagagccctccaggttgagtatctgaatcattgcagccgagatagaaaagcaactagctctttcagccatggtcgatgcagcaactcaagatcaatcgtacacgcaatagcagggaaaataaggaaatttaaagtgaagagatatgaattttatttttcagggaacaatctgtgtaccacaaatatcaaaagaatagacaagagtaattaatcttaaaatagtttggaacaagagcattctaatcttctagctgaacttacaaatttagtttttctgggagctcccccaaccagcagggagtgtatgggagagatgatcgtaccagtttgtcgttgtgcatgtatggagcatgatgaataaaaatttttgtaaaaacattgcccaaatccagaagctttgagctactccaattataggctagcactctgtcaaatttatcaccaaagaaaatcatagccctgtctagttcgcgaaaagaaaatttttaactgtcacatcagacgtttaaccagatattagaaggggttttcggacacaaatgaaaaaaaataatttcataactcgcttagaaaccgcgagacgaatttattaagcctaattaatccatcattagcacatatgggttactgtagcacttatggctaatcatggactaattaggcttaaaagattcgtctcgcaatttccatgtaaactgtgcaattaatttttctttttatctatgtttaatgctctatgcatatgtccaaatattcgatgtgatgtttttgggaaaaaaattgagaactaaacaaggcccatatctttgtaaggatgaaatgcaaggaaatagacatagcaatccttgcgcagttgcgcctacttccaggttcaagaacattatcactgtcagagtcccacccgaatttctcaaatttctcttccactattggctcgtcttccacatagtaatcatcatcatcataataaaaaggcttataattataagagtgaataataatgttgtaaggcccaaggtccatcacgttgttgttcatcatagttcagattcagtaggatgtgggaaatgtccatgtcatgcttcaacacccactcggtctgaccacaccgttcattcaggaaaccaaacctgaagttggggcctcagaaatgatggtaataatgcacagtatatccccttgcttgattttcctagataaaattgaccatctcctggatcttccgtgggcgttctaatcactcgatacgtattgtccgacaatgatattcttcaacaaaagaacagaataacatgatctgaatcacaatgcatgcttaattaattaaggggtggagagttagtacgtatctacctcatgacaaatcaataggagcagcatatataaagtgctcttcgccagtatccacactgatgatcacaaaatggatttgacctggtaacatccctgcagcctccccttccagagcaaatttcctctcctcccaagaaccagtcttggatgaaaacacaggtaggatcaatatatgtccacggcggccattcgcattcctcgcattcttcttcctcgcgcagcttgtaaggaacatgatcgggcactatgaacaactcatagttgggcgtaagtgtggggtcgaacaccaggtactcgttttccccatgcctggaggtaggagaggaggaggccgttgcagtggcccttgacgtattagatggggggcatggcggcggcggcggcggcacggtgtagtcgaggcggcaggagacggcggcgcccgtggtggggcgggagaggaactgggtgtgaaccgcgagtcgtggcagttgaggaggatgccgcccagcgagagcgggaggaggtccgcgcgcaggaggcggcgggagtcgacgacgagcgcggcgccactccttgcaggcgcagcgggacgctgcgcgaggccacgcggcgggaggcggcggaggacggccgcgagcacgtcgtcaggcagcgacgacgccacatccatcgcctcagcacgtcgtcgtcgcttgactatcgcggcaaattggggaattctttttcgccaatgcagttgatttgggctcaaccgctcaagccgcgggaggtggtcgtggctcgttgccaagtagtgtcgctgccagttaacgggccggcccattaggctttctttttttccattttaaaacgattttccaatcatatattgcgagatttcatcagaacatggatttgtattcagtttttaaacaagtttaaatgaagtatttgtggggtactccctcggtcccaaaaaaaccaatcttaggtacgaacctgaacgcacgtatgttcatattcatatctaggattgagttttttctgggacacaaagtgtacacggtaccccggatatctcatagcaagccttattctagcaaatactgggatactacatctcgatgattccgaatatcttcgggcttgttcactttgctactattttcaaccttaccaagttttggtattgtcaaattttggtaatgttgccaaaattttggcaaggttgttaaattttagcaagatttcatatgtacgtactaaaatttggcaacaaactaaatgcaaccacttttttttaactttgccaaaaaaaagataaggttgaaaatggtagcaaagtgaataagcccttctagatatagaataggagaatttagttgcaaccgactagataaccttctttttaatccttcctatcatcttacataagagggggcagagtcccgagattggggtgactccagacgatagatacaacacatcataatggcgccatgttcatcatacacaaacccttaggcacaagataatcccatatactgatacacaactagattagagtattacctcaaggtttatgtgtcgctatcgttatgtagatccaacacataacaatataaataatattgttgatccagataatcgacggtattgtactaaaatactgtaatgccacgagtttgctcggataggacatgaacccatgcggatgagagcttgcaggccgcgacaacacattctctctgaacgaagttgccacaacttcgtgccatccccctgtgaagtcgaggtgaggtccgggttcgctgtttacccacgagatgtggtgacgacatcacaaacacatcacgtgaattcaccttactaatatatcatggtgtccttttggtttattctatattatttacacttgaatattgtatatattagcattgctataattgtggtgtttacaatttattttagtcggaccacctatacactaaatcctagatataccattggatacaagtatttctactccctaaatagttagtcttactagcatacttttttaacctcttggttcaaactaagatgtgagatgttttctgccagacaacatggtgttaggaattttgatgtctcgatttggaaatcgggaggagatcgtgccaaagaccatttccatccgttgtctatgcgcaatcaccgcgattaaattcgtgttaaaatcttccttaactacacactacgatcggtggtgccatatcctttccttttggagctgcccccaattccctcgataccaaaataaaaggggaggccagacaaaaaacgaggtgaagatctctatcttgctgccacactaaaccctaatcccgatctgaacaagtgctagaggggggaacgtgtgtccaaccttggtcgatgcaagtggaggccgaaggaacgctgtcacgtcacatcccatcaccggcgaccccttcgggatcaagccggcgatttggtatgtgctgctactacgactactttgtctacaccgacaaacaccggagcggcttgaggggcttcaacctcttcttccacatcggtcatcaccgagcaaatcatgaacatcgtgctaatggcttctcaaggtacacataaagttttacctctatctttcgcatagggtgatcatgctaggctaaagaattagattagtagattagataatttacacaaggttcgacttatcaggtatcaattttctgattgactttcgtgctttggtgagtcatttgagattcctttgatgacctatgttatgttgaagggatttctggtgatatagttcgattgttgtctccaatgactatatttctatttcccacacgagatagcatgatatctaatatttgtaacacgtcatcgcttcatatatattaactattattctaccaaaatactctaaagtttagagtacttagtccaaaagaacacatgatgagcggggcatactcaccgcagccataaggcatcaaaaatacaaaacccaaccaaagctgacgcttgaacaagacataagtggaattatgttttgttgccaaccaatcatacccaaagtcacgcctagttggataactccaataaaaaaggaaaaaaaagcaacgctcaaatcagggataaacttaaaagcaattcccgaaatggaaatacatttttaccatttcggatgtaaaatgataacaaaatcctgctcatcaacccctttcaaaaaagatttataccaccaacacagaaaagttaggtgtagaactcagctttcacaagcactcctcttctatcatttttcccccaaacaccatagcttgacttatgtggttatagtacgattattgtctctaatatgtagatttataatcttcacaagagatggcctgatatcgatatagctaatattttgatataactaatatttacacttacagaacttcatatatattagtttttccactaaaaatactttaaacgcttggttcaaaagaacacacatgacacacaatggcgtgactcactacagctatgaggcaacaaaacccagccaaaagctgacgtttgaaccaagagaaaacctggaaacaagtgaccaacgcaatgcctagctggaaaaggccagcaaaaaaaggaaacgacaacgttcgaatttggaccaattttagaagcaattcgtcaaacggagcaaaacctgaccaatttggatgtaaacgaaaacaaaaccccgctcatcaaccccttccaaaaaaaaaaaaaactcctaccgtttttaaccaaaaatcctcccgagtcccgatttccaaatcccccgtgtgaaacggtcccgaaaatttttttgggcgacgcggctcccgccaaggaaccccgccctccgctccccgtttcccattcatccattccacgcgcgcgcggccgccaacacaaatcctccaaaaaacctgaaactgccgccgcgtgctccaccccacaccccccccccccctaaagcccctcccccgcgccgccacgctcctccgcttccgctcgccctgtcgcgccgcttgcttcgcctcgtgacaacctcgcctgcgccgccgccgccgccggcgagggggtggggggtgtggtggtgactgtgggaggcgcgtttccggtttgctccgcgggcggcgcgtcgacgcgtggcttggtaagcttgtgtggtgatgtaggatttgttaatttgttgtttttttttccttaccccgcgtgttgtagcggcgatgcttctcgatctgtgtctggttggcttcgtacgggtgattttgtggggtttgggcggagggttttggccggtgaaatcgtgctgctgctgctgctggttcgtcaggttgcgcgtccaggtttgggggatttgttcttcctggctgtggaaagcgttcacggagcggatttgagtcctacattgctggttgctgttcgtgctgtgccttaggaggagatttgataggaaacattttcgagatttcggtgttttgctgcggcggagcgttgcttcgagttggggaatgatggattaccccgcggattcgggggttttaggggaggatttgattttaggaggggttttgtttagcaaatccgttctgtttgtgctggttgatgtgtgatttaggggcaaattctaggcgtgagggatttgtcgctggattagccagcgaaatcctgtctactgttacggttcccctgttttttctcacttggtaggacgggacggggcgtgtcctggtggaggttgggattaatccatctgttgcctcggggaccgtgccttccactatccccggatattttggtcgtgtttttttaatttcgcttcacaaagtggggtttctgatgtgcgctctggagattcatcttggtgctggaatcgccgattcgaggctgcttcggcgtgcttagcttcgtctgagggctgaggccaacccagatttggggctgcttcgctatgcttcgccgcgccgccgccaacgctgcctatttgtagtcctactaatcttcgtatggtatgttatgtaagtatgttgtggggtttagaagattgttttgatgaagtgtggtttggtgctgtttggctgagttattaatcttgttgccatgaatctgtccgacgtcctctttaatagtagtgttgagtcgctttccccaaaatagtcaacttctaggttagttaactagatattttccccatctgataattattctggcgttaactgcaaagcaggggtagcgaatctgtgggtggattttttatcttcatcaacaattgttcgcggcccttggtacaccgccgccaacgattggccgcagctggtaaccttgttcatcaatctacaaggtatttctgtgatggattcactttctatttatagcaaatgagttttgagtgatttatgttgctatattgtgctgatgtggtgattttgggtttgcgattagtgggttgttgagatgctgggcgccttatttgctacctacagttgtgcaacagtagaaccaaacgttgtctacagcaattcgttttagagtttcttgttggtattaattggttgaatgtgatagcatggtttggaacattggactttttttgtggttgtttctgccactacctttctctgtgtgtttactgtattcagtagtgctcacttgttttccctgctttcctatcttatggtggaccaattttaatcaaactttggggttatcttaaggtcagtgatgttttaggaaaaatcactaccttaccgttggttggctcaatatgcgtacttatctatccattcttcattatcagtttttgtaatctgctggcttttgtgtttgtgaactaaattgtgaatgggaatatttttgtattagtgagtacatgattcattgatttggatgtgggttttcttgacatgggtgtgtcatgacctacttgctgtcatttctagatgattctacacaattattatctttactttccatgatttatgttaataatttgcttttgcgcaacgaatgctactactttttatcatagtgactaaatgaactgcaaactgcacaagagatacatgttatgcatcgtttccgtgctactccaaaatatagttaaacagacaaatagtatgtattgaaactaacaatttcacttctgttttggatgtttaatagcatagaattataccttgcaaatatttgcttttgataaattatgttgctcattcgatctttttccatagttaatttcaaatggtagcaagactactgcatttatgtgctaatatataatctacatgtctgactaattttaaatttacagggagatatggtgaaaagtccgtgttctcccgttaccacaggtcttgttcttaattacctcgtcttttacttgccctgtatgacaatgaagtgtcacctttcaatttatggcatgacattatgttcctttaccgttaccaggaataccttgtgatatacactaattttacctgtatagttttttacgcctttgctttgactttgagaatgtaaatctgtgatggcatttgactcttgtttgatagatgatatctgccacacgtcatgtattttaccagttcgatcaagcgtgctatgatttattttttggcagaagaccaggggtctgccctatcataacaaatatgcattttgtaaaatatattgtgaaaagggatggcatatatgcctatattgaccaggaatacacgctaaatctcccaccattctccctcttcctgatctgctattaaccaatattcattgaattatataagcacaagcattcttgttccacaacaacgatgcatttaagcaaagttggtgtctaatgctaaaacgtattaaccaaaattcactagtcaagttcagcatcacacattcacaatcgtgtaaacggagtaatgcacatgtttatcaagttgtcagttgtgtaattggttagaggtagatgtcttggggagccttaacttgaatagaatgcaaggcatgtcaagacatagataaacacttagccaccatcaccatcactgccgcagttatcgtctcttgccatcatatcaccaactggtggactgggcatgggcctaggcgtataatgcttgtggccttcccactttggttaagctgataattatgctgcatttcagcttaatctggtgttacattagcaaaccaattgcaactgctctgtgttgctcaaaaaggctgatccggaggcggcataggccattccaaagggaatcaaatatcgcatctcctcgtcactgctgctagcaaatcgctggtggcagcggcattgccttctgtatcaaccttattttttgtgttgctggtggcatacggctctccgtaggctagtggtctttgtggaactttcttgccactgatggggtagagatcttggcttggcagttcattggttggatctagcgatgagatcatgctgagacataatcttgaactccgatacctcttctcagggtgaaaacctttgttcttaccatcattagttggagctggcctaattgatattcccttctaaaggcatcgaaataggagaattggcccatgggagcagaggtgaaaaccttcgatctaattttcactgattagatctagcaacgatgatgcgagccgtgtcccttcttggaggtgttgtcatcaatactaaagccccaaggacctctttcaactgttgtcctcttgtggttggtcgcctaatggtggtgatggcgggtctacgtttcttttttcttgaccagtcttagcattgacaagtattgtgacgttatgtttttttctggtcttggttgtgtgcaatcctagttgatgtagatgttggaatttacactttcccttatctaaacaacaatgccttgggttgagtggcttattaacaatgggtagcatagtttaatcacatattggcttaagaaatcttttgttaggaaccttggacagccctctgaaaagcattcttattacatacttataaggtaaattaatctcaatgcatgttaccttgttcaaaggaaataaattaacaatagtttggccatcaaaagttccggatctatgcatcaacaaacgggatcgaggtaacactgaatgctattttgaaaggttttaacaaggcagggacaatgttgtccccgtggtcccaggttgttccatgtttccggtgactactttttgttagtttactcatcatctgtatgttaatgcataaatgcggcagccaacagattcggaaagagtttttgccatccttgacaattgcccaaatggccaattggcatgcttcgtgagcatgccatcgatcatgattcctaggatttgtttgacttgtacatgataccataacggtaggttatctatgcgttccaccagcaagtttcccacaaaacatggcattaaatgtgcattatatccaaaacagaataatgaagtcttgttaacttaagaaatgacaggtgttgctattattcacaatgagtgctggaatcgctctaaaagtggattgctaaatttctacttatttgaaaatggcttcttgtcacttgtgccattttgcatttggaaaatgcatatttcaccgttggatgtacatcaggaaagcagaatagtaatagtagatatatatgttatttgctgtgatgttgccgcatttaatttctaatgcctatgtttttcaagttactgatagaaagcatttgttatctgattgtggtttatttggtgaaagtttattctattatttattccagttggtgaaccaatactttcctgttttgtacactttatgcatcctcatctttgtttttccccctcaaaaatcttcatctttattttttgtctttcatgtttgagttttacatcctaaagtctttactatattccagcattcctgtttcttaattgttgattaacatgctgagttgtggggttttcaggaaagaaaaggtgcagagcaaagccacaaaagaaggacgaagatacaactgataaaggcaaactggatgagggacctctggatgctacaaaagagatgaatggagttggaaagggtgatagtcgtgctgcctgcaagaggccaaggagagcagcagcgtgctctgatttcaaagagaaatctgtacgcttatctgataaatcctctgtggtcgcgaccaatggaaataagatggaagaggaggaaatggatgccgtaaagctgacaaaattaggaccagaagttcagcgaccttgtcggaaattgattgatttcatcttgcatgatgctgatgggaaactacagccctttgaaatgtcagaaattgatgattttttcatcacagctcttatcatgcccatggatgatgatttggaaaaagatcgtcaaaaaggagtgcgctgtgaaggatttgggcgaattgaggactgggcaatatctggttatgatgaaggtactgcagtagtctgggtctcaacagaagttgctgactacgaatgtgtgaagccagcaggcaattacaaatcttactatgaccacttctatgagaaggcacaggtctgtgttgaagtttacagaaaacttgcaagatcagttggtgggaatcctaatctaggtctggaagaattgcttgctagtgttgttcgctctattaatgctatcaaaggttatagtggtacactgagcaaagactttgtgatctccaatggtgagtttgtatacaaccagcttattggattggatgagacagcaaacactgatgatgagaagtttgcgacactaccagttcttcttgctctaagagatgggtgcaaatctagagtggaagtaagcaagctgcagcctaacatttcaaatggaagcctgaagattaatgatgcagagtgtaaagaggtatctgaagatgatgatgagaagttagcaagattgttgcaacaagaagaggaatggaagatgatgaaacagagaggtaaacgtggaacaacttcccagaaaaatgtctacatcaaaattagtgaagctgagattgccaatgactatcctctgcctgcatactataaaccctctagtcaagaaatggatgagtacatatttgacagtgaagatagcttctattctgatgtgccagtaaggatcctcaacaactgggctttatacaatgcagactccaggcttattcctttggaactaatccccatgaaagcaggcgctgaaaatgatatagttgtctttggatctggttttatgagagaggatgatggaagttgctgttctactgctgaatctgcaaaattgtcttcatcaagtagttctaaccaccaggatgcaggcgtttcaatttatctgagccctatcaaggagtgggttatagaatttggtggatcaatgatttgcataaccattcgaactgatgtggcctggtaagtactccagccagatctgttcaatgtggatttttttctattacacaatctttttgttgggaaacaattttccttctgcatgctacattgatgcttacatttggctcgtgatttcaggtataagctacggcaacctacaaagcaatatgctccttggtgtgagcctgtcttgaaaacagccaggctctctgttagcatcataactctactaaaagagcaaagtcgtgcttcaaagctttcctttgctgatgtcatcaagaaagtggctgaatttgataaagggagtcctgcatttgtatcatctaatgttgcactggtcgagagatatattgtggtccatggacagattattcttcagcagttctcagattttccagatgagactatccggcggagtgcatttgctactggtcttttgatgaagatggagcaaagaaggcatacaaagttggtcatgaagaaaaaggttcaagtgatgagaggagagaatctgaacccaagtgcaactatggggccagcatcaagaagaaaagtgatgcgtgcaacaacaaccaggttgattaacaggatatggagtgattactatacacaccatttccctgaagattccaaggatgcagatgtgaatgaagctaaagaaattgatgatgaactggaagaaaatgaagatgaggatgctgaagaggaagcacagattgaggaggaaaatgtctcaaaaactccaccatcaacacggtctcgaaagttggtatcacaaacatgcaaagaaattagatgggaaggtgaagccattggtaaaacaccttctggagaagctctatacaaatgtgcttatgttcgagagctcagaataaatttgggacggacagttgcactagaagatgattcaggagaactggtcatgtgctttgttgagtacatgtttcagaaacttaatggagcaaaaatggttcatggaaggctacttcagaaaggttcagagactgttcttggcaatgctgcaaatgaaagggatcttttcttaaccaatgaatgtttagaatttgagttagaagatatcaaagaattgatgtctgtcaatctccaatcattgccctggggtcacaagtatagaaaagagaatgctgaagctgacaggattgagcgtgccaaagctgaagataggaagaagaaaggtttgccaatggaatatttatgcaaaagcttgtactggcctgagaagggtgcatttttctcccttcctcatgataagctgggccttggtaatggtttctgtagctcttgtcagcagaaagagccagattgtgatgaattgcaaatactatccaagaacagcttcatttacagaaacattacctacaatgtcaatgactatttgtatattagacctgactttttctctcaagaggaggatcgtgcaaccttcaagggagggcgaaatgtgggtctaaagccctatgtagtttgccatctattggatgtccatgaacctgctggatccagaaaaattcatccagcatcaacaaaaatcagtgttagaagattttacagaccagatgacatttcatcagccaaagcttatgtttctgacattagagaggttacattctttgtcctccttttctatgtttaaattctggtgtcatcattaattcattgctgtcattgtttgcaagatatttctccttacattggctttgatactttttctggatcaggtatactatagtgaaaatatagttaaagtgcctgtggatatgatagagggaaaatgtgaggtcaaaaagaagatcgacatctcaaactcagatgttccagtgatggttgaacatgaatttttctgtgaacatttctatgatcctgccactggagcattaaagcaggttagtcaatagctaatgtaccatttttattcagcaatgttagtttccatagttaactgaatgtgtgctgtatatatggaccagttgcctccaaatgttaagctcatgtctgtgcaacaaaaggcaactggcgctttgaaaaagaacaaaggaaagcagatctgtgaaagtgatcaggtggattcagataaatgtacaaaggtgtccaaagagaaccgtcttgcaactcttgacatttttgctggctgtggaggtttatcagaaggactgcagcaagctggtatgcactttccttcaataatggtgtttagctttatcatcaacatgtcggccatcagactgatattttattaccatttaaattctgtaggtgtatcgtttacaaagtgggcgattgaatatgaggaaccagctggtgaagcatttaccaaaaatcatccagaagctgcggtgtttgtggataactgcaatgtgattttgaagtaggtgcaccgtgcacttccttgattttttctgtggttttctttttacctatatagctcaatagggactgttatatgattttgcagggcaattatggacaaatgtggagatgctgatgattgcatttcaacttctgaggctgctgaacaagcagctaaattttctcaggacaatattatgaaccttcctgtccctggtgaagtagaattcataaatggtggtcctccatgtcaggtatattattttgctatacttgatggaattttctttgcacctaggcaagcaaattgtttgcacttcaatacttgtgataaatgacttcaattttgtaatttttttctcaactcagggcttttctgggatgaacagatttaaccaaagcccatggagtaaagttcaatgtgagatgattttagcattcctgtcttttgctgaatatttccgccccagattctttcttttagaaaatgttaggaactttgtttcattcaacaaaggacagacatttcgactgacagttgcatcccttctggagatgggataccaggtaattattcttctggttatacatacttaaaatgcctatgtacagcatttgttttgaatcttataataaccagaagctgtttacttgttgcttaggtccggtttggaattttagaggcagggacttttggtgttgctcagtccaggaaaagagcattcatttgggctgctgcacctggagagactctgcctgattggccagaaccaatgcatgtgtttgctagccctgagctgaaaataaatttgcctgatggtaaatactatgcagctgcaaaaagcactgctggtggtgctcctttccgtgcaataacagttagagatacaataggcgatttaccaaaggtggagaatggcgccagtaaactcctacttgaggtaaaattgcttctcctatatggctatccgctccattttatcctgtttcttctcttgatttatatgctgaatgaatcccctcttttgtaatgcagtacggtggcgaacccatctcctggttccagaagaagattagagggaacacgatcgcgctgaatgatcacatatctaaggagatgaatgaactgaacctcatcagatgccaacgcattccaaagcggcctggttgtgattggcatgacctaccagatgagaaggtaaatgccatctaccttgcggttgcattcacttccttttgtgctcttccatacattccttgcatcagcggaatgttaaccattatgagcgtgtgcaggtgaaactatcatctggccaactggtggacctgatcccttggtgcctgcctaacacagctaaaaggcacaaccagtggaaagggctttatggtaggctggattgggagggcaatttccctacttctgtgacagacccccagccaatgggcaaggttggcatgtgcttccaccctgaccaggataggatcatcacagtccgtgaatgtgcgcgatctcaggtaagctgctattgctatccatccattcaacattctcttcctgtcttctaagatattgtgaatttggaggggagtcagtactgaccgtttaactaacctattcttgtctgcagggctttcctgacaactaccagttcgcgggcaacatccagagcaagcacaggcagattggcaatgcggtgcctccacctcttgccttcgccctcgggaggaaactgaaggaagctgttgatgcaaagcgtcagtaggtgctcagagtccttctccgatgatcgagggagatgattctcccctgaaaagaaacaaacaaccaaacatatgagtgtacttattttaattgtgcgctgcatttaactttgtgtgttgattaagattttagtcatatagatccttggtaaccttgtacattttagaggttgtgttgtgattgatacccttgattcaggggtatgatttagtggctgtattcagatatttaaacaaaataatactagttagtgatggttgaattgttaccgtgggttatctggaaattcttgttttggtttgttcaggtctctaaaattttatttcagtttagtttggattttaagaattgaggtatattctcatttggctggatgcagtggaatctagggatttccatgggtcatggggtgaaggttttacttttgcatgaaactagaaagctagcccgcgcgaatacgcgggcatgcattttatttagttttgaaaatagttctaacaaaataagttgaaactaaagtaaggtatttttttaattgaattttcattgtttacatttttcttaagaagtctcgagaaatttttattgcttgtaaatttattcttttaccatccctgttagccctctttttaattgatgaaatatacatatcttatatagcgcttctcagtaatatgttagaccttatggtattttaaagaaaatgtctagtcaacatgaatcttaaaataataatttattatggaaaaatataacttttaatcatattataataagaaaggatactaatttgtattaccaccttagaggcttatacatgtaggttgtggagaaacccttggagctacttaaaggataggaatttactgaatttgaatttgttgatttatcattgactttcatctcttggtgtgtttaatatgactcatatgaagagaaatataaaattttggaaagaataaaatatcattatgttgtaaaataagctatgtttttctgtaacgaaagtagtagatttattcaatactatcttacgggttaagtgctcaactaaaatagttgtatacgttacataacaggttaagcacttcactaaaatagttctttgtaaatggattgcaaaagttattttcaaagatgacccatgagtctgaggcaaaaggctcgccacatagcaagctacacatttgagccacatgtgaaaagaatgctcacaaacaatcatttgtgcagtagtgtgattaaaataattatttatacaattaaaatgtttaaattcactatgtaaattaatggtacttgtgcccatattattgtttgccaacaatcgatagaacttgatagttcttttcggtatatagcaaaattagctagatattttacaactaattattgtatttcgttgctgagatgcacatgctattttttttctttatgttgcagtttcttattgttgatgaactgatgcctgggtgcatttgacactatacatattccaaataaaaaagtctagcggaatctaaattgatttcggattgtttcttgcatagtgcatgagacttcacataccccacgaatataatttcataactaaaaataactcggcaagcgtgattattattgtagtttggacttttcatgattgccgtcatgatttaaatatttttactctaaaatttataattaaacattaggaatttatatgctccaaacaatcactctttgtaactttcttttagctaacgtgcattaggaatttagtattacaattatgggtaaagtgttacccttaaattcattatattttagccacaacaaaaaggttaaaaatcctgacggccttaagagtataaatgtattagaattttgttttttcttcctcccaatatgtaatgaatttgaatataagaccttacatatagatataatactactaaaagtacaaacaaaaaaaattccataatttttgggatatataactaaaacattatatgttctcaaataactgatagtaaaaaaattgttgttagacttgatactgagatttgtgacaaatgaagtgattattaagaatatggttacatgtggcagttttttttgtaattaatatataggtaatatcgatgctatatatattatttatagaatagatacatcatatgttttataaagttttaaatagtgaataactgaagaaaataaggggggtaaggatagatcgctttgtaggtgattttttttctttggcaaatagtgggtaggtaattttccttacgtacatatataactgctggatatatgccgatggggataggaaagggaggtggaaaaaacaattctaatagtaatgaaaatagtgggtccagctgtttattaaagtgcaacgtgatggtttagcggtgtttgtaggactctcatatgacgacttaatagcgtttataggaagtttcatgaattttcagtatataatagaagacagacatatagatagataaaacagtccatatggttttaaattatttatttaattgtcaggaatataaagaatcaaactaatcagaaaatcaacatatatttttcaaaagttaatacatgcagatccactcatgcatgtagccctccatgaggaggacactgacgtataaccatggaagtctatattcaactgaagatataaatttaatgttgtttagattttattatgctttagatctcaacaacttacagagaaaagagagagcagatagcacatatacgtgcttgagccgtgagttggaattaatcttggctggtcgttcaggttcgtggttttttacaattaatcttggctgtgagttcttttccaatcatacgtaattttttgtgtttttttcttctttatttagatctttggctttttttttgttcggatggattaattgtacgtaaatattttctctcgtacgtgaacaggatattaggagtgagagactattttctttatagatctaataatttattggtctaaaataatgggtccaccactttaaatgaaaatcaaggttacatgttttacttttttttaagaatttctatgattattttctaatttattatagcgccacgtggtggcatagaagcgattgtagattgccacatggtgacttgagagcgtttataggaagttttatggacttttagtatataatagatagatgaatggctgataaataacagtttttaattggtttgccctcgtatgagggttgcttttactctggtgagaaagatcaaccaaatttcaaactcacgacatctaacttagatgccgtattgagttggagtactcagtatagtgtgtttgggatttcttcaaaatctgaatatctgattttttttttaaaaaaatgttgttctccgcatgtagtataactttgtttgttccatggtgaaaagttttggcgtgtcacatcggatacgcggacacacatttgaagtattaaacgtagattaataacaaaacaaattacaaaatttgcacgtaaagtgcgagatgaatctattaagtctaattaatctgccattagcaaatatttaccgtagcaccaccttgtcaaatcatggagcaattatgcttaaaagattcatctcgtaaattagtcgtaatctgtgcgattagttattttttaacatatatttaatatttcatacatttgttcaaacgttcaatgtgacagggtgtaaaatttttgggtgaaaactaaacagagcctcgatatgcctcaacaaaatgtaatgcattcccgtatcccacacataacaactgggtttttattttacctattcatataagcttcatgacaatgattttcttttcagcggttacaaaacaatcttgccaggtaatgctaatgccatctcttcaccaaatgtgaaacgatatgttgcctagtaattgcagtgacttgagtagcacaccaaggtcttgagttcaaatctccatagaagtgaatttcagattgagttatttgagggctagttccttgttcgataggctaagttcctattaaaaaaatgctgcatatatccgattggatatagagaccgggtaaaaaataccattctctaaaaaaaaatctcttcactaaatgagtgcagtgccttgctttgtgtttgccaattgaagttagcaacgctaccccattgcacaaaacgaggcgacggtttaacgtataattaattaagtatttaagtagtagtgaaaaacttaaaaaaatggaataataataatatggtttttaaaacaattttattaaaaaaatatagcgtttaacaatttaagaagcggcgaaaaatataagaggtgaagtgaggaaaacagagtaaagaacacagtcaaaccaagaaaattctatcaagcctagcatatatccagacacatgcgcagcgtgttcgtgtctaccaagtcgatatctgcggagccacacgaaccactctctgtacacagttacacagcctacccgcctagaactacaagtaaagtatctctatataaggcaatgaacgcgccgccgtcaacaacattccatttccagaacctccctgctcccgtgcgccgcgcgttccaccaaccccgctcacctccatctccaatggcggccgagccggccgatctgtacgtggaggtggaggagtccgcccgcgacgacgacgtcgacgtcgacggccgctcccgcgtccccgtccccgtcccctccccctccggctgggagctcccgccgtgccccgtcctgcgcaacgtcttccgccgcctcccccgcaacccggacttcgacggcgccaccttcctctccaagccatggctcgagctcccctgcgacgggcccatggtgatcgccgagccgcagcggctcatgccggcgctgctgctcccggaggggatggcgctcgacccggcctcccgcgccttcctcagcctcgccgacgggcgccgccatgacatcgcgttcccccacgcccgcggcgcgcgctgcgtcgggagcacccgtggctggctcgtcatggtcaggaagggccccgagggagtcgccggcgccgccggcaccgccaccatccacgtcgtccacccgctgctcccgcacctcgagttccgcctccccgacgagttctccctcttcgagatccaggtcaccgcgcccgaggagcgcttcctcctgcgtctgacgccgtccgagaaggcgcgcattcgtgcgggcctccccgtggaggagacgggcgcggagttactgcagcgcgtgttcaagacggcagaggggttgcgcccccccgagccctacatcaccgatgtcacgctctcgtgcagccccgccagctccgacgacgactgcgtcgcgctctgtgtctaccgccacggccgttgcctcgccatcgcgcgtcccggggacgcgtcgtggacgcgcgtcgaggtgggctgggaatacatggagccgcacgagtacaggcgcgagttcctgagcgtggtgcaccacaagggcagcttctacgcggcgtgctacgacggcatggtgctgcgcgtgtccatcccgccgcccggcagcgcgtcgccccctcgggtcgacaagttcgcggacgcgccacgcagggagagcatccggtgggcgcggtggtggctcgccgtggacaccgcatcctcctccgccggcggcggcgcgctggtgctcgtcgcgaccgaacggcgctggtggaagcagaagatgtacatgtgcgcgttccggtgggacgacgagctgcggttctggcgccgccccaaggacttgggcgggcgggcggtgttcgtcgggcgcggcacggcgttcgtcgccgacgcgcggcacctgccgtggtgcgccggcaactgcatctacttcacccgcgacgagcgggtgcgcaccggcgacgacgtgccggtgcggtgctgcgacgtgcgccgccagaagctctactccgtccacaatgcggggcccaaggtggcgatggccccacctgtctgggtcatgccgttccatgaatagcgcagagattttgcatcagagagatcataggtactatgtggattgtggtgatgcttgatgtaaattctctctttgagacttttggctgaatttcgtacgaactacgtgtatgtttgtcataggaattgcagattttagatcgcatttctggagtaaatttcctgcaaactgtaggcaagttgttatagcaattgaggaattctggatattgagaacttcgtgtgcctgtgcaacttgatagtactatgcattgagctgacacatttaagccggttctgaatcttctgtgaattttgctctgttttctcaccttttatacatgctagtttttcatatttgaagatgtgtaacattgtgttgtgtggcaaaaatatgtggcagttttcattgatacggtggtgatattcactagcctaggtcatattatgcatcttttggtgatgtaaatagtataccacccagttaggtctatgtcaacaaaatgcaatcaaaattattgtggaatactccataatttagtgtgtcgttcatgcgtttctaaaagttgagacaacaaataaccgatttgtctagtttagacaaaaaaaaaaagactccaaaaatgtttgatagccaacagtataaattttaccctcaatagagttacctcgactgctaggatgatttcaatacgtatttcatggccctccagttatggtggaccgtcctctcgagtctcggcctcccacattgctttccctctgatgctgtttccttccatgagtggcactactcctgccgactcaaagtttggagggagcgtcgtcgtgggttcaacatggtcgtgacccttggcgcgtggtctatttggaaggaacggaacaaccgcgcgttcaacaactgttctcggccctggttcgaggtggtcgtaggcatgtcacaagaggccgccctttggcatcttgcccatcccctgttgccaacgctttcttcgtagcgtgctaggttgtttggtcatctcattgtaatcgcaagaataggtttaagtcctccttttcttccaacccccctccccctcatttttttgttttgcctaccgtgtaaattttattcctcttaaaaggtgcgcaatctttttgcatattccaaaaaaaatacgtatttcatggggaaaaaaacatggacactaaggaggaacttagagtcgacaatttcgactagagttgagcgtggcatggagattttatttaagaagaaataaatgtggctttgtctatagagttttgtttaaaaaatatgtggcaatatatatgactttaggggaacattccaaagtcatgtgccgatgtatttagcttcttccaacatagtttcatggcaactgctaaatcaaatactacctactcttctccatagccgtatctccttgctctaattgtgcatggttaccaaccaaccgaacatataatatttcttcggattttggagtgggattgcagaactttcaccggaaatggtacaatttgtagacaagacagaaaacattcctgggcttcaacgagaaattgaccacgcctaaatgacttagcgcaaaaatgacgcagcgtaaatcaggtgtacccgtgggacccacacgcagtgacacggttttttctcgaaactgtgcgcctgtgccacaacgccgcgcgacgcactctacacagcgtccgcctatataatgcctggcgcgcaggcgcagctagcccaccaacccatcgtcacccacacaatcgcgcacatccgcaacaacgttaatccgcacccttcattctccgccgcgggcgctgcctcgccaccgcgtgccgaacatacaccaccgcacccacatgttcatctcgcggaccacgtaccgccacaggatgtacccgtaccgcagcctccctccgccaccgcggccagcgtggcccctcgcctgttgccccatttaccaaggaaccaaaaaatacttccaactcagcagtagcctagtatttcctaactcttactcatgtttttcttgtattttaacatacaatccatgtttgtactacgtttaataccacaataattcaaacataaatatttctaatgcatataatttaaccacacttaaattcacaatttcacacaccacaattcaaatccaaaatcaaaattttcaaacatgtaaatgcggtgtgagcataatgccatatacaacaacatgcaactaagattcataattcaccaatgaaaatgaaaattgctcaccaacatgtaatttttttttgtctccatatcaccacaataagctatgtgaatccggtgatgtattatataatttaaaaataacacattctacaaccatgaatggttcgatcgtaaaaataacacatcttacaagaatgaatggtttaggggctgtgtttaggtcctgctagagatgctcttaaccataactccataaacaagtatgaattgcagtaatgcaaattggacccaatagagtgacagtgtgtcagtgtgactggcaaccaatcttgtggcatcgataagtggatcaattagcctattcaagtttgtttctcaatcttcattgcaagcaaagacatgaatgtcaatgagacagtagccgtggaaaagttcagtgaatataccttgggaagtttatcaaaatttcacataaatgtatgtgtgatttcactacttcagggtcctcgcctacaaccattttggttgtggccaccgaccagcaattcgaagtgtgatttgaagcatcggccgcaccatgaaaccaccactacgactactgatggcttgctgagttgttagccctgtgatccatctcgaggatttacaatgcgaaacgcggagccacgactcgggataattggtgcggatgaagaagaagaggatgccattgtctgaagttgcagcgccaacgatggagcagacgtggtggcatctccggcgtgcgcagtcgatgtggttgctgctgccgcctcctcatcagaaccctgtggtggaagagcgagctgaacgggttggacttgccaagaattaactcgtctgttcatcgtgggagcgagcggggagtcacgatcccagtcaacctgcagatcgatcgagatatacatgcaatcagattgatcgatcgatcgatcaaacagcaacccagcagcatgtcgaatcctggaaaatggtgatcaaagaactgaagaacaattgattttgtcaggcaattatacctcgagcatgcgccactcgctccggcaatggacgtccctgacggtgccgtacaccggtggctggctgcggcggcgcgcgtcgtcggggttcatcagtaagcgcaccctcgtccccggagcgagcggcggcgagccttccacctcctcgcggcgcaccacgaactccgccgtgccctgccatgggcagtaggtcaccctgaacggttgggcggacgacgcgtcgagccaggcgtccgccacgtgcttgtcggggatcccgaccggcatgccgccgtgcggcttgcggcgcaccccgacgagcggctcgccgccggggcggcggcgcatgaagatcacggtgtccccgacgcagaggcgcttggccttgacgaacgcgctccagccggcggcgagcgtgtgggaggaggagcggcggtccgtgtcggcgtcgctccaggtgtggccgaactcccagcggccgccttgcaggttcgtcacgcggaggtccgggatccgcggaaggacgtgctcggcggcgctgggcttggggatcacgaagagggcgccgctgccgccgccgttcgccgcggcgtcgctcggcgacagcttcttgtcgaagaagcagaactcccgctggcctccgacggggtcgcgcgcggcgggaagcgggcggtgcgtgacgtagcagtcgcccggaaagagggaaatcatggcgtaggaatcatcggactgggcgtcgacagcgaatcgatgccggtgacggtgcagcgtaagcgatggcggttgtccgggatcaggcacgtcgtgcaggtgtggcattgctcggcgtggccttgggggaagtagtagaccgccgagccgacgacggggaggcggccggagtacggcgtggcgcaggcgagccagatgtcgtggtcgatgaccggcaccattcccgtcgtcgtcgtcggcggcggcggcctcggcagcgccattatctgaacttgcggggtggcaacaatggcatcccgaattcgcacagccgaagtagttgctgctggctgaggctgacgcaggacttgccaagaattaacttgtctgtgtatcctgtaggagatcggggaggccgcttgatcccaatcaacctgcacacatgcaccgatcgagcaatttcagatcaacgatcgatcaatcatctcaacatgcaacgatcgaattgatcgatgaacaaatcagattgggtaggaaggggatgatgagatgatgaaattaatacctcgagcatgcgccatgggcgtagatggtcgaaggtcctgacggtgcccgaaatcgattgggcgatctgcagcgggttcatccgcaagtgcaccgtcgtcccgggaacgaaagggtagaacggcgagaaggagaagccgatgtactcgtcgcgcgacaccacgaactcgaatgtgccctcccgtgggtagtaggtcacctcgaacggcgtcacgccctgcatcgccagccacacctcggacaccaccttgttgtcttcgaccccgggcctcgggtggtggccgccgcgcgcgcggggcgcgcgccgcaccccgacaagcagctcgccgtcgccgtcgccgtcgccgccgccgcggcgcatgaagaccacggtgtccctggtggcgaggcgcttggctttgacgaaccctctccagccgtcgttgtcgttgacgccgaggtcgccgagcatgtagcggcagcgcttcttgtcccagatgtgcacgaactcgaagcgcttgcctcgcaggtccctcacgtcgaagagccgggcggtctggtaggcggcgatgtcgagcggcggaaggacgtgctcggcgccggcggggaggacgagggcgttgctggtgacgtcggccggcgacagctgcttctcgaagaagcggaaccccggctcgccgtgggcggggacctggcgccgcgcggtcgtgtcgtcgtggctgcctggaaggagggagatggtggcgtacgcctcgccgctctcggcgtcgacgtcgaggacgaggtcggcaacggtgcagggcacggggtggatggggtccgggaggcgggagagcagcagcgcgggatcctcggcgcactgttcgatgtggccatgggggatgtagtagaccagtgtgccgacgccggggaggacgccggagtacgggacggcgcaggcgtgccagacatcccggtcgatgactaccggcggcgggacggcggcggcggcggcggcgtcaggcggctgcgccattgttcgatctcctccacgggaggtagtggaagtggtggaaatgtgttgaattcgaaattcgaattgacgccagcagatggggtttatatatacacgccacgccgccacctccacttcgttaacccttctcctttcgtcttgctaattacagtgattaatccgttattacatgtttctttcttgtcggctacgttttaaatgaccagttagttacaggcttacagctagccagcgtccacttgcacggttttttactgttatttcttttcgttttttctttttttttgcttgggttacctctctgcaaggaaaaatatcagtaaaaaaaatcgtctacattgttctggacggaggaggccagggttcaaaattttagaaatatcgaaccccgatatgatatttatttcggcagaaaattttaatgtttttaattttttcatgaattttaacaatatttgttcaaatgtgactaaatttcgttcaaaatatcggaccgaaattttgaacatatcgtcatatcagcgtcccgatacaaatacccacttgatataggaaacagtaaccgtcacctcgcctcgcctcaaacctcaattcgacaaatccatctcccgctccacccaaaacccctcgtcctctctcccggcgacaatggcggcggcggcggcgccgctcgccgacgacggcgacgggatcgtagaccgtgacatgtggctcgcatgcgccgccccgaactccggccgcctccccgccgtcggctcggtggtcttctacttcgtcgacggccacgccgctcagttttgccagttccccgcccctctcctggagcagctcgccgtccccggcccccgcgtcttcctctgtacggtggccgccgtccgcctccgcgccgacgccctcaccaatgaggcctacgccgagatcaccctcgacccggtcgccgaccacgacgtcccgcgcctggcccccgctcccgctcccgcacccgccgccgccgccggtggccagcagttgcgttacttcgtcaagacgctgatgatttccgacttcgacttccgcatccgcttctccgcccccatggctgacgccaaaggcgtcttcccgccgctggtcgacgccaaagcggtccagcccctcctcgtcaaggacctccatggatctccgatgacgttcgactacggcaggaagggcaagagagtcacgctcgccaaggtctggaagaaatttcgggacgacatggacttcgtcgacggagacagcgtcatcttcatgcgtcgccgcgacgacgacgacgacgacggcgagctgtacgtcggggtgcggcgccagcgcacgctcgaaaggccactcaggaatacgatgcgccggtacaggcctccgaccccgccccaggcggccgtgcaggaggcggtactagccgcggcgggtcacgcggcggccggcgagcggttcacggtggcgtaccggtcgcggaaggacggcgacgagttcgtcgtgccacgcgaggcggtggaggaggggctccgcgccagactcacctcgctggcggaggtggagtttgtgtgggccgtcgaggacggcgcgccgcccatcgtcgggccacggggcaaggtcaccgccattgccaccggacagctgtggcgaaatctcgaggtaatccattcttgacagcttcctgacatccatgccaatgaattttcattttgtttgtttgattgttttttgtccctcatcagcacagcatcatcatcgatttcgttcttgcatgcccagtgttactgttttgttcatgcaagattgatcactaccgcgtgattgattattactcaataattgcattgatatggattctactctgctcgttgtgcacatcttcagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaattggaaaatggtgtacctgaaatctgatatctgaagaacacgaacagttcagatcgagatgacataacgacaattttatctgttagttacgactaatatctcaaggctgcttcctgcactgaacttaaaattcatagaatgcagtcaaatcctgtcaggtttttggacgccgacaattctgatgatcatagatcagctaatggttcaattcacgttgctagtgaaaacaaccaaattgcgtaaagccttggctaatgctgtagtttagcagatggtttgggacttgggacagtcactgctcaaggactaggttcagagttgagacttgagaccaataatctatgttccgttgttacaaaaaaccgttgcaaggacggcaatctgaaacttgttgccggttgagattgagtggagctgtttgacaatacgtttaactgggcatcagcttcagacacagacgcagttacaagcctctgtctgaatggatgctactggtggttccgactgacattttacattggtgaaattattgtttgatccattgtgcattactgctggaaaatgacttatctttgctaaaaatccagtgaaatagaacaaatcaactcaaacctgaactttctgaaaattcagactcgatatctgaattctgaactgtttttagataaaaaaacaaatttaactatggttatacgttaactagttgttgtttaatttgttttttcttgcgagatgtacaaattgaatttaaacttgtatatttataaagtgatatatcacatgttaatatatcttctcaatttcttttaaacttttttttttgactatttcaatggcatgcaagcaacgaagatacatccgtgcagggatcgaaatagttccccaacgccgccgcctccacttcgttaatccttttctcctttcgtcttagtaattacagtgattaatccgttcttacatgtttctttcttgtcggcttacgttttactagttgggctagttagttacagctagctagggtccacttgcacagtttattactgatagtatttctttccttttttttttttttgctttggttaactctgcaacgaaacgtctacaaattctggacggacgaggcggcggccggcggcgacagtataaaaccccaccgcccccacccacttgcaagcgagaacaaacagtaaccaacgcctcgcctcgcctcaaacctcaattcgacaaatccatctcccgctgcccccccccccccccagttcctcggcctctcccggcgacaatggcggcggcggcggcggcgctcgccgacgacggcgacgggatcgtagaccgtgccatgtggctcgcatgcgccgccccgaactccggccgcctccccgccgtcggctcgatggtcttctacttcgtcgacggccacgcagagcagttttgccagttccccgcacctctcctggagcagctcgccgtccccggcccccgcgtcttcctctgtacggtggccgccgtccgcctccgcgccgacgccctcaccaatgaggcctacgccgacatcaccctcgacccggtcgccgaccacgacgtcccgcgcctgctccccgctcccgctcccgccgccgccgccggtggccagcagcagcagttgcgttacttcgtcaagacgctgatgtcttccgatgccgagtaccgagaccgcttcgccgtccccatggatgttgccaaggacgtcttcccgccgctggtcgacgccaaagcggtccagcccctcatcgtcaaggaccttcaaggatctccgatgacgttcgactacggcaggaacggcaacagggtcacgctcgccaaggtctggaagaaatttcgggacgacatggacttcgtcgacggagacagcgtcatcttcatgcgtcgccgcgacgacgacgagctgtacgtcggggtgcggcgccagcgcacgctcgacaagccactcaggacgcgccgatccaggcctccgacaccgcttccggtggccgtgcaggaggtgatagctgcagcgggtcgcgcggcggccggcgagcagttcactgcgacgtaccgctcgcggcaggacggcgacgagttcgtcgtgccacgcgaggtggtggaggaggggctccgcctccgctccagattcactcccgagatggaggtggagtttgtttgggcccttgaggatggcgcgccgcccagcgtcgggccacatggcaagatcaccgccatccacgacactacatggatgtggcgatcagtcgaggtatcctgacatcgattaattcccctgattctcatccgccatgccaatgtttttgaagttttcttgtctgatttcgttcatactgcagattggatggacgggaggttcagagatgaacaagtacgccaacttctggcaagttcgattggttggttcggacgattttgcttctgctgctcctccccctcctctttctccaaagaggctgaagagttcagaggtagctacggcatctacttcttcatctccctgcaatggatgtctcacacattgatcgacttgtaaacgcacgcacacgttgatcgatgcaacaatgttcactatttggtgaattgatcgatgcaatgttcaatcgcttttcaggatcatctgcctccaccaaaggcgtcagcgtcagcggcagcggcaaaggcttctccctcttcctccgcgcaggcgcagcagttcagtatcacacgcgagatgtggcgggcatgcgccgcccccaagtctggccgcctccccgctgttggctcatttgtctactacttccctgacggccacgcctagcagtgcccgtcgcgtccaccagagccccttccaggcagggtgtttctatgtaaagtcacagctgtccgcttggatgcaacaagaaatgagctctttgcgaccatgtccctcatcccagtcgccagagaccaagccatccagcctcaggcgcccgctgatccaggtccaagctcccctcaagtgcagactactcttgtttcatttgtgaagcctctcacgtgcaccgatgctgtcaagaatcggtatcggttcatagtgcccaagagagagaccgccatgggtgttctaccccagctccaattgaacgaacacgtgccgctctatatcaaggacatgcacggaaaggagtgggtgattaattatacatggaaagagtacacccacatgctttccagtggctggataaaattcgcgaatgccaaccgccttgtcacaggtgacaacgtagtgtttatgcgcagcatggacagtggcgagagatacatggggctgcgtcgcaccctcaagccggagccagtgtcagttgacgaagtgattgaggccgtatggagggcggcgcgtctcgagccgttcgaggtgacctacctctcgcgccaggacggcgacgagtttgttgtaccgtgtgggattgtacataatgctctacgagcgaagtttaccccaggaatggtggtaaacttcgtatgggctgttgaggaggacaggctgccgaatgttgggccacagggaaaggtcattgccatagagaactatgcaacctcaatctggaggatgattcaggtattactgtattactctgaattttgctgcttgtttaattgcaaatgctttcctaaattgtgccttggatattaggcatcatgagtagttgtaactttgtaccagatctagtgctagcattttgtgtctccactgaaattgttgcattgtccatttttatctgacactgtgctgctcgccaggttgagtggccatcctgtgcaggaatgaacagatatgttaatttttggcaaattcgtgaagttcttggagagagttcctttgaggcatccacttgcattgtgagaagtcaagattactcgccggcaccacagaggaatttagttaatgcgcttcagcttcctgacggaacaaaacagcttcagcaaaacaagaagtctgtttcctcgtcatccaccttccgactctttggcaaaaaaatgacacctggcgtgccaccaagaagagacaccagtggtctttctggacaggtgagctcaacattgcagtaacaaaagtttgcattctcctattgatgatcatggaatttgtaggtatcattattcagccattatcttccccatgatgaggacgatggacaagttccaacgatgaggcaacggctagagacgctgtttcctgataacatctgaggccaaggacacctacctaactaaagatttgctctgtcacttgtgactttgcgagactgggtccgtcatgaatcatctatgccagctttggtctgaatttagtttgaaggttattctgaatagtttcaaaattcggggaacaagtttgcagtgttaaatgtccattctaaatctgacggaattggaaaatggtgtatctgcaatctgatatctgaagaacgcgaacagttcagatcgagatgacataaccgacaatttcatctattagttacaacttacaactaatatctgaaggctgctgcctgcactgaacttaaaatttttacagaatgcagccaaagacctgtcaggttttcggacgacgacaattctgataatcacaaatcaactaatggttgaattcctgttgctagtccaaacgaccaaattgcataaaagccttggctaattctgtagtttagcaaatggtttgggagcagtccctgctcaaggaacttggtgttttgccaggttcagagttgagaccaatatcctctgttccttggaccagtttttcagacatttttacaaaaaccgttgcaaggacgcaatctggaacttgtcgttgccggttgagattgagtggagatgttaaataactgatgacggcatcagcttcaggcacaaacgcagttacaagcctctttgtctgaatgaatgatactggtgtttccgactgacatttttacattggtgaaatggttgatccattgcgctggaaaatgacttatctttgctaaaaaaaacccagtgaaatagaacaaatcaactcaaacatgaacattctgaaaattcagacttgatatctgaattctgaactcaatccaactcatctcggtgtcgacctatataatgccccacgcaacccccagtccgatcgcacatacttttcagcccaccagcccgcacgctggtttctcattatgggcccatcagcccacatgtttgtttctttcttcattatttttggcccaccagtcctttctttttctttttcgcgggtttcggcccactatgtgtacgtgcttcctttccttttttttattttccgaaattttcaactcaaatttgattcaaattgtaaaactttcaaaacagactttgagaacttccaactccaatttcaaaacttttaactcagatcttaaatactttcaactcaaattttaaaaactttcatctcaaatataaaaaaatttcatctcaaaattgaaaactttcatacctaaatccaaaattttcatctcaaattttaaaaacttccaattcaaaattgaaaactttcaactcaaaattcaaaaacttttaactcagatttaaaaactttcatgtcaatattttgaaaactttcaaattgtattttgaaaattttcaagtcaatatttaaaaaattttaactcaaaatttcaaaagcaattatttttatttttattgagagattactgtagcattcgctaatagctatgattagcactaatcgttgggattagcgacgtcgcgtcatttcgctaagcggaggccgcgtgcgcgcgacttaagatactcgcgcgtgcgcgcgagctatctatcccccgcgcagtcacgcaggcgcagcgccgcaacaacattccacgctcttccttcaactcatttcgctgcgccgctcgtggtggaatgtgggcgaaggcgtcggatctgtattgtgaggaggccgaccgcgacgacgacgacggactcgccgccatcctccacgacgcctgggagctccccacgcgccccgtcctgcgcaacgtcttccgccgcctcccgcgcaacacggacttcgacggcgccaccttcctctccaagccatggcttgcgctcgccgtggacgggcacaacgtcgtcgccgacgggcgcttccacgacatcgccttcccccacgaccgcggcgcgcgctgcgtcgggagctcccgtggatggctcgtgagggggcaagggagtcgccggcgccgcgggcaccgccaccatccatgattccatgtcgtccacccgctgcttccgcacctcaagttccgcctccccgacgagttctccctcttcgagatccatgccgccgcggacgagaggagcactgcgattgccactctcgaaggaggcgcgcctccgtgccggcctccccctggaggagacggacgccgagatgctgcagtgcgtgtacaagcccgacaaggagaactgcccctacatcaccatggtcacgctctcgtgcagccccgccggctccaacgacgacgactgcgtcgcgctctgcgtctaccgccgcggccgctgcctcgccatcgcgcgccccggggacgcgttgtggacgcgcgtcgaggtgggctgggagtacatggtctcaacggcaagtacgtcagcatggtccacctcaacggcggcttctacgcggcgtgctacgacggcacggtgctgtgcgtctccatcccaccggcgggcagcagctgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtatcgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaactttattgccgccttctcccggtgcaggacgtcaaatgcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccagatttttcggaacgtttccaaaacaaaaacgaatccgaatttgcagcaaaacaaaactgcaaaaggaggctgcatctgcgcaagggtgagaagccaattttttggaccattcgacgcgtacgtcgtgcacgcgcgccgcttgccctgccctgccaggcgaggcgaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccatcgggtggagcgtataagtcatactcctaggtctttagtaagcttcctagaagattcacccaaaatcttcataaactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataattcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggaccgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgtctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaataataccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatcctttattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcagtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggtacacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacataagcatgtgacccattctccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcgacatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagctattttgtagtcatgaaactgctccatgatatacagatcattgctagcatcagtagcactgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggttgttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaagagccaatttttcggaccattcgacgcgtacgtcgtgcacgcgcgccgcctgccctgccaggccaggccaggccaggcgagcgagcacgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaagacccattcattaattccaacagcagcaacagtgcgtcgtcgtccccgccgcggggggagaagtttgcggacaggccgtacagggaatactgatccttgtggagatcgcggtggtggctcgccgccgacgactggtgttcgtcgggacggagagctgcctgagcccctgggacgacgacagatacctctgcgcgttccggtgggaccacgagctgcggttctggcgccggccgccgggacaggagcttcggcggccgcgcgctattcctcagcgccggcacggcgttcttcgcgcgacgcgaggatcctgccgtggtgcgccggcgactgcatctaccctattgacgacgagagcgtgctcgccgggaagaacatgaccgtgcgctgctacaacatgcgcagccggaagtatagatggccatctgggcggcacggcccaggcacggccgtgctccggccagaatctatcgggcccacacggcccgaccaacgccagaagcatcggcccaggcacggcctaatatgactcgggccgggccaggccggcccgatggcacgacagcccatcgtgcttctttaaaaaaaaaataatttcagtccctcatttctttggaccatgtctgaaggaaaaagtacaccaaaggtccctcaacttgtcatcgggttacaaaatggtccctaaacaggtatatcacatcccttagcttacaaaaccgttcactcaaggtccttaggtggttttgaacccggttttatctgacgcggtggctgagtcagcgtgggacccacatggaccccacgtgtcagggtgtccacgtcaccacacacacactctctctctcccctcttctctccattcctctctctcatttttcccctgggcatggatggcggcggcgtctttgacgcggcggggaggagacccggcgtggccggcggctggaggggaaggagcgtggcggagaggagggccgatgcgacgggcggctccgccgatggatgtcgtcgcgcggatggccgcggcggccgtccccctcaaccgtcggcctcgacgcggcaaagcaatccaaaccaaatcaaataccgagccgatcgagtctagctagctagctcgctccggcgattgaccaccaccaccgcttgcagcggtagtgatatactgatatggcggagaagaggctactgctgccggtggcgctgacgatggcgcagaagcatggaggaggggagagggtgtgggagcggccgtggaggtcgtcatcacgcgcaggggacgcggcgttcgtggaggacgtcgtcgcgcaggcgcaggtgtccaacttccggtcgtcctcatcgtatccgccacgcgcgcttctgatactctatgagcaatcgacgcccgcccctctgttcgctctctctctctctctctctctctctctctctctctctctctctcacgtggctgagctgacctcgacgggcgatgtggcggcggcggcgacgatgtgggagcaagagggccgccccccacgccgccggcttcggtcgcctctccaccagcttccatggatgacgacggcggcctcctcgctctccccgtcggctcctcatcctccgtgctctgcgaggacggcgcctcgggcgccgccgaccgctccacgctgctcgccgctgctgctcgatctgaacctgtcggcctcgtccccgtcggctgttgccgccgccgaagccgacgagatggattggtggtgcgacacgctgctccacctctagcctgcacaacaccaaacaatggcagcaatcgccagtgaactctagcctacgacgacgacgacgacgaccaaccagcaagcagcaagaatcggcaaactggtactgcgttgctacgctccaatccaaccatcaccattgctgctgctgctactgcgaagaagctctaccatctccttcatagacacggatatttttttttattttcgttttcctccatcactttttcaccactcaggatttcgtttccgccgcctctcttttgcatctctgtatccaaaggggatgctgctgctttcagctgtaccaatagctagaaaatggtagagaagatgagaaaatttggttcaaaatttgtaatgttcagatcgagcagcagtggcgagcagcgtggggcggtcggcggcgcccgaggcgccgtcctcgcagagcacggaggatgaggagccgacggggagcgcaacagggagagcgaggaggccgccgtcgtaatccatgggagctggtggagaggcgacggaggccggcggcatgggggcggccctcctgctcccacgtcgtcgtcaccgccggtcgccggccgcctgacctcctctcccacctcgccccgccggccggcttgcccagacgaaggacaaatttgagagagagaaggaagggatagaagaggggaaagagaaatagtgatgacgtggtacctgacacataggtcccacgctgactcagccgccacgtcaaataaaaccgggttcaaaaccacctaagcaacaaaagtaaacagttttataagttgaggatgtgatatatctgttttgcggttgaggtacgactttgtaactcgatgacaagttgagggaccttcggtgtactttttcccatgtctgaatgattgtagtaagtctatttacatcccttatttcttgggccgtgaattatatggctgcaataagtctaacttagtccctaaagtattttcttccctcctcattgaatcaggccgtgccgggccggcccaccgtgccaaggcatcggcccaggcacggcctagctgtcgggtcggcccggcccggacacgaccccaatcgggtcgcgccgtgcctgggcctatggccatctatagctggaagcttctgcgatgctggggccaaggtggcgctggccccacctgtctgggtcatgccgttccatgaatagtactgtacagagacatccatccaatgatccaagcaggtaaatcattgatgtgtaggagtttgatcaccatttgttcatttgttgctaggtgttttttcatgtgaattctatctttgagtaaatttcatacgaactgcatgtaagtttccatagctaccgaggaattccggatttatgattttgctttgtataattatgcacttcaaggcattttcttatagctgagagagctacacaatttgcatgtgctaccaaccttccatttctgattgttttgtgaaattgctagctgtctagttttactcccagagttccagtgctagtgtttgttgaagatttttgtactggagtagtattttgttgtgttgcaaaaatgtatagtggcttatttgattttaggatgtttaattttttaacttgattctaagtgtctttactttgaaatcagtattagtagctgcaatactgttccaattttgcaaagctctctgtctttcatgttctcgaataaagatttgcctgttcaagagtttgatcgtccatatgtattaagcagattagtgaaaatatttttggattagattttagtgaggactacatgtatgctatatggatatagaataatactagaaaaacgtcccgcgcgttgccacaggatgtgtgaaattgaacgataataaataaatataaaatatcaaaatattataaaatcattttcttacttatatataaaatgagaatgacgatttgaggattttagaaaaaaaataaattgaacaaatgacttttttctaacttcgatgatttattttttagaaactaattatgaacatcacttcatatatgactaagtattcaattctctatgattttgtaggagtttaacattgacacaattaatacttcctcctatttgtgtacaatggacataatatataatacaattaatattgtgtttttcattgtacgtttaattttcacttgagatgtggtgttccaacctctgttcaaaccgatcatgttaaatttaggatcctactctataaaatcaagttttccaagttctcccataatatcacatcttttctcagattttttttatacctatacgatttatctgcttaatttccttccataaggttattgtacatgattaatatggttcatctagaagtttttttccatagcaatgaatgggcgtagttagtctcataattgtgatagattttattgtgcttgtttttgttactcttgtcgtacaaatcgatatagcaaaaccggttgatcataaattgttatgtttcagttatgagatacaattatttgaagctcttaagatacaattaaaatcttaattgcaatttgtcagaaataactgcacattgcggtagtttggtgtggcatcatcaatgctatcaaagctatagtaagacatttcttcagtggctatgtggttaataatttgtgtatttatagcagcagcgatctcatctgttggtgctaaaattgcacgctcacataagtaggttggtagctgtgatacatgtggtattgaaccatacacaaaagaaatcaaacctgctaggttcctttcttcaaccggtagtaagagatatgatggaattttcacccaggtggtgtccggtcgatcagcgggtgcactatcatggacaacaccatcacccaaaaatagaagccatgttgcaaacagctcaagctcaaacctgtcttaatgagaaaaggttggataattgagcctcatgttttcagttaattcaagcaccacacaattttgccataagtgggagcgagtgatcaaggcattcaggatttgttgctgtcttgcattaggaataaccggtagagtttgcctaaagtctccacccaagacaattgttataccaccaaattgcatgttcactgaattaatcatggttgatcgatggcatgatatctctaacggtgcgatcaaatgcttcaaagcaatgtttatggttaacaggtgctttatcccatataatgggagatgtttgtcgaataaattcatcaagatgggtgttctacaatagagagtggattttaaactctcaagtggatgatccctcattatttacatgccactcaaatagttatgaaaaaaattataaaaaatgagaagatgtattattatgtgatatatcgctctacaaacatgcaagttaaaatttaacttttacaagttaaaaaaataaattaaactatagctagttaatgtatgttcccagttaaatttgttttttcattgcgacatatagaagttgtttgtgaagtgatctatcacatgttatatatcttgttgatttttcttttaaaaaaaattcttaactatttgagtgacattcaaaccttaacttagaatagtttctttatataatggagtttcaagccaatttatagataaaaaaaaatgtgaagatgtcagcttatggtagtgtgtaccggcggatgagtattgggccagttgtcgctgtcggcggcggcgaggtgcatatgctgctatgggcttcaatgggctggtttcatcagaagttaagtatatgtgcatgcgtcaggaataatttcactttgattcccttaactagtggaagaatctggttagtatccctaaaccgtaatattggttatcttgactccccaactattaaaacatattcgatttgcctcccaccacggttttggagggctgtttgcagatgtagcgtctacacggggtgttgatctggtcttcgttccacgtgatgttgacgtgacgcttatgtggtatttgaatttaaaaaaaaactaggtgattcccttcactttgttgcgggaattacttagaaattcttaatatttttttgacaatcaagctaagagtaaaaaagaaaaaagaaatgaaacatccgggttgatacccgtgctttagtgtgaacatattgataagtatatgttaaatattgtaaaagtgatagatagatttgttaaaatattatgcaaatgatacgaggggtgatgattgatatgcttgtattttgatttgtataattaaataaattgtagatcatgtttatgtttgcatgagattaaatatgtaattattgctagtggatgatgatgtggcatggttgcatgttgagctatagacttagtgtgctttaacttatatagaaagcatagatatgagggacccatgtcatcctccttcacattctttcacaccttctttcgtcgaggaattcttccacatgtcatcctcattcaccttcttccgtcgagggagtcaaattgagccagtcaagatatctggtatagtgattcagggatatgaatgagattctgccgctacttaaggccttgttcggtttggaaggattgaagaggattgaagggagaataattccacaccacaataggtgtggaataaatcccctccaatcctttcatcatggggattaaccgaacaaggcctaagggagtttttacttttatagatattgttggtcaaagtagcatttcgaagacgatgttagggtccaaaaatacttatattttgtgacggaggaagtagatcaaaatcgtattacaactcaatgactagtgcactgtacccttgttttaatatccagtagtcctcggttgcgttctctttgagcttaaggctgaaatccgctctacatttaataagattcacaaaaggttggatattatttacattgacaatgaaaaaaaattaactatcatgcaaactattaagatgaggaccaggagattgcatctttggcgatgcgttgtaataggatggatcacgcttcccacataccatagaattttcgtcagtcattctgcctgatgcataacaccacatagaacaatgtttccagtgcatggtttaaaagagtgaagcaattctgcagtcggggtgaactaagcgagactgaaagctaaggttgcccagaccacacgagccaacacaacaagaagacccgttgcaacgtatgaatatttttctagtaatataaccaaacaaccacgtgaatacaaattatatgatgatatgaaaccaaacttttcattgtcacacaccctctagacataacggacttccagtgtacacacctactccagcatagatgcttgtttccgttatatccaaggaaatcttagttaccgggttataaatctgcacgatcgcttttgtccctgcttgcaaccaaaacactacctctccctcgtccgtcacaaccaaagggtgcactttcacataaactccagttccaaagaaaacaaaatcaacattaatcctatattctttcgaccacgtccccttgtcaaaatcagtcagaaaccacagatccacgatagaaacgtgatctttccaatgcgctgcagacagagtgcccttaagttgagctaacatgagatggccggcgaggccagtgtagtttactgtgccattagcatcatgaagaatcgtctttgttggcccttggagagtcatgctccattgctccgtttcaaggtcgaaggaaggcatgcagcctgtccgtatgagggaggaggcggcaacgcggttgaagtaggacaggaggaagtaagccgcgcctctgtacacgactccattggtgaagctccaatcgaggtagtccggtgggttgtccgccttcctccactgaggtttcgtgtcgctggtggtgatgatctccgacacgtgggagtagtccctggactccacgatgcggagtagcttgtgctcgcctgtgtgagatgtgcggccaaacgcgagccaaacacggtctccgcctctggtgcgacggcgaggtaagtgcagccgcaggggatgtgcttgacgacgttgccggaaaggtcgacgaggttgatacgtggggtaggagaggtctccacgccaacggcgaagaggagggcggtgtgagggtggcgggcggcgtgcgcggcggctaaaagcgggtcggaggtgaaagaccgccacgagtggcagacggcgcggaggcggcagatgggcttggcggggaggcgaaacaagacctcgtgcagcatctccggtggcaacacgccgtccactgttcctccgtacccactgcaaggcgccgccgacgaggacttgttaccgacgcgagcacgagtagtaggaccgccacgacggcgagaggcagcgcgcttgggcatcacggcggcgacggtcctcttccggcggggtctagaggacggcaaggaccggacgggcttccccatgtgttcctgcggttccgaattccgacggtggactgagggcggcagcgatcgaggctagggctcaagataatagccgatcgaagaggaggaggaattcgaacccggaacgacgctcacccggtgaccggcggcgtcgggttttacgagggaaactgttttaacagctcgagtggacgtccacccgtttattgcatgtcatctaaatggttatgaaaaaaattgaaaaaatatgaacaatatatatatatatatatatatatatatatatatatatatatatatatgtaatatatcactccacaaacatgcaagttaaaattcaacttgtacaaattgtagcaaaaataacaaacaagactcaaattaatatgtatatttacagttaaatttgttatttttgttacaacttatagaagttgaatttgaacttgcatgtttgtggaatgatatattacatattgatctatcttgttaatttttttgaaaatttttcataactatttagttgacatgcaataaacgggtggacatccactcgagttattagaatccatctccggttttacaagggctctctcggctgggctggggccctcttggctgggccgaatgggaattaaaagagtggcccgtgacgagggggaaggatggaagcccggacgggacaactgtgctggtgcagtgggaagaataagtctattttatctcctcacaaaaaaaagagtctattttggcctccctaacctcttatgctttgatccaatcacatcccccaaccataaaaccgactgtaatgcatctcccaacttcaaaaactgatgcaaatatactccttcggtgatttaagaagtggtttttgctgacgtgacaggttgaccgactgagtcaacatatggcccccagatgtcagtgaaatgtgaaaaaacatatagggggacccacatgtaagatatattcattttctccttcctccacctctccctatttcctctctttctctgtctccatacctatcggggtcaccgtcgggagtggcgcggtgaaagggagctggtggccgatggagggatgcagaagtcaacgatgatagggaaggagctaaaggtcggtggtgaggccgggaggttgatacagtcaattagccggagaaaccaagggcggtggcggccttagatccagaagaggagccaagagagaggcgataggtagtcgagatagagagcccggtgctagcaagcttgcgttaatgcaaacggagcttgagctctcgctacagagacagaggggatccaggaagagggcggagcttggggtcccactggtcgcaggctcctctctcaaacctcagtggcaggggagcttgggttcccgctgccccatcaaacctcagtggtgggtggcaggggagctttgggtcctgctggtcgcagtctcctctctctcgagcagtggccacaacagcctaatggtcgacgagatcacggtggcgtagatggaacttgggatcccgtgacagatatggaggggagccgcgcgagcaacatgtcatctcctctctcccgagtgacgcgggcggcagcgcactggcgtcaccaagcatgatgatgcggcaactgttgtggatcttcagctcgaggtcacgaaggtggcggtagtgccatggaggtggtcgtcagggaggaggagcagttgcgtggaggtatcaggggtggaggctagcgggtgcgtcatggggaaagagattggacacctcttcatcccctcctcctagcaaaaagcagctccattgtagtaatttctgttgaacttgccgacgaagactagagagacttggcaaagaaatccttgaattcttaggaaccaagaaaaggaggggaatatatgaccccatcaaaatcattcattagcatccatgaaatggaatgtagtaagcaaaggatcggtgcttttcgtattctcttgggaggagggtttgatgttgtacaaccactagattggtgaatttattattaaattgtggtgaacttgttcaacgtatatttacccgtgataactcttttttgagatacaataaataatattttcttacatatatttgtatataatctctcatatttctcaaactgggggtaaaaaggtcatttcaagttccttttggtgacataacactctaattaggaaaaatctctcactcatatagtgtttgtgtaaaaaaaatggaagaggggcatctcaatagagtcactccgtaggagtggtggcaaatacttaaaaaccctgttatagtaacaacaggaatagaaataggagtaaaagtggcatttatagtactactctttccgtcctaaaatataacaatttagagggtttaaaatttgctaaaaaaatataataatttctccactaacattctcttccaaaccaatcacaaacctccattattcaattttttcgtctaccttcacttctcaaccaatcacaatattcccttattcaattttaccaatttttttaataactgtattcaatctttaaaaaaattatatatgggaaggggtagtattataatagtggcaaatagttaaatttccacaagaattgaatggaggagaagagttgtctcccctgagttgatttaacacctctccacgaggtaggcaacgcgagttggcagctaatcctgtcaagtatatttttaagatggacataggtattaagaaaataggtagaaataattagagaaatattgtgattaattgagaagataaattatttaagaaattaaatagagaatgattgtgattgattgagaggagttggtaaatgaagaaatagttttatttcacaaaatgttaaagatagatttattttgagataaagaaagtaggatggagccactgggagagcagaagtgcgggttccaaaaatcagattttttttatttgccctcaaattggcttagatcatttaatgaagcagacgacaagcttttcatggagactctccattatatgcccattcattttttttccttttccaatcatttccgttgtttgattaaggtgcagaaattaattgaactttcaattttttttctgatcgaatcgccatgtaagtatcatatggaatgaagacctagtcaaatgggctttgtatgagccacgtcagttaaaatcaggttcaatactactcggcgggggactatatttgtaccggttttaaagttgagggtacaacgattctgattttgcggtttgaggatgtcttaatttgaaactcaaaaaaaaatgaggaatgtaaagtggacttttaccagtgaaaaaaaggtcagtttgtgagggttggcaaggaggaggggcgagggcgtattgaacaggtcaacaggaacaccctcaccctcgctgcccttcgggttcacccggccccggccctaaagtgaaaaacgggcgtaaaacaacctctgcacccgacacctccggggccctgtcacccgaccgaggccctgctgcacccgcatccgcatggcaacgaccgaggaagagacgatgaggcgtgatgcagtgggacgacgatgaagaggcggagcagcgacgagcaggcgtggggactgtggatggatgaggcggcctgacgacaatgatggtgtgtcgcaccggcagccggagatgaaccggcgcggagtagcagtaggcggcgtcgacagcccggctgcgtgggggcatagaggagaagcaggcggcccggttgcatagggacgcagtagcgtggaggaggagtagggtgacgctagcggtgccggcgacgtgggtgagtgagcttggcaatgacatcgcgttggggaacgcccgcgcgtgcacatgcagtaggcggtatagcgctagcttgggccggtggtagctagggactagaaaagggatagggagagaagaacttatataatacatacttaatttaacccggtttcataagtgggaagtgtttacacctaaatttggtacctatgaatgaaatagaggaaaattgtcaaagtttgaaaagtgttggatttcctccacagggccggtcataccataggtatatgggcggtctgactggctaatagagccggtctgaccgcaggtatgtggccagtcagactgtcagagtccgagtccaagtctgtcttcatcgggtctcaggtttccttactcgggaaggctatgtttcgtatttcctttgatttctatcccgagttagacgtggagaagggcctgtagagggcaagaccaacccctatttaagggacaaggccggttcatttgtaatcccccgaatacaatctcttttaccatgttttctattttacccaagttttagtccatttttttcaatttgcgctgtaaatcatctgccgctgctgcgagagtgcgacacctctttgtaggtttgtcctgaaaaccttccgttttgcccacgagacgggtagttatcttcatattgatctaagtcggtctagaggctgattttgatctctaaatcgccttcgctaaccggtttagctgtttttctacaaaacccatcttgatttggtcgtttggctagatcgaggtggtcgattctatatcacctcaaggcgtttaggtgttgcgatcatgcttgtcgacttgtcacaaaaagttaccaacaggagggttaagattttcggtatgggatcacctatacatttgtcaacaaattttgttttcaaaacttgacaaatgtaattgtagtacaatcgtgatgtaattacgttgtaacttgtatgtaactttcaaaaatctctccgtaatcggtgaaacggatgtcctgggaacgaatcctctcacatgtgtgctgctatgcgcgctgtgatttttttctttcctcacttgcacaattacggagaaacaaatctaccggttcaaaactatgtgaaagttacatacaaattatattgtagttacatctctcaaatttttaggagaaaatttgtccacaaatatgtagctaaattgttatgtagtacagtttcgaaaccgctaaaaagcggctagtcgcgcgtctcccctccctcgtggcgcggccacgtggcgcgaagagaggatggccacggtggaacggcgcgggagcgccacgtgcggcacgtttctccggtttttctggtttttccctgatttctttcggcggcagataaaaacgtggcggcggcggaatcagggaagacgaggaaacagctgccaccggcgggcgcaacgctgccggccgtgacgccgctggctgcgacactgctagccgtgacgccaccgggcaaggggctgcaggtacaggcaccggcgggcgaggcgccgctgccgggagaggcgctggcgggcgacgcgacgccgccgggagaggcgcaggcgagcgcggagaatcgccgggcgggagcatttcgtcttcgcacgggaacgagaggagagagaggcaggagtgtgagattgggagcgatattcgcgagaatactcgcccgtatataagccgagcaaggaatggggagaagggagttccaaaacttatgcaggagggtaggggatttgttggagctgttttctagactaaaatccctcaaaattagttttgggaatcagataggttgactgttggtgatgctcttagcgcgctcgtgcagtttaggatatgaattagactatccctttggcctgaaatatttatttgcgttccgcaagtgaaatactccattttgttaggcccatcaaactaacaagcaccagagcccacccacgatcgaggccaggcaccatccatgccgttgccaagttgccgtcgacgagagcagaggccaaggcaaagctgcttccagaatccagagtgccacctccgtctccgagcacggcagcaacggccacaggaatctgccgtgcagagcacgctatcctcatctatatatttctctgaccacttcgtcctcacccctcccccatttcaaatcacgcccacctcaattcagaactccacatggctgccgatcccaacctccccggccgtggcggcgccacctcttccccgatggtctccagcctcggtggcgtcgacggcgagggcgcgccgcccccctctcccatccttgctgccctcgctttgtcgactgtctccgcggcgtcgagcgcgcccgctaccggcgccaccgtttcccccctggtctccaacctcggtggcgtcgacggcgagagcgcgccatgagcgccgcctccctcccccactgtccctgcttcgtcgacggtgtccgcggcgtcgagcgcgcccgctaccggctccacctcttccctctccagcctcggtggcgtcgacggcgagggcgcgccatgcgcgccgcccccctcccccatccctgctggccccgcttcgtcgacggtctccgcggcgtcgagcgcgcccgctacccgcgactacctcggcgggatcactggccaccgcctcggccaggaggacgactccggcggccacgagtacacatccgtctccggcatccacgtccccagcagcagcggcgtcgccttcgtgtcgttcggccagtgtcctcaggaggtgatctccaccgacctctgcctcggcttggggcccatcgccgccaccgcaccgctgcaacctcctccacctccagcggcggcagcggcagcggggtctccgtctgctacgacgccggagccaggacatggggaagcgacaccgacgacaagttcctccgcgcagtttcagacgcaggcgcagcaggttacgcgcgacatgtggatggcctgcgctgcacccaagtccggccgtctccccaccgttggatcattggtctactacttcccggacgggcacgccgagcagtgcctgtcacgtccgcaggagccgcttccaggcagaattttcctatgcaaagtcacggacgtccgcctcggcgcagcagcaacaaacgaagccttggcaaccatctctctcgtcccgatcgccgccgacgaccatgccttccagcttcaggctcccgctgatccagaccctgctccagcccagtcccagagtctcgtttcattcgtcaagcctctcacctataccgatgtcaccaagaatcggttcatggtgcccaaggacgatgccgctgcgggagttcttcctcacatacagttgaacgatgatgtgcctctccgaatcaaggacttgagcggaaaggagtgggcgtttaactacacctggaaagctcacacccgcatgtttcgcaatggttggatggagttttctaatgccaacggcctcgtcactggcgacaatgccgtgttcatgcgtcgcggcaacggcgagatgttcatggcggtgcggcgcacgcgcaacaggccggcgcccttctcagtggaggaggtcatcgaggccgtgtggcgggcagcgcgccgcgagccgtttgaggtcagctattgcttgcgccaggatggggacgagttcgttgtaccacgtgacatcgtcgatgatggcttacgcgccaggtttgctccaggcatggctgtgaacttcgtatgggctgttgaggatggcaagctgccaaccatcgggccacagggggaggtgatttccatagagaactatgctacgtccattggcgcataattcaggttctgaatttttcttgttttgattgaagtgactgcatgtattgtgttgatagtatgattgatcttaatttcttctgctcattgtttttttttttttgacgcaaaaggtagagagactctaccttgttaccattgtattaatggtggtcatgaaagtaacaaagccagtggctggcaagagattatacagggggaacaaagaggaaggataaagaaaaagaaagataaaaaagaaggaagggagaagaaaaagaagaagaaagaacaaaacacaaaaaaaaacaaaaataaaaaggaaacctagctaagcttgtctgcccaagtgttgatatgttcgcgaaggcttggctttaggcgatgaacccataattggagactttctctgatttgatgaaagatgtatgcaacgcttgtttcagtgagcttgaagaccagctggttgcgtgctttccagagaccgtgcgaacaagcagcaaagcatgcagggcatcccggtttctggtgttctggtaaggtgtccaggattgattccacaaaatcttgtatgttagagctgcgcacggctgtctcatataggttgagtttcttccagacttcccctgctaatttgcaacgaagaatgatgtgatttgctgtttcaatagctgggcaggacatacagtgcgggttggaatcccattttttattaaccctgtttgcattggtgttgagcctgtcccggaatgctaaccacaaaaagatcctgcaagtgttggggatagccttgttccagataagtgttgccggctgccaaaggatgccatgataagtcaacaagttgtagtttgctgatgttgtgatatctgtggaaccaagcagcagtgttcttttgtcggggacattctgttgtatgtgttggtccaacaatatatccatgagggactgtaactcggtttgagcccgggaagagagaaccgggtgtagatcaattgtccaggtgccgttagtgtgttgggaggagactgtacagttgatatttgttgcgtaggaagctagtgtcggatatatgaggttgaatcgtcctgctgctgtccagtggtctcgccaaaactgcactagctggccgttcccaatcgttaccttagtggaggcaataattggctcgataacggaacaaactgtcttccaaatcggtgtttctgttggttttgctttaatagggatctcatttgccatgtgttgcgtgcgcaaccattgaaaacatggttctgatgagtctgataacaacctgcatcctatcctcataagtagagccaggttgtgagctctcaagtcaccgattcccaatcctccttgttccttgttgagagtgacagttggccaggccactaaacattgacctccttttactttcttatcccctttccaaaggaatgccctccttaggcgatcaactgcttcgatggttttgtctggccacttgatgcaggacatgaaataatttggtattgccgacataactgagttgatcatgatgagtctttcaccccaactgagaaggcctgggatccatcctgctatagccttcgatctattttgtcaatgactggtgcaagcaacttgtgtgagatcttggctgttgtcacgctcagaaattcacgaaccagaatttctaagctgaatgtgcattaaatccctgtccaggaccagctagggtacacaaacgacaattgttgacatacaaatccacgtcttacaaaaatataaagattacaaatgcagcggaaaagataaaagcgagctaaaccgggaagcttgacttcagcagcggggcgactccactccacaggcaatccttgacggcagtgacgaaatcaacttcgacaagacagctcccactaggaagatcttcagctctggtgtgggggaaaagagagcaagactgagtactacccactgtactcagcaagtcataccggaagaggaggtatgatgcaggatataaccgaaggaggctaaaggttcttttgcacaaagcaggcatttaaaaacagtagttgaaagcagtaaaacagttgtagtaataaatcaatattaaccaaacactgtccaacgctacaccacgttgcaacaggcccaaccaaccgcctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactacaaagggggaaatcgtgacctccacataactctcccctaaccatccacaccacgctaaggtttcacccccacccctcaaaaggcagtgggcggtcccctcttgcgccgcggtgaatccggcaactggacaaccggacaccccggccgacccaactccatcacgcccaccctcgccaccggtgcctaggaaagggttgagctatacttcagatcaagcagttacccactcccgcttgtggtaagcacggtaagtctcccagggtttcccgtgaaccggtccttaactgccatgggtgcgaccagctaaaccatgcacccacagcccaccattcagtgtattttaattaactaacaccactgcggtggcaccaatccaaaactatgctaatagacaaagtctatgtaataatgtgatccctttttgtgtactagttaagctaagcatggctaagcatttcctaaaccaacatctaatcattttgataccccagttatcaatggcatatggtaaacaatatatagcagagtattaggacccatcccacatgacattgtaaaagaatgcgacatttaatagaaatgcgggacatttgtaaattgggtacaatatgatcaattgtaatgcatgacttgccttgctctcgcactgatgagaccacagcaacgtcttcgagaaaccgcggatcgacaaaacagccgaaatctacgcgacaaacaaagcacacaagcaaaacatgctataagactactgaaacaggaaacaaaaccatttttaatggattctttgcatttttatgaatttactgagacttgaatggacttaaacgaagctcggatgaattacttatgaattttagaagataaactgtgtttttactaataaagaaaaaatccttaatcaatttattgtgcaataaatcccagggctgacgtcatccaagggggggctgcgctgacaggtgggccccgcttgtcagcgcacaaggggaggagagggggctcgggcaagtgggccccactggcagcggcacaaggtggccggtctaccgtggaccgggaccacgcgggtggtccaccgccggtccacgggaccgacagtccggatcggcccgaggctgatcggacggcgcgggcggcggttaggcacggctcggctcggcacaaagccgaccgaccggccatggcgagcggcagcggcgcgtgcagcgcaggccatccacatgtcgtgcggagcggcggcggacggcgcgaaaggctgcggcggacgtccggagcggcggcacggccaaaggcggcggcacggccaaaggtggcggcgcacgcgggaaggggagaaaagggagggggagggagtcctcaccggaggggcggcgaccggagcgggaggggatgagcggcggcagcgcttcggaaaacggcggacgggagcggcgcgtcctgggaaaaggcggtgaaggggttagggagaagagaggagccgcggcacggcgaggagaaatggccggagatggaaacaatggcgagctcaccggcgtgtagcgcccgttccgtcgtggcgcctagcgggaaaattatctcttaaaaaccctaattgcgaaatttgtttctttgcttgttgtctagtgtccgtgccatctcaagatctcaatccgcgatcgatcgtcgagatcaattccgaatccaattccttccaaatcgaatccctccgcaaaagtctagtttgcctcccccgggttcgatgggccgaattccgctcggcccatctcttccccggccccctccctctctctctctctctctctctctctctctctctctctctctctctcgctccccccccccggcgcgtttcccccccctggctgctcgcgcgagcgtgagccgcgccgagcgcctctctctccgctcccctccgctccgcccgcgcgccgcgcgcgcgtgcgcgggagtcgcccgcgccgagcgccccctcctctcgcgcgagctccccgctcgcaaagccggccccgcgcgccgttgctcgcgcgcgcgccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccatcgtcatcccccagcccccgccactccgcgcgcaagccgccaagaggcggaggccgagctctcccttccctctgccgcgtcgccccgctccctcctccttttcccgattcggcaaaggggcaagccccctttctctccctccttttcccctttccttcctttttcccctctcgccggcgtcacctcctgtcgccgctttggacgctagccggagcgccagctcgccggcttgaccgttcaatgtcggtttccctcgcccaaaccgacaataccgcccatttaagcccaagccctccccctccaaactctctcattttcgcctccgcgccattgccgccctctgtttcgccgtcgccgatcgtcgttgcgcgtgtcggaggagccggcacgagcaaggacgcggaagaggacttcggccgcgccctcttcttcctcttccccggcccgaggccggagagattactcccgcgccgtcggcctctcgtcacagcgcccctcctcatctcggtgatgcctccctccgttcttccccctcgccccatctcctccccctagctttcggtagtagctcgagtagactccccgtagctagccggcgccgccccgaccgatgccgtcgctcgccgtgtgctcgccgccgtcgccgcccgagctccgtagcaaccgcacgtcgccagcctcgctcggcgtagctccgtccaatccgacgctagcatcagattcccgtggtcacatggatgctctcaccgctgggaatcgacccctcgtggcctcgtcgccgtttccctcttccctcgccgccggttgccgccgccgcaatccgccgccgtcgagcaacctccggcgaatccgagccgttggctcgtctcccctcgtcccgtgcaatcgcccggtgtgctcgcttttgcctgtatcgccgtggctcgctccgccgctcgccgctgtcgcccgccgtccattcgcggccgagtcgtcgtctacctcccgccggcccgcgtggctgccacgtaggcgccacgtcggggccaacttgggcggcgaccggataagccgacccggccagccgctccctccgtttctccccgtgcgtgtggtccgcggtgagccgtgaggctgcgcgtgggcccgccgcatccgttcctccgcgaaccgcgcgcgtgcaccgcgtcccagccccgcccgcgcgcgtacgccgcatactccctccgcacggtgagccgagccgctgacaagcgggtcccacccgggaccacgcgtggtgagcccggtccaccggctccctctctctcctccctcccgcgcgcgcgcgcttgggccgtcttgggccggccggtccgttaagcttggccgagccgccccaaatctcttgggccgcaccctagccacccgagaaaagtatatattccctccctcctttcttttcttttccttttccaaaaaggatttaattaaatcctttttcctttagaccaaaaatccaataatcttagaaattcaatatattcccaaccgtaattccgtttgaccccgttcaacttctaaaatttcccaaatctcgagatctatctagtggcacgcttagaggtctttaatagggctttattttcgccgtttgttgagttgtcccgtttcgcgtgtagtttcggagcccgaagacccgcagtgcgaggatttcgaggatcaagctccggatcgcgagcaaggcaagccccctttgaacatcttgagcctatatttgaaatttaattatattgcttgcgaaatattatgcattgatacgatcacacttaatctgttgtcccgtctgcaaggcagattggtagacctacctaatttgttgcatttgatccttcctttgttaattgttataccatgtccccttgtaaccacctagttacacctcgatattcgtgcactctgtgcgagtatcgacggtcgccttcaaacttaaaatctgagaaacaacttgggtaaaactggagttttacaaaagacttggaaaacccgacacctaggtcggtgcttgcgaactaaatgaatttccaaaaccgcggaccggggaacgtaccgggtgtacggtttcccgctctcgcacttaaggacagattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaatgctgttgtgaaaagggaattcggtgtttgaaaaatcagcagctgacgggatcagctaggcccgggtggccgtttgaaaagttgttggcccgggtggccgttgaaaagctgttggccggaagccaatcttggttcaaatctaaagattgatgcattgcacatactccggccggacgagacgcactgtctcatccgagtcgtttgagaagcactcacctagtcattctagaaaagagttcaaacaaaatcaattacgaaaacaacaacctttccttgaagcctgcattaaacacttatttcccctggcttgctgagtactcccgtactcacccttgctctatataaataattccctcccccagttgctgaagaagatgaagtggatcctgccgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttattttggagcgtcacgggctagttccggtcgggactagttcggggcgtgacacggcggcgcgagggaatcggagctccggcggtgattcgcggcaacgaagcggcggccgaggtgcggacgggctcggtgagcgcgacggcggcgactgcgcggcgcggcggtggctatagtggcggcggcgcgtggccggagacggcggtaggcggcggcgcaaggggcgagcagcgcggcgacgataggaagcacgggagggcacggcgagtgcgaaaaacgagagagggggacgcggggagcgatttatagatgcgggagggggcggacgtggccggggaggtggccgatttggccggcgacgtgggggagtggggaggaagagagagaggggggattcaaattgaaccccgaccactctcgggcgcgcgggcggaaaagccgccggagtggggcaccgacgtgggcgcgcggcacggccggagtggggcacggagaacggcggaaaacggcggcggcagcgtggccggtttcgacagcagcggcggttgccggaggtaggagacaaccgacaggtggggcccacctgtcggcgtcccagagagaggaggaaggggcgcatgggccggcccaacaaaggggaggccgagcgcgggagggagtgggccgacggcccaacaaagaaaaaggagggaaaagaaaagaaaaggagaaaaaggattttcctgggattaaaaatattgcacttgctcaattttaattggttaaaattatttccaaggctctgaaaattccactaaaaatcatgttaatgtattggagcatggggaactcaaagaaaaattccaccacgccgaattcgattattaaatgcatttattaattagggatttagctctaggttaattaagataatttcttcgggcaatttatttaactaatttttaaagcaagaaaaggggggaaacttcagggtgtgacagctgtcgagagcggaagacctagacctagatagttacaaggaagcgggctgatggggcattgcaaaagctcagcgatggccgttgcctcgggttcattcatgtgtatgggtacgaaggtactcttgctgaaattgatctgtagccctgagaatgcagcaaattcctcaagaatgctcttaattatttcagcctgctcaagcgatccttttaaaatgagtagggtgtcatcagcgtattgcagcgtgggaggaggagagtgagaatccagtgggtggagtaactgctcggagtggaaggcttgctgtatcatttgctgtaggacgtcagcgactagaatgaagagatatggggagagagagggtcaccctgacggactcctctcctatacttaaatgactcgcctgttgatccattgatcaagacgtgtgcttgtccagtttccaaaatctgtttgatccaattgatccatgtgtcgtcgaatcctctgcggtgtaggaccaagtataagcaatcccagttaactgtgtcaaaagctttttggaagtcaagctttagaataatcgttggttttttccttttgatcgcacattgaacaatgtcagaagctagtataaaattctccgtgattgatcttcctttgatgaatgcagactgcattggatcaattaactcaggaatttccccttgaacccggtttgctagcactttgctgataagctttggcagactgtgtagcaaggatattggcctgaaatctgttatgccgagaggggtttcttttttcggaattaaagtgatgtaagagatgttaacccctgaaagatcggctgcattggcatggaaggaattgaacagcgcgatcaggtcaggcttaagagtagagatgaagcatttgtagaactcatttgtgtagccatcaggacccgggcttttatttggaggcgagtgcaggatggcgcttgagatttcttcccaggaaaaagaggtggagagagctgacaagttgcgcattgaggggtagaggggcgacagaggaatggagtgggaagtgagttcagtgctgaagatgttccggaagtgtgcggtcgcaatttgcaatttttttggagtgtcgtagtgttctatcccatcctccaacaggagtttgattttattttttctgtggctaattgtggctgcaacatggaagaaatgactattctcatcgcctagcgtgcaccaagtgattttggatcggcgtttccattttagcgcccaaaaccagtttaactctttgaagtgctcgtggcagtgtttacgaagtgagaattccaggtctgtaagaggccgccactcttcacagcgatcaaagaaatcaatgacatatttgttagtgtggaggagagattttaaaccagctttgcgtcgtttccaggctctgattttggctctcagccttctgagtttaaagttcaaaatggagaccggagagataggtctagcggccttaagcaggtcgttttacactaaatttttgaactccggcatttgcagccaaaaattttccaccctaaaaattgcggagcgaggcgctgaatcggaaatgtgaactaggattggtgtatggtcagaagttgttgcagtcacagcttttgcttcagtaagagggaaggattggctccagagtggattaatgaaaaccctatcaagtttaacaagggtggggtggcgtcttttattagaccaggtgaaggtcctgtttgggatgtcaatgtcaaggaggctctcggagttaatccagtcgttgaatgtttccatctccgaccaattgatattatcgttatttttttcgtgggggtatctataaatgttgaagtcaccgaggatcatgacagaaccagttagattgagagtggtggtggagagctcatcaaagaagaggatcctgtgctggtcgtcacagggggcatagacattgatgatagagaaggaggtgttgtcggaagagctacagaaggaggtggtcagatgagacggtgagctggagaggacagtggcagagaaaaggttgctccaagcagtgagcaagcctccggctgaaccaagggagggttgaaaggagaaattacgaagattgcgtggtaagaaggaagcagcgaggagagggcagatagtatcaagcttggtttcttggaaacaaactatatctggtttattctcagctagggattggaagataagagctttctttttatcgcagccaaggccgcgcacattccaggtggcaatcttcatagaaaaaacagagaagcaacttggtggaggaatcccacccaaaaccaaggcaaaatcgcatgtttaaaagtctgccgcggaaaaaaggaagaacagataagcaagaaagctgaaacggtaaaaggagttttgcaagctgaagcaagagtctgctcattgtgcatactgcagattggatggacagaaagttcaaagatgaacaagtacgccaacttctggcaagttcgatcagtttgttacgatcttgcttctgctgctcctccccctcctctttctccaaagaggctgaagatttgtaaggttgctacggcatctacttcttcatctgtctgcaatgaagatgagcaagttcagacgatgcgggagcgagtagaggcgctacttcctgataacatcaaagctatcatcgatcaaaaaggaaatccaaagggaaaggacacctgacgttgtcggcaatgatcacactcaagattgggtctgtttgtcatgtggggattgcaatacaaacgtcgcagcaacaggcgggcgacggtaaggcgtgacgaggaatagtttttacttctattttgattcggttcggagtttgttagatagtttgttagtttcttattccgtaagctgttaggagtctatcctttagaattgctatgtaatctgtaagacagtttggttttggaatcaatcaattacgtgagattaatctgcagacctattcctgcctcgccggtgcggtgccgaacacggctcctccgcgccaacgaggtccaggaccacgtcctgttacagccttcaaatactccctccgtcgtaatcctccttccaatctcctcgcccgtgacaacttggtatcagattcttctggttccgtgtccatgggttccactcagacgcaactcgacgagatcgcgaagaacctcacttccatggctgcgcagatttctgatttagccaggaagatgagcaccctggaaccattggtgcccatcgcaccaaaacttagcgacctgccggaacgcgtcacccaggtgcaagcctctgcgttcgagtactccgagcaggtgcgctccctcaacctggcgatccagcgcgtggaggcgtcctagcgcgcgtcggccacggcggcatctggcgcctcctctcagccgccgccaggcgaccctcccccatccggcgacaacgacagaaccctgcgccgcgatcgccgtggcgacgactcgacggtcgacaacagctttctaccccgcgccaagctcgagttcccgacgtacgacggcaaaggcgacccgttgccatggctgaatcgctgcgagaccttctttcgtggccaacagacaccggaaaatcgcaaggtgtggtacgcatccttacatttagttggtgatgcacagttgtggtactacaggatcgagctcaatgctggtgaaccattgtggcggcgctcgtccagttggtccacaccaggttcgggccgccgatgaccgacagcccccttggcgagctcacggcgttgcgccgtacgggcacggtggaggattacatcaacaatttcctcgccttggcctgccgcgacgtcgaactctccgagcgccagcaagtccaactcttcaccgccggtctcgtcaatcccctcaagaccgatgtggctctttgccgcccacaatcgctggacgacgccatcatgcttgcgcgggcatatgaacagcgggtccaagttggcgcaacggacccagtcccggcccgctccggccgcgcaccacgccccgcactccccgcgctgccggcatccgcgtccaccgcgccgggcacgtccgcggcacccgacaccttgtcctcggcatcaaccggcaaacagcccctggtgtcggctcttcctcgcaagcgtttgtcgccggcggagatggcacagcgtcgatctgaaggactctactacaactgcgacgagaagtacgtcgccgggcatcgctgcaagaaatcattcgtcatcgaggtcattagctttccggatgatcccgaggaggaggcagaagacgcaccgactgctcatgcgctctcgctggacgagcccagcatctcgctgcacgctctcgccggtgttcgctcgccgaaatacaacacaatcaaggtgtaggctcgcattggcacaatagacctcatcgccctcctcgactccggctcgacgcacaacttcatcagcgatgtcgccgcccgtcgtgcccgtgttcccctagaaccgcgacacggcctcagcgtcgcggtggtgaacggcgatcgcatcaagtcgccaggccgtttcccaccgcagcttgttaccatcggcaatcacgacttcgtcatcaacttctacgctcttcctcttggcggctacgacattgtcctgggcgcccaatggctcggctcccttggaccgactctctgggacttcgccaaccagtcgctcgcgttcgggccgccgactgaccgtgtggtttggactagcattgacgcgccggcatcaccttcccaggcggctacaatcgacggcacgccaggcgagctcatgacggagttggttgatacctttcaggacctcttcgttgagccacacggcatgccaccggggcgccacctctgccatcggattcgcctagagcacggcatctcggcagtcgcggtgcgcccgtatcgctatgcccacgtccagaaggatgagctggagcgccagtgtgacgagatgctgcagcagggcgtcatccggccgagctcgtcggcgttctcctcgccggctctattgatcaagaaaaaggacggcgcatggcgattctgcatcgactaccgcgccctcaacgacaagaccatcaaggacaagttcccgatcccggtggccgaggagctgttcgatgagctgcgcggcgtcaagttcttcaccaagctcgacatgcgttccggctaccaccaagtacgaatgcaccccgacgacatccacaagactgcgttccgcacgcatcaaggcctgttcgagttcttggtcatgccattcggattgacgaatgcaccggcaacgttccaggcgctcatgaacgacgtgctcctcccgtttctgcaccggttcgtgttggttttctttgacgatattcttatttacagatcatcgtggtcggaacatctccgccacgtccgtaccgtgttgcaaacactgcaggaccataagcttcgactcaagcgatccaagtgcgagtttgggctctccgccatctcgtacttgggccacgtcatttcggccgccggcgtcgccatggacaggagcaaagttcaggccgttcttgactggcctcagcctaagaacgcgcgtgcagtccggggcttcctcggcttggcggggtactaccgccgcctcatccgtgacttcggcaccatcgccgtgcccctcacggcactattgcgaaaggagggctttcgctggtcggacgatgcgacagcggcatttcggcagctccaacaagcgctcacggcggcaccggtgctttaactgccggacttcaacaaggagttcgtcgtggaatgcgacgcgtcgggctctggcttcggcgccgttcttcatcaaggcttcggaccggtggcgttcttcagcaagccgatagcgccacgccacgccaagctcgccgcctatgagcgtgaactgattggacttgtccaagcagttcgccattggcggccgtacttatgggggcgtcggttcctcatccgcaccgaccattacagtctgcgcttccttctagaccaacgtctatccaccgttccacagcaccaatgggcaagcaagctactcggcttcgactttgcagttgagtacaagccgggaacagcaaacgtggtggcatacgccctctccagaagggacgaacacctggctgaaactctcgccttatcagcccctcagttctccctgtttgatgagctgcggcgcgaggtgctcacgtcacccgagctgactgccattcgggatgacattgccaaggggtcaaaaccgccggcctgggcgttcacggacggcctcatcacgttcaaaggccgtatctttgtgtctgcatcatcaccatccttgccggccatcctcgaactggcacacggcctggggcacgagggcacgcagaagacgctctctcgcctccgagctgacttccacctcgcacgggacagggcggtggtacaagagcatgtccgagcctgtttcacgtgtcagtgaaacaagacggagcacctacaaccggccggtctcttgcaatccttgccggtgccatcggcggtgtgggccgacatcgccatggatttcgtcgagggtctgccacgcgtccatggcaagacggtcatcttaacggtggtggaccgtttctccaagtttgcccactttataccactggctcattgtagcgcccattccgtcgtggcgccaagcgggaaaactatctcttaaaaaccctatttgcgaaatctgtttcattgtttattgtctagtgtccgtgccatctcagatctcaaatccccgatctatcgtcaaagttcaatcccgaatccaaatccttcccaaatcaaatccctccgcaaaagtctattttgcctccctcgggttcgatgggccgaattcctcgcggcccatctccccctccct

SEQ ID NO: 64774 - DNA, 2632 bp, Oryza sativa
aggggggaaaatgaatcctagggttagggtttgggtatgtttatttaggttaggattaatctggaccgtccattcgatcggacggctccagctgctcccacgtcgggccgccggcctattgggccaccgaatggaggatgcaaaatagacatcaatggagaaaggaaaaaggccaaacacatagaatagacaaaagggagggaatataaactttgctatattcagcccaaacatagaaaggaggattttgattttttttttccaattaaataattattaaattatttttgtattattcaaaattagcaattaagctctgataattccaataaaattctaaaaagcgtaactaatcatggataatttaataaaattaaatttaaccatgtaattttatttttcacacttgctttacttgtaaattgatttaattatacacctacgtacttaaaaataccaaatattttaattaattacataatgtaaatttttctttaactttttctcaattttttgttccgtacacttcccgttgcaacgcacgggcacatttgctagtggtacgaaaaattccaaaaaaaaagaataataaaatacttcaaggtttcatagtacgaaaaatacaaaaaaaaactaagaataaaaattacttcgaggtttcatagtacgaaaaatcaaaaaaaacaaaaaggtcagatccgacctgccggattcgaaccagcgacctaaggattgatctgcaacgactacagtcctccgctctaccaactgagctaaggtcggacactgcttcgtactacgagataaattttaatactttaattttcaaatttatacagaaattagctagttccttctgtcgctaaatggtgactgttattttgtttgcttactatataataaccacgataattctgtgtcccagaaaaaaatatctcttctcaaaattttttttatctaagttctgattctaattaattgctgcatggtatcacgtcaagtatggcccatcattggcccttgggctacacatgatagaaattttccgtttggacccaaattatgattgttgtctgcagcagtgtcagtggaaaactgccgtatgtacggtgtcggtagcaaaactgaggatatgtaatatatatcctacgaatctctctaggggaacaagctccctacggtttaatgtcctttccctagtataattctccctagggaacctggggatttccagtagattgttaggtctcctttgattcaaaggtaattcataggaattttatagaataccatttatataggaattttttctatatagccctttgaatcaaaggaatgaatcctacaaaatcctatgaaattcctatggaatgcctaaagacatgtaagttttagaggaaatttagcatgaggttctacctcatggaaactttcctatgagtcttcatctctcatctaattcctgcatttttcctgtggtccaatcaaacggccatccctgtgtttttcctatgctttgcaatcatttgttttacacttgcactcgtatcaaaattctacgtttttcctattcctacgttttctcaatcatgtgattcaaagtggccctaatgtgatatggtctacattttgttgtttgtgaacatcaattcaccgatatttgcgactaattgaccattcttcgtttaatcgtccgcatgatgtagttgatgatgatctaaagtagttttttaagacattgtttagtatttgtttgtgtttcttacatacattttatgttttattacttattcaatataaccaaacttgtcaatgaggtgtataaatacggcgttagaagccacatagttaatggtaagttatggatgtctattgaaaaaccaataacatattcaagttttataggcgtacacatttaaatccccaaaggagtatgtaatattataaaacatgtttgtatatttacgaacattaaattaattttcatcttcgagaatcaaaggaacaccaaaagctaacccaacgcatacgcaccacgcgaagcaaagaaccgatgcagctttctgcgctaacttagctgaattcatctgcaggtttatctcataaaaaacaagcaaaatctgcaggtaattaacaagattcaagcaaactaacccccaaccgaaacgccacgtactcacgtgcatccattcccatgtgcagccatggcacgcaagaacacacaagcccgcatttcgtcgaacacccacgccacgtaacgcacatatgcctccctacttaacccgcgtcgcgctctccgtgcatcgatcgtgtaagctagctaagcttggcgaattaaacggaggcgatgccgcgatctcatcatctcctcgcggcggcggtggcggcggtggttgtggtggtgatgggatggtcggcgcggccgtgcgaggcgtcgctgtaccagccgccgccgccggcgatggcgtaccacgacggcgcggtgctggagggcgccgtgccggtgtcggtgctctactacggcgcgttcccgccgcaccacagggccgtcgtcgccgacttcctcatgtcgctgtcgccgcgggggcgggaccaccagccgcacacgttcggcgcgccggggccggcgccg

SEQ ID NO: 64775 - DNA, 512 bp, Oryza sativa
atgtggttcgttcacccttcaaagttcagagtagtagacagtgcgcattagcatcggattgatttgtcaattgtcatagcaaagaagccacggatgttaggcaatgtcctcatatcaaataattagaagaggtcaagctgtgaacccaagtcgtctagcccaccaccctgtggagctagccggaaaacccctgggcatttctcatcaattgtcatagccacagcttgactcatgcatgagtgtttcccgagtaaggatgatttgtctgatgaaaaaactttgtttacgagaaatcttatttgacgcgttttatacaaccatcgttttatttatgatgattaaattacaggccgaagggtaaacgatactagtgttaaactcgtcgtactccggtcgaagttagccaagaaacgcaagccatccaacaagggggaagaaaatcatgtcttggacattttgttcaatagtgttgatagctggatatatatgtcgcatcagacatcttgtaccat

SEQ ID NO: 64776 - DNA, 8452 bp, Oryza sativa
tttaagagctctatcagcttggttctaaactctggagataagttcttactaataaatgtcggccttggccgatcgcctggacctatgtctatttctaccagatcatcggccgacatgaaaccttgaccttgcttgtcatcgagatcatctactgtatccttagtgtagacatttgaaccctccacgacgccctcaaaataatagcttgggttctccatcttcgattggctgtatatcagaatcggacacttttagaaaatctccatcctagactttttcagataaacaatcaaggccatccatctctcaaagagctaaatcggcactggcaacattaactgacctgtcggctggcatgatctctatcttgtcgccttgccattgaatcaaacactgatgcatagttgaaggaatgcaacaattggcgtgaatccaatcccttccaagcaacaagctgtaagaacccttcccatcgatgacaaaaaacgtggtaggaatagtcttactgtcgactgtcagctccacattcagaacacctttggtttccgatggattaccaccaaagtctttgagcatcatgtttgtcttgatgaaatcctcggcatttctacccaactttctgaacgtagcataaggcatcaaatttaccgcggcctcaccatcaaccatcattttagacatcggcttcccattgacgtagccgtttatatacaatggtttaagatactgattctctgtcccctcgggtttctcgaacactgcctgttctggtgacagaaccaacttagccgattcctcttccgcctcgtcgacatcggcttgatcgatcccgaattcggctagcaaggtaaagaccatgttaaccggtgccgtcacaacactcttcccttttgccaacctctttgcctcatcggctgcaacatcatcggctacaggaaccagattcttaacacgccactcctgccttggctttgctttcttcagccgatgattaatttcttgttcaacctcctgaaggcgctccctgttcctcaatctttgaacccttctcttctgattcttcgtgaaaataccagaaggacaccattgattcttcctgattacattgtcctcttggccatgatcttgattcactggacctaatctttgatgaacggaaactcttgtctgccttagccgattacccttattatatgatcggcttgaactctcgacaatatcactgcacccaggcagttttcaatagatggcaacctcataccttcattccagcagaatctaaagaactcacaaccccaatgaggatcaaaaccatcattgtattcttcattatgcttctcctgctgcctgtcatacttcctctgatatttgttgataatcttagccgaattcacctaaaaaccccttgcacgggtcctatcggctgtttggccagctgtatgccccatattaacaggaaaagggttaccatcgaccttcatcggctttttggaatcatcaaacctaatcttgcctccctcaatggccacctgaatctgctctctaaaaaccttgcaatcgttagtagaatgggacccagaattatgccatttgcaatacctctttttgcctaattcctcagccgatgggattgtatgaccagcagaaagttgaatttgcttctctcggagtagcagatcaaagatcttgtcagctttagtaataccaaagtcatacttctcctcttttccagaactttttacccattggcatggtatgacatttttactcctcacccattcggctgcagctatttcagaatcgtcctcgtcatcattcaacccatagatgtatggacaaacatgattaactttcttagagcttttcctaacttccgcgaacctatgttcatgcaaggttactttctgtatcggatgtgataagctatcaaagtcttcagacaagaacttctccctaatcggagcaatcataccctgaaagaccaaatcgactaactgggcatcagttaaactcaagctgaagcatttgttcctcatctccctgaatctctaaatatactcgtgcacgggttcatcatgccgctgcttaatcgctgtcaagtcagataatttcatctcatgaaccccactgtagaaatagctgtggacttgcttctccaaatcggcccaactattgatcgacccatacggcaaagaggaaaactaagtaaaagtcgatccagacaaagataaccggaacaacctaaccttcaaagcgtctatagccgatgcttcaccacactgagctaagaatcggctaatgtgctcataagttgacacaccatcttgtcccaaaaatttggataagtctggaactttgaactgattgggcagaggaactctctcaaaccagtcagggtaaggctgccgatacaagcttccagtctcttttggtttaagcccaaactgttccctcattacatcagcaattacatctgcccatggtcattgttgagctgccccttgtgactgttgctgcatgggctcgaactgaccgtattgagacgcaaactgaggttgagccaatccccctggctgatattgggcttgcggggaaggaggctgatattgataattcaagttacccccttggtaattgtgaagattcagctggatattacgtaccaagtgctcagggacaacttgaggcattaatgtgccatccggttgtacgtggtgaaccaagtgttctgggacaacttgatttaaaaattattgcaccggctgaccatcaggcgtcgcaaacccggccgatgcgcttattgaaccttggtgctggatcggctgaacaatttgctgtcttaacggcgtttgctgaatcggctgcagaggctgctgccttggtggtgtttgttgaactggttacctagcctgttgctggattggttatacaacctgctgaattgggggtgtctgctgaatcggctgctgctgaatcggctgttgctgtattggatcaacaacaggttgaggtgggagaaacatggcagcaacctgatcttgggttagccgattcgcaacctgcccactatgctgtggctgctctctcattaacaaccgagggttcaccggctggcctggcgccatggctgatgaagtatgtaggggagttgatgccggcgccgttggctgagtcgttggtgcaatggacggaaccgcctaagtagatggctgaacatcggtaatcaaagaccgataatttgggaagacacctccttgcaaataaaccgggcctacagcctcatgctcagctattgaaccatcaactattgacttcatcatgtttgataagatattgactaacaccctagactgattgatcaaagcatgatgcacaacataatcaacccgatcttggaagttattgaaaaatcctgtgccacatcgctattctgattaagatttcctccctgtagcccctgagcaccatctccatgcaccccgtcaccttgtactccacggactccttgagaattgtcgccttgatttcctagagagccgtcggtagcacctttaatactcggctgagccgagccgtctggagcttgtttcccatctccctccttagaagaactggtcctaggatcatcagcgaccacttttattttgtacttctaaacaagtgtccccttgcgggtctgcatgaatgagttcaagaactgatcccgtgcttgctgcaaaatttgcttcaaactctttcttctgctcgggtgtgaatttttcttgatcgatcggcatgacgtttccttcattgacgtcagcaatcctaacttcagcatcttgtccttaacagagtctgggcaagatggtggtggtggctatttctcagccaagaggaagaattgttggctgacttcgtaaaggtcccaccaggcatgccaaaagcgtgttgatagaaaacacgtggcttgggagatctgcttaactccagtgcaggtccaaagctcgccttcgaatgtatgagcatgccagttgatttgatcctgtaatcaacaaaaaatagaagcaaagaaaccgcggttaaatctataaatgatagtcgatcggctaggtgccgatgacatatcatttatctttgagccgatgtcatatatgtatcgatcggcagtcatgaataaacaagaaggaactaaatctactcgatcggctgtaggtattcacaatatatactccttgtatcgatatatacttaaatcaagtgattgggatagatcggacgccatgccgagacagtataaatcacttaaatcgaaatatatattaataatgggactacatatgttcatagcagagccgatcatatagatctagcatgtatcggctaatactccgataccactctatactaagatattaaagcaagtagaatatatcaaacaatggcctaatatacttaaatgcaataagatcttaaaataaatgccagatttaacatgtcaataaagcatatagagtaaatatagttaaatcagataagatcggctgaaactccgatgctaccctaatcggcaaccagaaggcaggctagaggttgattttctaagcatgacttaatagatcaaactcaactgatacaacattaagtatgaaaagaagaacaatatctagacaatcaagctgctggaagtttcatagagtggtagatatcttatataatctaagtcaatatcgaaatctaacctaatcggctgtcctctaccgatagatgttagccgattgtagattagatagtggtattgccagagattatgtaagatatatgatagttcgacgaattacataaacgagatcagagtatcacaaacatggaagcactaatcccgagaacacaagtcgtcataacaagttttacctcttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcgatctccgcctcagactttgcttcgatctaatcttctttcccgatgctgatattaccaaatttggttgttaacatggtggtgtgagatgcaagcggctgggtggcggcgacgattcaacgtcccggttatcgccaaaggaacctcctctccatggatctccttccctgctaaggttagattcctgttttggtcgactgggcttggtggctggaggaacagggtggtggttcgaattcggcgatggtcattgtgtactagatgggaaagcgctagtgaaagccttgcatggcctttggctggcgtcgacaccgttaggcattattcccttccttggaagggtctttatggtgttttctatgtctctaccaatctccaagtgaaaagcttgatccagtcgctggccgacgagcggttgtagcatttcacgtcatgtcctccatggggatgctgttttggagagatctacccatgcaacgatggccgttgatggactcttgtgcttccgaagcactgtacacctaggtgtttggaatggccttagccgtcttggctactttcttgttcgtggtgggcatccagctctcttcgttcgtctttgctaggtggagtcgaagttgttacattgttacagtgcgatgaagcttggcaacgataacacattgcagtctctttctggggggtactggtgttagccgggtggaggaaatggtgcgtcgttttgttgttttggtgatgcctttgccaacgatgacgtgatctctatggagtcaaacctgttgcgtcactaggcagcaagctcaggcctcggcaacattgacacttgctttgcgaagttgaagctgtttgccgcttttttagctagcttgacattgatgtccaccgttgggtttcatcgttgtttagttggtagttggttagagttgtgtggtattccatgtgttgggttattctactagctgcgattgaggtgcttttggcgagtctcttcttgttgagagattgtttttttcttttccttgtaaagtgtctgggttttactcttgcttaattaattgaaatgaaattgacatttctcctatcggtttagtttttctttaaaaatatatcactttcacccctttctataatttttatagaaattctgaaaacttataaactaagtgagagtttcagaaatggccgtttcccccctgtaatccacggtcaaactttctatgcgctagacggctagagcctagatgtctaaaaaacaagggatagaatgacgcaccgcttggtgaagaactgaagttaatggcttccttcttccttcactacactggacaaggtcaccagtgacgggcccaaaccctcacctttgatggctttaggcttggtcagtgatcagtggtcactagtgagttcggtcacctttgacgggtggaagaccattactgatgacagtcacctctgacgtgctagaactctacggcccgtcagaggtaagtgtctgtgctaacccatgccattttgcaacccgtcatagatgactcacctgtgacggctcagagtaaaaaactatgtcacttgtgacgacatgtatgtgcaaaaccgtcactggtatggtcacctgtgacggcttttgcaatatgaaccatcagtggtgagcttacatctagaaaaaaaaataatttcccctaggatttgctaaccatgcctctggaaaaacagaacatacacatgcaatatatatgtctccagtttcagcccattgcattaaaagtttcaaactaacatcacatgaattccaagttgtcaccgaaaatccatagacattcacacacatgcattgcaagttctcaaattgagccaagccgatgcttcaaagcaccagaaataaatccagaaaaaaaagagaacatacttcgatgccaaaatactgaaaaatgagaaatacagcctaagtgccacaaacttgaacatagcatttccatctttggtttctgagcctgacgaatatggtatgacatacaaacttacaattagatcagcataagtacagcccccagtgcctgtaatgacatcattcagagaagtttaatgcaacaatatcctaacagcctaacaaccagatatatgttacagatgggatgacagtagcaggaacagcttcgatatgttacaaatgcatataactatgcaagaatagcctaacagctagataatcagcataagctgctccaaaacaacaaattaaaatggggtcactctgactgagaaggcaaaaataagtttacctcagattagtattcattagctagcttttcaaccatccttgatagtcatccatatgcatgtcagtagttaaatattatctgaaagaaacggaaatagatcaactggcagaggaagctcaccatttgtagaaagaactagcgtctaatttgttcagctagtatagaaattgggggatttgtagagtatgcaagaacacaaccaaaagaaacttctggtaagaggtctaacaaggaaaataaaaacagatttagtgatgcatcaacttaaatagaacaagaaaacaaagcgaaacaacatgcatgcccactatccaaacaaaatactagtacacaaagagcatctaactaatgatccaatagctcatgatttttgatggggttaaagctagatgcatccttggacaaggatttagccacaggaaccacaggagacgccggaattggttgactgcaagctcagatgtgaatgcaaggaaagaaaagggtgacttctgcttagcactaaactgagtaaaataaatgaggggacgggtgactaccgaagaatgggggaaggggacagctgaagcttgctctccccacggcaggttgaccttgacaacgtggtgtggtgtggacggcggaccgcttacctcacgaacggatctggtatcggtgaagctaggtccgcaggatctgaagcacccaaactcgggatggttggatccgcgacctgtgagttcagggtgtccggatctggagcccccgagttcatggttgctgggaccgtcagggggaggctgggggatgtagaagctcgtcgtcgaccggaga

SEQ ID NO: 64777 - DNA, 1614 bp, Oryza sativa
aatatagtgatacatacaaatgaaatggcattagagaggtttggcctgccaaagagttatatttgaatcactctctgtgtctaagacactgaacaaatctgtttttgagccaattgtggaacactattactatgtctatgccatttccccagctgtgctccactgatttttatgacctattttcatgcatggtttctgccaatttgaagcaataaaattcgttgcatgtgtttttttttccaacaggttatatagacttgtgattgaatttcacagacacttcttgactgtgcgtatatattgtagttgttgcctactctctctatcccataaaaattaacttctggctacgaaactagatgtagccagaagttggtgttttatgggatggagagggtactttcttgataagagtgcgcagtgaacagatagtcctataaattgtttggcacattaatagcagtgtcctggtggtggtttgtgattcatcttatatcatattaatgaaacaaaacatggatgggagtagtcattttctttcttagtttgctctttctatgcataactgataacatcaacgttgtggaaatattgtacataacaagtttgttatggaagtgcattagtgcaatataatttaaggacctaaaagaggttttgcacacaattgttttctctatatacacaaaatacaagtaagctcttgccatgtacattcagcttgatgtcctagtgttacttcaagagtgttagcaatgcattgcagcgacatgagttacttgagttgtgctgttcgtactctgtagcttgtgatgtttgttctgcagaacgggggattatgaatttagcaatacgcatgctttcttttcacgaggatgtgatataacatttagtttcttttggttcagaatgtgcatggtttttaatggccttacgctctcctcatatcaattttggaagtctttcaggagaaaaaatagggtgcaatttagtttgtgcacaaccactggaattgattttctgatatcttgaagataagttcttcagatggacataagctgactttagcatgagcttgattttgatagtagtcaacagtgaggatgctagaagagatacaattatgcaacatcataaacttgaaaagcatttagacaagatgatattggttggctccaaaatcgataagatagtactcctatctccatataggaatcccagtgtgccacataatatcacagtcaacacccatgtacacacacataaacatacttccccaaacatatcacagaatatatagacaaatgtatagccccaaggaattgcacagtcaagaagctgactttagacatgattatgatggttaaaggttaaaaaagaggtggatctacaagaatcctcaaaacacaattgtgttaatctgttccactacctcaatctgaggttgtagatttcattcttcacagccatcttagatcagtattatcaagattaacttgtttatgcttccatctgtacacttatactctccgctctcatttttaccatgaatttttcatctgagttcagtttcagttcgatacctaagcaatgttagtacaccaataattgtgt

SEQ ID NO: 64778 - DNA, 4755 bp, Oryza sativa
cggctgtgcttagatccaaagtttggatccaaacttcagtcattttccatcacatcaacctgtcatacacacacaacttttcagtcacattatcttcaattttaaccaaaatccaaactttgcgttgaactaaacacagcctacagagtactacatcaacaatggccttgtttggatcctccgaactattaaatagccctccggaatcttgctatttaggagtattaaacatagattaccgacaaaaccgattccataacccctaggctattttgcgagacgaatctaatgatatatattaatctatgattagtggctgattactgtagcatccctgtagcaaatcattgattaatatacctcgttagattcatctcgcaaaatagcctaggggttatagaatgggttttgtcagtaatttacgtttaatacttctaaatagcaagatttcggagggctatttaatagccctccggatccaaacagagccaatgataaaactaaacagttctgtgtcgtttgaattgtacagacaaattcaacaccagatgaccctcgtaggtcgtagccatggtccaggaccccctctctcaagtggagtgtctgtcggcctaccacctccactcatgaatcatgagcggccatcatcattgccccctcggtatgtttggtataatctggtaaatgaccgtcttctcttttaggtctctttgatttggagaaaaaacataaaaattttgaaggatttcaatcatataggaaaaattcctatgaatatctttgaatcaaatgattgaatcttttccattcctttgaaattattatggaatagacaatcttatagacagtgtttagcaaatgacaaagggaaatgattttccacccatctttaaattctaaccattcattatccctctaccatttaatcctaacccttcattcatttcccaatcccaatcccaccccccatttcccattatccaaatacacccatagagatttttgaggaaatttagcaagagctccaacctcttggaaaactttctttgagtctatctctctcatccgattcttgcgtttttcctgcggtccaatcaaacgataattcccgtgtttttcatgtgttttgcaatcctctgttttacacttcaattcctttgagaatcctgtgtttttcctattccgccattttttccaccctgcgattcaaaggggcccttagctcgtgagaatgtgagtataaggggaaaaattggatagaagattctgaagatgcaatacataaaagagttgtttttagacatgagaaagaatggatggaaaatttagggtacttttgaattgtgtcggtgatatgggccgggggtatcatgtttagagggaggaggctgccccccaaggccacgtggccctcccccgaggggagtgaggcccgaggtagggcggcggccactccttcccaaagactagtcggaggaggctgccccccaaggccacgtggccctcccccgaggggagcgaggcccgaggtagggcggcggccactccttcccaaagactagttggaggaggctgccccccaatgccacgtggccctcccccgaggggagtcaggcccgaggtagggtggcggccactcctacacagactagtcggaggaggctgcccctcaatgacacgcggccctcccctaaggggagttaggcccgaggtggggtggcggccactccctcccagagattggacggaggaggctgcccccaatgccacgtggccctctctcgagggggatcgggcccgaggtagggcggcggccactccctggccgagactagaggtagaaggctgccccaggccccacgtggcccttctccgaggggggatcgggcccgaggttgggcggcgaccgccccctcccgtgactagggatcgggctcccccgaccccctctctaggtcaccacgtacggtgggttaggtgtccgcctccaggtccccacctacccgcattaatggcgacccgagcggtcgcgccacgccacatttaatgcggtgtgcagtgcactcaaccgttctgtgaccggccgaatgactgatgggacccaggatgtcagacgcaccatcgcgtgtgtcaggcgatgtgcagcccgacatatcccatcaaataatgatggtgagagattctcatcctcttatcccagccggagtcagtcctcccgctctggtcaaagcaatgctcccgtttctcggtgtaataggagcccagaagtcttcacccattaaatggtgattgacaggggcaccccccgtgtcaggcggtaagatttgacaggccccatcatcaagacgacgtgcgcttagcttcccaagtcaagatacaagacatgcatttaatgcaaagattataatacttctctaccagagctaagttagattgttgggcccatgtggtaacctcttgaggtataaaaggaggtccaggcctagtggtggaggaggggggacttccgagcgaactggcgcttgagtctcgcagccccaggcacttgtgttctacactcgaccataatcccaaacacaggagtagggtattacgcttcttagcggcccgaacctatataaaccccttttgtctcatcgtctttgggggattgaaccccctcaagatcacacagcttcgctcaccgaatcctcgaatctcacccgctgcccccggccgaactcacaaaaaggggcctcacggttccctggtggaggagttcattctccgacatttggcgcaccaggtagggggtgtgttcgtgatttttgaggttctttcgagtgccggcgcgacgagcgtcgcaccgccgatgctggggaaggcgcagcctcctcgggagagccgcgccaccccaggcagggggctaggcctcccacttcctcactggaaaaggctagcggccaggcctttgtggcgagtcttcggaatgtccgatggcccctaaagtttcgacacagcctcaccgagaagtacgacggcggcgtcaacccctccgagtccctccagatctgcacgatgatcatagaggcggcgggggtgatgaccaggtcatggcgagcttcttccccatgaccctcaggggccaagcgcggggttggctcatgaacctgctgcctgcctcggtctactcttgggaggactcttgcagttgagctccgggtgccgtcgaagcccgggaccctctatgctggttcttccgtagcggctagctttggtcccgccggctggctatggtgcccggcccggctcaactaatcatcctttcaaccttcaagtattttcaatttttcaattcatcagcataatatagcttgaagtcttatatttcttttcccccattcttttctcatggccctgcgacgctcgcgtgttgcgcattcgtttgcttcctcggtggtaagagcccaacctctctctcatctacatgaacgtttcctcgccaagtatgggggctaagttttctagccgtattccagccttaagttgagctccgggtgccgtcgaagcgagggaccccctgtgctggctcttccgtagcggctagctttggccccgccggctggctacggcgctcggcccggctcaactgtagacagggatcgctggctctagagtttttcggctctcacactcgtgcgaaagtagtcgtccgtgtagaagggagagatattggaaggaggccaccgaaaggaaagagcaaacataatgtgtagcgtggggacacaggctcgtgggaacctgacctcgtttgctaagtgatcacaggcttcccaagatggttcggaacccatggtgggggctctcttcgagctaaaggtttaaaagatcgcgacatgcaagcaaggtttgtgttttcttcattcatacaagcaattctttgctataagtgtggggctacgattcctagctctatcctagccctgcgtcgagctctgggcgccgtcgacgcctagggccccctgtgctggctcttctgtagcggctggctttggccttgacggctggctacagcgcccagcttggcttgatcgtgggtgaagattgttggctatggaaaatttagtcctcgcactcgcgcgaagataatcgtttgcataaaattattattgcttatatttatctctcgcccatctctttctcgcggtcccgcggtacccacgtgtcgcacgctggcttgccttccttggtaacaaaaagtttatattcgcttcatctattcaaatgattctttgctaaaagtgtgggggctacgattcctagctctatcctagcactacgtcgagctctggtcgccgtcgacgcccggggccccctgtgctggctcttccgtagcagctagctttggcaccgccggctggctacggcgcccagtctggcttgatcacatgtaaagattgctggctatgggaagttcagtcctcacgctcacgcgaaaataatcatttgaatagatgaagtagaacaccaacagaggttaacaaaaggcaggggctagcgaggtacgcggcgtaaggtcacgggcccgagagaatctaacaacgtttgcagagtatatacaggaaataagttcacggcctaaggtacgtgctaaactcccaccgcccaactcccagaatgataggatagaagatcggacccacatgtcaactgactagaagattggcgtcaaccctgaccacctgggaaaggttttggtcagggctcacgccgggg

SEQ ID NO: 64779 - DNA, 8231 bp, Oryza sativa
attcctgcagcccgtcctggcaccggcgttgtcttcgtctttggctcgatttgacctggatctggcgtggtggaggcggaaaggaggcggcgaccgtgggtggtgggcgaaggaggcagcgacccggaggcggtaggcgaaggagccatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaatggcttcccagtgcttcgctgccaccaccggcgccggcaatggcgtctcgggcgcggacgccggacgccgcgcgcgtgccgcgcagacggtggcggggatcctggcggtgcacaacgaggcgcggcgcgcggtgggcgtggcgccactggcgtggagcgcgggcatcgcccggtacgcgaaggggtacgcagcgtcgcggcgcggcgactgcgcgccgcggcgctcgccgctgttcaacttcggcgagaacgcgttcgtcgggaaggggcggcggtggaacgcgccggcgctggcggcggcgtgggtggacgagggccggcggcggtacgactacggcagcaacacgtgcgccggcgcggcggcggccgcgtcgtccgggtcgtcgtcgccgtgcacgcggtacacgcaggtggtgtggcggaacacgacgcaggtcgggtgcggccgcatcgtgtgcgactccggcgactcgctgctcgtctgcgactacttcccgccggggaactacggcaccggccgaccatactgatcgtgttatacatatagtgccgtgccccggagaataatcacatactcactccgtcctaaaaaaaatcaatttatacggacaaatttgaaccaatatatgtatgtgttcatctttacaagttattttttttatgggacagagagtgtaggtcgttgtgcatgcgagtgaattactattctgcccaataagccgttgtgctctaatgcttgtgcattatatatattttcttcaaatataatttaattttgaattagtacaatttgatctgtaatgtcttgagctaaattgtgaagattatgctctcgtattcatttttctgaaaaacaacgaaccaaacaatattcaaagcatagaatatcaatatatattttaaatactttagactagatatatacatgacaatttatgtttagaataggcatgaaacagtataattttatcatcaggttttgtgaagaatgtatatctatggatattattgctatactgaaggctttgtaaatgttcaaaacgatacgtttacacgacaggatgaagtaaattagaggcaatcagacagactagcatatttgtttgcaccagcgagagcggtggtgtcagacatggctgtgcctcgacgcaacctggggtatgcacagacctagcgttgccccacgaggccacgacacaaaactcaaagagatgccaaggacaaatacaagatgttacgtgtattcgaatggagattcataaatagaatgagttttttattttgtattattttgtattggtgtctattagtctgtgattgcttatgttatgtcagcatgtgggtaaggttgtttgtgagcatcatcattgggccatggatttttgacctgaagatacaaagccagaacatgatgaccataacaaccacaaacatgaaattagaggatatatcattataaacctggtagaacatttaccttgcctatctcatggaggattggaggcacaacttcatacaactttgagacctgaaaggaaataatatcaacagctcataactcccctaccctcactcttttcacagttacatgaatttattttggcttctcggattggttgtcatatagtttttttggagttgggcaaggggaaccggtggcacgccgttccagcgaccatggcattgtttcccttgtgcatggtgatcccctcgtgtccggttctgtcaactggatatgggcggtgagggcatgcatgtaggacacgcacacatgtttttttcgtaaaatcccctaataatcggagaaatcgtgaaacaatacttccaccatttacgagaaatataacataaagaaaagaatatgccgtttttagagatggcgctgaaatcctattaagaatgtccgcattattgtcattacgaacttgttcgtctcaacagtttcgactttcgagtctagtttgctcgtaaccacgagcgatcaatccaagtaataaacaacttattaacagtcattaatcaatcgaaattaacactcccccttgcataaccccggtaataaatcccatgagttaactatacaaagtaaaattcaaaagccaaacccccacaaaattaacagcagcaattaattaatcaatcaccgcagtatataataaccccgagttcaccacaacttctccacaaacaaattaatcaaccaacacaccatgtctcccttctactgctgcctcgccgccgtcctgtcgctggcgtcggcgtcgccggccgcggcgtccatctcggtgtccgccgccgcggagcctccggccaacagtttgttgccggcggagcagttcctgcgggctcacaacgaggcccgcgcggcggtgggcgtgccgccgctggcgtggaacgcgacgatcgcgctggacgcgcagcggtacgccggcgagctccgggcgagctgcgaggcgcggccggtgtgggcgtggggcaccgacggcttgtacgggcggaacctgtacagggggagcggcccgcgggtgcgcgcgggcgcggacgcgtcggcgcactgggcggagggcgcgcggtggtacgaccgcgacggcgactcgtgcgcggcgccgccggggcggtgctgcggcgagtacacgcagatggtgtggcgcgccacgacgcagatcgggtgcgcgcgctggttgtgccgctgcctgggcgacacgtgccctctcgtgttggacaccgtcgccgtctgcgagtactacccgccgggcaacatcgccggccagcgcccttactaacgcatatatatgccgcggtatatatatgtagcacatgcacgtgcgagctcataaaatgttgtggtgtaataacacgtgcgtgatcaactttcaagaacgtttttgttcttgcattggaacaaatgtttgacaaattaatactacatataaagccgtcaaaaaactgagaagcacgttctaattgttgaagaactctactccctgtttttttatatattattaaagcacagtacaagcgtggacgtttttaatgaaatgattgttacggttcgtattcctcacgccactacttaatgttctcaacgacattcaaaacaatcggtttttgcgtggacgctgccatgctggtcacttcctcctcggaagatgaaccgctatacgccgatcacgtcctccactaccatggctcgcctctctatctcccatgccacatatttttattctaataaataggggactgaggacaatgggagttttatcgccacccacttgtgctctcacttactgcgcctcatgacctcctccccattcactctagccatacagggtttcaccactccatctgcagagcatgaaaactagttaggaggataacaacagcgacaacatctcagataaaattttcaaaactttggaaattattattgtggacggcttctacagataaccgtctgcaaaattcttttttacggacaactagtccgctagtttaaatattttgaactatttaaaaacaaaccggggcccaccgatttatacaggtgacgctctgacacatctacctatgaaaagagttttcgtaggtggttattgaagacattcacttttgagaacttttttacagatgggtgtttcagacatcacttacgaaaaatcatttaaccataataatagatagtctcaagtacttcatagttctaattcctcgagtttaatccactggaaatgaccagtgctagcattatattacccgccatatctagcagtgccgccatgggtgcttggtagatacgcactctacctactcttccgctacgcctcctccacctgcactaaagcaaaggcaacgtctccacatctaggtgagggctgttttatcggatctgcacttatgtgcgcctgtacggttgggccctgtgcaatgcgatgtcatttgtcgagttgcctatgacgctgcaactcctctcgtctctcgggcatttctgcttctaggtaggccataggcagatactagactactagtattaggtgttggccccccaccatcatgggcccccagcgatcgcctcggctacatagccccagggccggccctggcttttcctgatccatcctgattctgcttttatcagagtatcaagcttgcttgtatgatgatagtacattgctttgttacctttttgctcgctgcctagtgctgcaatacatcgattcagtttcttgcttctatatgcttgtttatattaaatgcatgggaggaattaggaaattacggaggaaatcaattaaaggaaaaaaaatatttcactgcattttatatcttttatttggtcggtcggccacatgtgcttaataagttatgaaaatcttattgcttctacgtatgtgtatgttgtgtggatgtgataataaggttgtgatacgtgtactagcgaatcatcgtgcctaaactcttcggatattccggaattccatccctaggtcccgacattaattttattttctcctcttttattactatatctttgcgaggcaactacgaatcgggcgtcggatttttgagagaaaaatcgggtccccctcctgtgcgctcccctctacacattcattgcatgaatgctgcatgccagctacttgcttcctatgcctacatctcagctacatgcaatatccaatactaccctcactttcccctatcgatgcatatctagcttttcttaacatgtttaaattattttttctcttaaattattaatcccatatacaaataatgcaatatgattgcatagttgtatttttttaattaaatctttacaacaagatctaacataactatattttaatgaaaataattaattgatgctttatcacttataaaaaattgtttcaatttgcttcataagatgttccagagagatgcaacattcaaaatataataactgcaagaccgtcaaccattgcatatgaaagctattcacactttcacagtcggtgtagcataactcccctagtaaaaaaccatgagttaaaagtacaaattaaaagccaaaggactcacaaaacggcagccattaattaataagaacccccgctatatatatacaatcgcgagttcaccacaacttcaccccgaaaccaccatgtctccactctactgctgtctcgtcgccgtcctgtgcctcccgcgggcctccgcatcgccggtggcggcggcatccatctccgtctccgccgtgcagacccccgtcgagccgacgccggtgcagttcctgcgggtgcacaacgaggcacgcgcggcggtgggcgtgccgccgctgtcgtggaacgggacgctgcagctggatgcggcgcggtacgccggcgagctccggacggaatgcagcctgcggccgccgccgcccaccgcggcgcggggcaccggcgacggcgccgccgtctacggccggaacctgttcaaggcgtacggccggcgccacaccggcgcggaggtggcggcgttctgggcggacggccggcggtggtacgaccgcgacgccggccggtgcgcggcgccgcccggccggacctgcggcgcgtacacgcaggtggtgtggcgcgccacgacgcagctcggctgcgcgcgccgcacctgccgcaacggcgtcgacaccgtcgccgtctgcgactactacccgccgggcaacatcgtcggccagcggccatattgacaatgatctcatctgtttctgcgacacacgacacgcaatgaaatgtagtacatacgatcgatggttctggtgagtgattgagtttttggaacaaatgtttggagaaatatatgaaacatgctccaaagaaaattaaagggatactctaagataattaaatatggagatttaatgatggcagctgcgatgaggattcaaatatgtattgtcatcggagctagatttgttcgacctctccatttcccataatcttgccgaacaactctactctctcccaagtccgacccaaacacggataaatgaactttttttacaaggttatattttacctggcctctacatccaatcggatgcatgtgagcctttttaaattggaaacttaacccctcaaaacaactcaatctgaaatttactcatatggagatttgaattcagataacatttttacattaggaacttagcctatcaaacaacccaatataaaattcgctcatataaagatttgaactcagagccttgaggtgctactcaggtcacatgcccttccgcccgataaaagaacctggtgatcggtgttgcagacaccttatcactgttgcttgaataagtaggaacaacaatcttgacaaaattaaaaaaatacattttttaaaaaattggcctttttttcttttgtttggcacaaatgcaaggtagttgtgtggtttgtagcgaatccagaaattttcttatgatgtagaaggagcagctggaccagacttggcatgggccagttttcacattgaacactcatttttcacgaaaataaaacaaaacaaaatgaaattctgatggtcggtgatggctgagttaaaaatacagttatggtaatacatcattctacacattttaagggggcaaatcacacgaattccctaccttccattatgcttctagattcattgtacgtcctctatctgttgagctccgacgagtgatgaacttggcaaattttgtacatattcctcaatcttaaataaatttggttggtctatcttgaccggcccgacaaaaaaatgaacttggaagaggaagtaggaggtgttcccgacttagagggataagaggtgaggatgagagtaagggatggtgggctggtggccatggtggagtggcaaggcggtggtaccagtagcctcgacagtgggagagaaggtcggtggacttgtgttggcggggacgtgggatctagagtggttagggcgaatcgttaaggacggggaagaaggtgcaggggcactctactactgttcggaggaaagtgaagctaggggaagagg

SEQ ID NO: 64780 - DNA, 607 bp, Oryza sativa
gaatccgttttggaataggcaccttcaagattccataaatccaaaaaaaggctggtttgatgcagcggctcgatccgatcacccctgagatcctcgattcgaagacatccaagaaaacaatcctagaattaagaacgaaatcaacatatgagattcccaatccaaagacatccaagagcacaatcatagaattaagaacaaaatcaacatccaagaacacacacagataggaggccaccgctgtcaccgtcatcgagcgcaccacccccatgcgcgcggcggcggattttgccaccccgatgcatgcggcggcagatccaattatgcccttaagcagagaggaggatgggtagttgttgctatcctagcgagtgcatgtgcaggggaagcgaaggctaaggagcgcgacccagtggtaaaggcagctcctacgtgacctagtggtgaaggcagctcctacagcctagaggcaggcccggaagagtgcaaaatcgaggagcgtgccagttagcgcccgctctatccaccacgccctcacaccatccacgcgcggtgtagggagaggtggaaggtggaagcgcgaagggcggcatcgttgggggaaggg

SEQ ID NO: 64781 - DNA, 16707 bp, Oryza sativa
cttgtccgtttgtgctagccattggcaaacaacagtgtggctagggtgtagtccacctgggaagggccatgagttcattgaactcatgtacacgtctacatagcagatctaggggtggtcctcattgtccccgtgctcccaggaccacctaaaaaaatcctagctcaatgcatatatatgtatatatatatgtgaaaataaaattttgaaaaaagaaaaaaaagcttctttattaatgtattatgatgcatatttgatcaatttatacttctaacttggaccatccatatatagatacgccggcctttgcatatctactagaggttgcggtgtgcaagaggaggcgagagagcgagaggggtgcagcaattggctcgatgtgggtctatggccccaggcatcattgacaagggtggatataagaagtgactgaaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgctctagtgatggtgtatgcatgttatgcaaggtgcttacaacagaggtagagcagctgcgttgtagcacctgtgctacgccatggcatactccctgcctctccagcataccgccccttacagatgtggcccactgggtctgtccagattgctccggtgatgtcacagccagctacccgccatctgatgttgttcgtccggagagcagcctcatcgctgcgattcgtgtgattgaggctgatccggtgctgtccatccaagagaaggctcgtcgtcgccaggaacttcttggccatgccggtgatgcaggggctgcaataactgaagctgttggggaaaacgtagaggacagtgagagcaacaatcctttgtctatgctgaacaagaacatcaactgctcattttgtatgctgcttccagagcgacctgtcactgtaagtatgattgctcttttgccaaccctgtcaacctttgctttggaacagcctagaaaaatatagaaatgtttccatgaggcactacatgtcataatatgtaagctcataaagtgtaagtttgtaccattacttagatctcagatcacactgaagataggctcctattagcacacaaataaattatgattaagttgttctgattttatttgaattgatctacaattgctgtacttctactgcaaattacatcaagtatgatatatacatgaaaatacagggagctactggattgttggtttctccatctatttagcctgttttactgctctgagatatgcctctgtggatgcaattgatctcctttgacttttgccagtatctcctcttccttctcgacagttgtgtcctctcttcagcagcacccaccttcccgatgtttcttgccaactttataattttcaccttgttaagaacctttctctcttgattatcaggctataggatcttccagttaggaaagagctatgtatagttttcttctatagggacagtgatcattacatgcatggcatctcgttgcttatatgctagccctcctcctatgagcttaatttatgttgccatcgatctgtctcaacctggaaaatttacattacaaaaatgtcatgcacatattcgtagccaaagtcacatatgatcgcctcctattgccttgcatagctaatagttctgcattcagtataactttctaatacaatacctattgccatttgcacccactatgaaccatgcacaactaagtcgaatcaaccatgcacatatgtgttttggatatttgtattatctcgacaatttttaatctgctccttgttagcaagaacgcctcgtttcatagcatatgcatttgtctggtaccataatttatcacagtgaaatgactaatgatctcacaaaaagtggttttgttcatgttactttttatctccgtcctttatttaaatattgaaatttgtggaagcttcatttattgtttacaaaggatatatttccatggacagactagtcggctgagactcattattatctggctagttcattttcatgttatttttcatgtaactacattattatcctatgaagataatgctaattaaccgaatacataggaatttgaacaccatttatacctgtgtttcagaatattttactttgctgaacatcaaattccattattatagcatccatgtccatcaattgtcatcacataatattttcctttgcttacatgtattgtgcagacaccatgtggccacaacttctgcctgaaatgcttccgaaggtggattgaaaatggtaaaagagcttgtgtgatctgccgagcacctattacacaaaaagtagcacaagatctaagaattaacttggcactagtccaagctatccgcatggccaaggctgcaaacaatgctagcacaactggtgaaacaacggtttatcattataaagaaaatgaagataaacctgacagagctttcactactgaaagagcaaagagagctggaatggcaaatgcttcaagtggacaaatatttgtgactattgcaccagactattttggtccaattcttgaagatcatgacccaaggaggaaccgcggtgttcgagtcggggaccattggaaagatagaatggaaggtagacagtggggtgctcatttccctcatattgctgggattgccggccaatctacacatggggctcaatcagttgccctctcaggaggttatttagatgatgaagatcatggagagtggttcctctatactggaaggtttaatattactacctgaccttacattgcgatttgtttctgtggtttatcaaaaactagttaatccattattttctacatttggcagtggaggaagggatctaagtggaaacaagcgaacaagcaaggagcagtcttttgatcagaagtttgagaagctgaatgctgcattacgtgttagctgcttaaatggctatcccgtgagagttgtacggtaatgtttttttttctctatgtgcatccatgacaaatttagtgttagtttatgtaaaatcatcattatattatttcctatgggttgcttccgggaccatcacaaaaaatcaaagccatcacagaaggacgttcttctggtaatgcacggagaatatatgtagacctctatatgttgcaagatattatttgttccattattgttatgtaattatgatacgttgcgaataactgtactcacacaaggttattgtcttttaaggctttcagtgttacgtttagtatgtttccactacatctaatacgaacaatcttgtttcatttctttggaaaaagtaatcccaatttttgtttttgtatatgttgttctgtttgtttattaaaaggtcttttaaagagaagcgctcaccatatgctccagagtctggtgttaggtatgatggaatctataggattgagaaatgctggaggaaaactggagttcaggtatttatagttttcatgaaacattacagatattttttgtgtaggctgcaatgattttttttttagatttacaaaactgaatgtatccaaaattatagtttatcaacttatcaatataagtgatgattgttggagtttttgttttttggcctcagggtacattcaaagtgtgcaggtatctctttgtgcggtgcgacaacgagccagcaccatggactaggtttcttatacatcccttatctcatgtatacagggctattgttattctatttatttacttttccatttaattttctatatttacttgaagtgatgaacatggagaccatccaaggccattaccagatattgaagagctgaaaaacgcaattgatattactgagaggaaaggaaacccagcatgggattttgatgtaagttgttgtattatgttctcagaaaaaatattagcttgcacatattgtgacatctcctttttcttgttataggcaacagatggatggaagtggatgattactccacccatcagcaggaaggctgtcgtaactggagatcctagaggcaagaaaatgcaaggagcagcaaggcatacaaataacttgtcaatgagagaaaggctgttgaaaggttttttttttttttgtctatgaattgcagttcatagtagtggctgcttggcattgcatttccactgatttcagtcatatattttctttattatagaattcagatgctccatatgtaggaacgtgatggaagagccagtgacaacaccgtgtgctcacaacttctgcaagaaatgcctgcttgggtcatatgataatctttcccttacagaggagagaagccgtggtggtcggaccctccgggcacgaaagattgttaaaaagtgcccttcttgtccaagtgatatcgctgatttcgtacagaatcctcaggtacagtaaaatagtagcaaaaattaattttgtatagattttagtcatttttttgcgagggatttcagtcatctttcccattcttagatgatgtattctttgttgtaaggtaaaccgtgacattatgaacgttattgaatcactccaaaaagaagctgagaaggaagatcatgctagggtgagtggagaaggcagcagtgcagcacttgtagattctgatgatgaaaatgacactgcttgggagaaccaagatgatggtaatctggatgagggaggttgcaacaatcctgaggacatgataactgaatctgttgatttgaattctgttactaatgttgataatactgaaaacaaggtggaagttcagcagcctcacaagcgtaccgccggtgccgggaaggggaaaggtggcaaatgggctaggacaagctctgcaccaggtgatgcagatgccaggaatgttgtgacttcaactgaaacattggatggaatagctgctgagaatgtggctgatttagtacaaattgaggattgcactttcactggtgtggaaagagccgaccccaatgcgttagaagttgatggcaagaatatgattccagacttttcagaagctgagaaggttaaccctaaacaggatcaagaagttcttccatgatgtgtttccttgcatacttgggatgtttaaaagtttttaagaagtagtattatcttattatctttggtgacattcagattgggatgatatcatttaatttgggaataattgaactcatagtgggggtgcaactttcacttcctcaggttcaaacattaagctgctgcattattgaaacttgaaacatatgcaaattgcttgtgaagttttttttgtattcttcctcttttgttatccctttttctttgattatatttttttttgcttgccctgtttactttgcaaaaactagcttggactgaaatgattcatgggtcgtgaaatggaagaaatagtggtgatatatattgttgttgcattgattcccagtttctttcacggtataatgcagtggtggatttaccacccggcttgggcaggcagttgtccaggctatatgaacgcaaactatcaaactggactgatttctctacggtaaaatccatggatttaattacttcctgcacaaaccaagtagattagatttaactactctagttgggctgtacaagcagcaagccttataggcttacagccctgtagcatgcaattgagccctatcacaatgaataacatatggcatgctcaagcttatacgaatcatcttgtctttcaactattgaaaattttacatgcattttgaactaacaaaattgttttgcctttaattagtagtaaaatgagcgtataggcattacacatgtgggtagcggatttggttagactttcccatgctttgtgaaattcctggctccttcactggtataatgcattactagataagggaaggctcctatatgctaagttctaattgatgttattgggtgttcctctcaacacctgggaacttagtggtcgtatcaacagatattctcgataacatctggtgcataacgtgtgctacaaatgaagaagaggcagaggtttttaaccctctcatgagtagcacgcccaaccaggttgatatggtaggacagagaggtagagctgaagtgactttcttggaagttgaattgagttgcaggtttgcttgaagtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcaaccacttgtggagtttggcagggactaaggggctttttgtaattatagacctcagctagggccttttatttttaagttccttttggtcgtgtaacaagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacaccccccgcagcaacccccccccccccctcctcgtatagtaatcgtcaactgtggccccaccccagaacccgcccctgctttttccccgcgctctccattattttcggatctagccctcccgtacaccgcagttagccaagccgctccgcctcgtttccatagccgccaccaccgcctccccgtccgcctgccgccgccgccgtgtgggaggggataccagacttgggaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttagttagggaaagagtaagttcgagagagagggaagaggtagagggtacggtggtggggtgggtgggttggggcggaggggtacggtgcgtcgagcgttttagttataacgcaccctgggtgcagtttagcgcgtcccagtcttatataacaaaattatacacttccaagagtatagctagtctacaatttccagatttccttcatgtctaagggcaaaaaggtccttttcattgaaattaaacattcaactaatggaatgagtatgaaagggatcaaaatcaaaattcaggggcatacaagggagtggacaaaactcgagggcatagatggattgggtaagctttcaggggtatagaagaaatttttcccaacactcccttttatagcttgaaagggaaccaattagaaacttgcttgttgtggtggagggtatggtcaaatcggttgtggccatggtggcaccaattgttctgtggcccaacatg

SEQ ID NO: 64782 - DNA, 903 bp, Oryza sativa
tgtagttcttatgttctatgtcggcatgtggatttgcttgtgattcgtttcgaacttatcgatgtgtttatgtttcgtcgtgtaatgtcagacttcggcatgtcgtgtctttagggtctcgtgatgtaacgtcggactaaggcgcctaacgtctttaggtatgctgatgtatgtcggacttcgacacgtaatgttatgttatattattgaactctacatatatgttaagaatattttgattacatgaatccttattttctcacaacatttactaactttgcttgctttacatctattctttcctcccaggaaccaccaaggagatgtcaatacagagaatggatagacaccagaaaggttctaactccacctagccgtgttgtacagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatataatctatgtaaccgcaatgcaaatagtcgtatcatgttcaaattttactactatttcttcatgttacataattctccttgtttaagtccatataatgtttctacgacccagactgcgataggcgcctatataaattatccgagtactaatacgtcgaataaggtacaaaataatacctcacttaacatatgaaattgcgcaacaaccaactttaatacatttttataataatattaacaagttttaccaataaatacttctttatttattattaacataacatagaaaaatcttttggccgtacttttttcatctgggtccctt

SEQ ID NO: 64783 - DNA, 3626 bp, Oryza sativa
ttctctaccagagctaagttagattgttgggcccatgtggtaacctcttgaggtataaaaggaggtccaggcctagtggtggaggaggggggacttccgagcgaactggcgcttgagtctcgcagccccaggcacttgtgttctacactcgaccataatcccaaacacaggagtagggtattatgcttcttagcggcccgaacctatataaaccccttttgtctcatcgtctttgggggattgaatcccctcaagatcacacagcttcgctcaccgaatcctcgaatctcacccgctgcccccggccgaactcacaaaggggggcctcacggttccctggtggaggagttcattctccgacagattgctacactaccaatttataggtagtgttaaattttaggtaagttttggcactaccaatattttggtagagatttctattgatttggcaagttttagcatccatccaaacatcacacaagtactatttagattaaaaagtttagtagggcaagatttggcactaccaaaaacagccattgatgctcgttgggggggggggggaattgtagcaaccgaactgatctgagtattgcacagtggagtagtaggcaaaaggccattttggattgaagccaaaatgtaaccttacctatttattggtagcttcaatagtgatagtgtatgtttggattgaagtcaaatcattaataatgtctattaacaatttggcactaatctagaactttcttctctatatcatcaatatttggctttacattggtagcaattcaaatatgtaccatacatctctaccctactaaaaaattactagtaccaaaacatgccaaaaatttggcactatcaaagatttggtaggtaaaggttggtttgctttgtagcctaaatagaccttaccaaattttgtcaataccaaattttggcaagttttggcatgactaattttggtaaggtaaagttgtgtttgattgaagccaaaatagcctaagttcactattgaaatagcctattttcttaggcatgccaaaatttggcttcaaaccaaatagacactaaacactattgaaattgccaaatattgataagcctaatttaggcctcaatcaaaaccagccctaaataaccaaacagccccaaagttctgtcatggcaaagatcatgaaaagcatgtgactcttcctcaagcatttgctataagcataccaattttgttgtttaagagttccgtttcgacgtttgccctctcctcttttggtgtttacatccgcagaatacatccgagtgaaattttagttgtttctagtatttgtcctgactttgaacatgtaacataatattggatttctcacggttatggtactgacatatactacgatgttccactaactaaagcgtgattaaatttggcatggttttcctaactaattttttactttgattttttcattactacgatgttcctagcaacaaaaccacaattatatgaaaataaattcaaatgtcaatataatgatattatttttgtaaaataaaacataatttataataaaatagtatttgttaaatatttagatagttgaattttaatacgtgcataccttattcagtgacacgggtggagtaatgtgttatgtatgatttatgaaaaatctcatttgtactctagataaactcgatactataagctatcgaccaagttttaacgatttttagccggcttgaaatgtgcatctccaactgtttgtttgaaattcgtcgattttcattcaaaatcaacgataaatcgatgacttgggtggagttcaaaatttgatttataaggaatcgagattatgtgcttgtttactttgtagccgctctcaaccttacctgtttttttttttcacatttttgtattactaggttttggtatactggatgtgtttaatttaaagccttatcaaaatttggtagaattttttaagtagaaactaatagaattactaaagtttaataaggtaatgttggtaagcatacgtttggtttatcttatcaaaatttaatactccatccgttaaaaaaaaatcaacttctagagtttgaattttgtcccaaaaaaccaacttctaccctcctacctactttcagcacgtaaaacgataagttttatcccttcaataccctttatctacctatcatttttactgtttttttcaatgattaagagcattttagtcattcaccatctccactaattccaccttgggatgctagtaatgcaatttttttggacggagggagtataagattcgaagtgagaatacaatgaaggagcctaacaagcatgatggcttgatatataagatccatccaacgcatgcgcgttttatccgataatatagggtctgttcactttgatgctattttcaaccatactattttttttaagctgtcaaaaaaatatctacgtttactttattgccaaatttggtaaatacataagaaatcctggtaaaattttggcaattttaccattttgcaaaaattttggcaatggcaaaattcgataaggtttattttagctacaatctgaacatgtccattgtactataatggtatgttagcttttatgttagcttttataacatgcatgtaaattgacacgataactgatagatagtactcttttttaagtattagagtggtcttatttctcagtctcttggtcaacacaacatccacctgtttctatcccaaccattcttaccaacaactaatggaacgtttacctcgcgataaacgtatccaaaatggtcaggaagctcaatttttttttacacggcatgaaattcacttgactgaccggactagagagagatccaaagagtagatcggggcgtggagaaaaaagaagtccagatagaccccggaccccacgagtccagtcaatcgcaaacagcgcccacccacgaccacgacgaacacaaacagtaagaaccaccaacgaaaccgatctaacccaagcgaactccccactccacccgcaagcaagggtagtagactagtagtaggcgaaagaaaaaaaaaatccccccaaacgagagaagcggcagcgacgacgacgacgacggcgacagcagcagcggcggcagaagcagcagaagcaaccccctcctccgccgctccgccccatcggatcgaggccgccctagggtttcccccaggctccgcccctccgcttcccccctctccgccgcgcgcgcgcggggagccaccaaaccctaggacggcaaacccggcgcgatcgcccacggtggaggcctcgtcggcgccgagaggagccgctccgggctcgggtcggggttccggtacctcaccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtcctccaggtctctatccccctagccctcacgcctccgtagcttgtggattttctgtgactgaacgcgcggtatgctcggtgtgattctggggattgtga

SEQ ID NO: 64784 - DNA, 3442 bp, Oryza sativa
attagccccttgccgccctctgtatgggcggcaagggcctaatcgcaattttggccaacgacggggcagacggcgcggtcgacccaccgtctgccacgtcagcttgccgcccaccattagggcggtaggggctatttctgcaatttttttggtcgatagattatttctgtaaatattaaaaaaaataatctaaaaacgaaaaaaactcccgcctgcacgcctcctgccaccctaaccctgactcccctagggcgactgggctgtttttttctcgttgggccgtccgtcgccgggatgggccaaattcttgggtgttcccagacaacccattggaacggaaaaagtacaccgaaggtccctcaccttgtcgtcgggattaaaaaacatcctcgaacctcaaaaccagatatgtggggtctcttaactatacaaaaccggtcacccgagatccttcggtggttttgaccccggttttggtctacgtggcgctgagtcagcgtgggacccacgtggaccccacatgccaggtgtccacgtcaccctctctttcccctcttctctcccttcctcatctctctctcactctctctctctctctctcacttctctgcagctggccgaggcgaggcgggagggcggcgccgcgatggccgccggcggaggcagcgtgcgagcgcggcgacttctccgatttttccgcctccttgtcctgctcggccgacgtgggcgcgctcgtgtcgtcgcgcgcggctaccgcgtcggccatggcgagggagccgccccgcttcccggtgccccacgcgcggctacgacgtggggtggtgggggccgaagaagcggtgagagggtacgactacgaaacgcgctacttccggcagcggctggaccacttcaaaaacttttgttcttggtgtggctttaaggtcgatctatgtgccaaggtctcaaaatcccctccccgaaaacctcaaaaattcctgattcaattttaaatctagattttgttgaaaagttccacattggttgtggaagggcaaatgacctaagatattagtggaggaacccctcacctcaacggctagcttttggggtgggaaaggccctttacgatccttcagattttgcagtatttcaacttttgggcgggtgttttcttgcaataaccatgatatcgtgactatattttaacattgttactatgataaagcagttatgttcctactttggtcatcatgttattacgccatttctacgagacggacctaaaaagagatagcatgggggaagtcagcaggtgtactttggtcatcatgttattacgccatttctacgagaaggacctaaaaagagatagcatgggggaagtcagcaggtggatttgatcaattgatcggagtctgcccgacgtgcgaacgctttgattgacgtggaaggaaggggtgcataatatttattatgtggagggggtacataatagatgtgctatattttgtcatacaaattttaaagatgccacgggccaagatatatacaatacaagcatgtactcacgcgcatctttaaaaaaaaaaaaggtcactcacatgggaagaaccagtcagctctccatcttccatccgacccataagacaacccctccctttttatggacaccggattatcaaatctgaatgtgtcgttcttcatgtcatacacacagtaggcgcagtcaccaatgccattgatgatcccatcagagcataatctggttatgtttaagctcgaaaagaatatacagctgccataatccgatgaaagaattgccctggagcaggaggtgccgaggaagagagcttggtcacctagttccttcacctccaaccacctgcgcttctccagatctgcctcgaacacgtccagcttgatctccttcctcagctcgtcgacgccccaacggcgtacattgtaaaatatggggagatgccaccgccatcgaaccatcatcagccttccagtagcgcacgatatgacgaggtaaaaagtgctccgccaactgtagccttgacaactctaggcttgaggagctatgccgatcacgatatctgcactgatgctatcgctgaactcgtgaacgaaaagctccccgtcactgctaatggagtagagcttgccattgtagtaggctatgtcgcgcgcgaagcaggggccgccggaggcaaacagccaggttgagtgcattcccggccggtagaagaaaacgccagagccggcgatgacggcggcgacgagatcaggcgagcacacggcgatcttccgcacggcgttctcgccgaagcacatggttcgttgtccctctttctcctccccgtagtcggggaggatggcgtcgtcgtcgtcgtcgcagtgccagtggtagggcagatcaatcctggccttggagattgggttcatcaggaagcactccagctgctcgctgcggtcgtagaggagccagccatcgaacgagccgcggcagacgaccgtgcctccagcttggagctcgtcggggacggggatgcggtgcacctcgccgtcggggagactctggtaggtgatgcggccgtccaagttaagccaggggagcgccggcggcagagggtgctgctgccacgcggcgaggcgccaccggcggcacacggctcggaagcggaggcggtcgccgtgggacagcagccggcagaacaccatgcctgccagctccggctggagatccggccatggtgaccaggtgctttcatcatcgtcgtccatgatgccggctggaggtacaacaacgacgtcccgcccaagatcggatgcagcaggcatcgcgtacgtctaagatctgtgcgtacgtacgtgcttgggatctctatagctggctcgatcgtatacattgattatatatacgtatgaattaccgagtccgaagctgtcgaccgagttgtattttgctagctactagctgttaattttgtggtgctccctccgtctccatttcatattataagttatttgtttttctattttaagtttaatcaagtttatagaaaattattgtaacatttcaaacaaaatatcatcaaaatatgttcaatattaatgaaactaatttgttatcgcagatcagtatatatttaaaaaattctataaatatagttaaacataaataagtctgacttaaaaaaattcaaagcgacttatataatataaacagagagggtagagaccgagtccataggttctcccacagagcaaggataatcataattataagtcaattataaatttatttggagaagaataatattaaaatgattttttcacaacaccgagctttcatttttctatatggaccataaaattcactcttttaagttatagctgactccaaacccccctctccaccctctactccgtgcaaaagcatgggcggtggcggcgg

SEQ ID NO: 64785 - DNA, 2685 bp, Oryza sativa
ttattgtgcgagaaacccacaggagacaattttagtgttcactatcttagtaccttcgctatagttgtagatctaccttatatttgtaaagttctgtgcataatattgtagttgtcatgaaatatgatgaacaagtttatattttattatatcttggtatgcaatagtcaaataatgttatcattcctgaaccatattaaattatggactatttctgtttggtaaatgttctgctgtaatctcttcttcacagtttgcaatcttacaacttgcactgcacagtcaattattttttatacaccttattatttacatgaaccttacaatgatacttgtgttccaggcactatatttctgcatcccgttcagggagaaattgctggaatattatgcaaataacaaaactcctggagatgcggaggagaaccttttgacttgtttggcggatcttttcatgcaggtaaagtggacaaagtataagtttcttacttgatgataatgatatgtaactgtgtttgagcatattgttgctttcaaaaactttgaatgggtaacagcttcttcataactgttcttcattgcattcagtggaactttcatctaccaagtattatatttctgattgttaaggacaatagtacgctgatgttttagttgaagtaggattgtaaccatgatgctagttggtaggccctatttgcttggggacttactccctccgtcccaaaaaaaaggcaaaccgtgggtttccgtgccaacgtttgactgtccgtcttatatgaattttttttataattagtattttcattattgttagatcataaaacatgattaatactttatgcgtgacttatctttttaatttttttcataattttttcaaataagacggacggtcaaacgttgggcacggaaaccagggtttgtctttttttgggacggagggagtattagcctgcttataatctaaatacctaaacctaagcaaacagaaagtttttttattcggctttttttaaaagccataagccactgttgcaccaacaagccaaatgctagatttgagtagcccttttggcttttgtgggttggtgttatccctccacccttatacttgtggattaaaagctatggccttgcagactacaaatttcaaatagctagattaagagcttatgctgaaaaaagtggtgggtcttaggctcattcctgggagaagaatatcagaatatggtaagtcctattctatattatgtaaaggccttaagttttagtaatgccttacagggtggcatcaagtgacttgtatctgctgtgcagcctttaaaatatctgttccctctcttcaggatgacacgatgctgtaactgtagtagacagaagcatgcaaagtatttttattttcattctaacagttctcaagaacaaatgtttttgttacgacaatttaagaacttatattgtcctattgattatgcttctgcaataaggggttatctgtaatggcatgttttagttgtagtggatgtcgtggtgttgtcatgccgatgacagggtgtcaagtcagttgaaagcaatcagtactcaatattattcccagaccattcaccctgagtccttgatttgaggtgagaagaccctttaaaggatagataatcacaaagaaataaacagttctagcagaggtctaggagatagggatctctgatctggcttctgtggtttctctctgtgctgctgcttaatctctgaggagaacctggtggacgtggaagaagttgtggaggcattagggggtagcagtatggcagaggaaagaaggataggtcataggtcaggaaagtagtgaagactgctacctggtgttggtgtgagtggaagcctggcaatatcaggacatgagattacgtaggtagtgaggtagctggccgtctcacatattatccccctcctgctatttgtgtgctccatgtgttgattagggtgccagcttttgtttagcaccctcatccattgaagtcatcatataatcgctgccagggtgaagtttcgtatgttgccagttaataaatctctattgcactgagtttgaaggttttacgtcatcgtgtgttgatcagagaattatgatggaagccacttgatagcactgtgcagctccatatgagatatatttgttgtctgtgtgctattttcttgtttgggtatcttgaggtgatttttctagtcttcagagagtgcactgtttattggaagccacttgatagcactatgcagatatatttgttgtctgtgtgctatttatttgtttgggttttcttggggtgatttttctagtcttcagagagtgcactgtttattggaagacttatatcaacttacttagagtaatgtacactgacctgctgttacaatcagcatatattctaaaatccatcacacaagttgattaccaaataagatatttggcttgatgtcgtacccacaaattcattgatctgtgtgcattatgtttactgctcggttttgtatggtctctgaaatttctgtcaggatattgtctctgtcagcaacttaatggatcataatatatattgcaggtaagccagtcaaagaaaaagactggcgttattgctccaaaacgctttgtccaaagagtaaagaaacagaatgaactatttcgca

SEQ ID NO: 64786 - DNA, 5824 bp, Oryza sativa
ccctcgccaaccggctgccgccaacgaggacaatagcggccgagcatggaggccgagcgcgccatagtcactgctgcgaaccccatcctcagcggcgagcgctcaatgaccgccgacctcgaggccatcaaggctcctgacacagctgccccgctccctcctcgagcttcctcccggccctccttactccctctttgagttcccttgctaaccggccaccgccgccgaacccatcctcagcgcctagcgtgccatggcagcagacttcgagggcgtgaaggcttccaaccaggctatcgaggccttcgacgccgcctcctccttgcagcagccgacgctgccgccgcctcctcacagcagccggtgccaccgctggcgagaagaagtagccagaggaggaagctaccggcaagaagggggagaaggggaatgaccgaatgaggagttgctggagatagggaggagggtggggcccactgacatgtgggtcccgctattttttatcatttgtcttacagacatgtgggcccatagtctctatctctacttctactactattattaaaattgaagatgtttttgtgaagagatttttgtacgtcgtctttgtccgatcgatcacctgattccgcgccatccgttttagtccatcggcgcccttcaagcctttgcgatggaatttttggctcccttttctattttcgggaatgctaggggacgggatatcgtcccccaacgggatagctcctcctccataacgtgattcttatccatacacgcaccaggcctgctcactcgccgccgtcgctgtcccccgtcgctgctgcgcccgtcccctgtcgcctccgccgccgccgtgcccatcccccaccgccgccgcacccgtcccccgtcgacgacgccgccgccgccgcgtccatgccccaccgccgccgtcgcaatcccccgccgccgccgcgctcgtcccctaccgccgccgtcgccgtcctcatctacaagggacatctgcagggggccgaccgcacgtgtcggggtgctcctcccccaacgggatgcccagctatatatagtaggaatcacctgatacctggtaggtatcatccgatacttcgtaagtatcacgcgatacatggtagaaattgtcttatacctgacaagtatcatatgatacctcgcgagtatcacgcgatacgtgttagaaatcgtctaatacatgacaggtatcgcatgatacctcgtgagtatcatacgatacgtggttgaaatcgtctgatacctgacaggtttcacatgatacctcgcgagtatcacgcgatacgtggtagaaatcgcatgatacctgataaatatcacatgatacttgcaagtgtcacctgaaatgtgtgtagaatcgtctgataccttataggtatcacacctgatacctactcgggatcatcatgttgtgtagaatcgtctgatacttgataggtatcacacctgttacctactcgggatcattccgttcgaaaacgggattccattatatagcagcctctttattttttgtctgtaagatctgcacaaagatttatatttatgtagacccaacttacaattacactcatttacaaaacgcttatatatactatagaacacttacaaatagttacagtgtatctgcactcagttatattataaaaaaattgattttacaactgcttttgtctctagaattactatttttaacatgtttgttcttttttttttgttgaaaacgtagtattcactggttgaaagttttgtaagatttgttggtccaaatctaatgagtactccctccatccctaaatatttaacgccgttgacctttttaaacatgtttgaccgttcgtcttattaaaaaaaacttttgtgcaatgtgtaaaactatatgtatacataaaagaatatttaacaataaatcaaagaattaataattacttaatttttttaataagacgaacggtcaaacatttttaaaaaagttaacggcgtcaaatatttttttttaataagacgaacggttaaacatttttaaaaaagttaacggcgtcaaatattttgagatggaggaagtattatgatgtagtgataaacaatctacttgtagaatgcaaagaaacgaggtcgtggcgacccacacgcacagacaaaagatttcagtagtcaaagcgagacgattccgtcacttccgtgagaaacaacgacgttttctgagacggcgtttccgctgctcgccgtcgtcgtcgcccatggattcggcaccggcgccggagccgccatgagatgcaggaacgggttcaccggaggcgcgacgtccatctcgccctccagcatcttcaccaccgcgcccatcggcggccgcgcctccggccgctgctgcacgcaccagaacgccacctggtacatcctcaccaccgcctccttgcaccgccgctcgtcgtcggcctcggccacggtcaccacggcctcgccgtcgctgccactacagatctcgtcgctcggatgattgatggcggcggcggcgtcgtcgaccatcatcaactcgccgcgctcgtacctggcccacgcctccatcggccaccactgctggctctccggcgcggcctcgtcgaagttcctcctccggccgacgatcttgaggaggagcatgccgaagctgtacacgtcgcacttctccgtcacgccggactgcatcaacgtctccggcgcggcgtagccgggggtgccgcgcatgccggacacggagacgtgcgtgtcgccgcggttcaccagccgggccagcccgaagtcggccaccttgggcgtcatgccgccgtcgagcaggacgttgccgggcttgatgtcgtagtgcacgatcttgtgctcgcactcctcgtggaggtagcggagcccccgcgcgacgccgatggcgatggcgcgccgcgccgggacgccgacgtcgcggctcaggtcgaacaggtaggcgtcgagcgcgccgttgcccatgtactcgtacaccagcgcgcgcacggcggcgtcgtagcagaagccgaacagcctgacgaggttgatgtggtgcgtcctcccgatggtgcccacctccgccatgaactgctcctcggacctcctcctgtccatgccgccgcggagcaccttgacggccacggcgaggccgttggggagcgcgccgccgtacaccgtcccgaagacgccggcgccgagccgcgccgagtagccgcgcgtgaacccggcgagctgccgcggcgtgaaccggatgggcttctcgtgcgccatctcccacaggaacctctccaccgtcgcgctccgcatcgcggcgtcgggcaccacggcgtagtgcgccgtcgccttcatctcggcggccaccgcggcgccgcagctctcggcgccccggtacaccttgaccagcaacgccgcgaacgccacaacgaagatgatcgtggcaatcactgcagggaccaccgatcgatcaatgcaaaaatcaaacaagaggaagcaactcaatataatcgaaatcaagcagccagtagatgagagaatatatgagatgatcatggaaaccgatgacaagggtgcacaccgtaacggcaggcgacgccatgaagcaggtgatgtaatcttggtgttttgatgaaagcatgtgaagagtgacggccttgtgccttgctccacacggccttgcaaatcttaataaatttagccggcgattaactttttcttgagagagaggcaagcttatcccaactctgtgactagtgaggtgattgcgacatagcttagcggatgattactgtagcatcactgtagcaaatcctggattaatatgcttcgttagattcgtctcgtaaaatagtctaggggttatagaatgggttttgtcagtaatctacgtttaatactcctagatagtaagattctgaaagactatttaatagtccggaggatcaaacaaaaccatagttcgctgaaattttctgttatacttggatagatatatcacatatatttacctcttcactactttattagacataaaatttaaattagtttaactagtttgaaaaatgtacggtcgacactgtcacaacatctccaaagagcaccaaataaaaaaaagtgctccaaactccaaagggtccctatcccaagtcacaatccctgccattcgtttgttgtcgccttaactctatgtctgcacatttaaaaattgaacgttattattgatggattcattcatactctctccatcctaaaataaactaaccttgaatattatgtgatacatcttacaaatttagttgtactatatatttagattcgttgaactaagaagtctaagatgcgttacatactagtacgatgtttgtttattttaaaatggagagagtggttttcaaagtctgcttagccaccatgtgccctgctggtttgctagctggccatatgccacccctctgctcgtcatgctcatcctcttcgttatcatttggatttattttctataaaaaaattggaacttatcattgctaagttcattattttttgtttttagaattctggcagccaacacattcctctcgcctcctgcccccctgcctcccaatcgtcaccacatatattaatccattaaaaatatagctattaaagataaagatatttgtaggcaatcaataacatatgacaaagttaaatacagagggtgggatttagatattgggttggagaaaaaaaatgtggggagaaaatatttttagggagttccctaaatgggggttgtcaaaaattgaaaaaaacttgaacaaatatgtaggtgaattatcacttgtattagtttgaatacatcacttcatggagctagagcccatctctcaagtgtgatgagatgcatatatatatctttaaggatatataagtggaacccttgtttgacatttcaagcaaaagggaagtagatcagtagcatcgccacttgtgatgccactatttgtgcatttgtgcaatactctcttttagataatggattaactaaaacccacactctacatcctacatgtacatgaccaaaactgtgcaatactcctttcaacaaaaactaacagttgtgcaactgtaacttccaggaaacatccaaattaagagaagcgctaatacagaggtaatgtcaatccaaacaactttatggtgttgcgcaatgcctaacattcatcatctcctctccaacttgcttcaaaccaacgaccactccactctacgagctccaaactccacccatatcttttgccacatactacttcctcagaataagttaattaatctgagattaatttattttggatagacgtctgtccagatttataaaattaggatgtgtcacattctgtgctatcaccgtaatggtatttgattagagcaagtttaatagtatagccaactactaactccaaagcatctacagctaatgtaatagctaattcatacaatagttccttactatactattaatacccggtcctacctgtcatacacacattacgtcttggagtttgtgctgcagctggctacagatctgtagcccactgcttttctctctcttcctttatctatttaaaatatgtttatagctggattatagcctgctattatacctgctcttaacaatgtaatgatccaattggaatgatcacctctgcagactgacgagaccctgatctcaatgagttatcactttcagctgaatctgtagtgcttgtccacctaagcgcagccgccggcgacgcgaccaaatgctggaacgggttcaccg

SEQ ID NO: 64787 - DNA, 726 bp, Oryza sativa
tttgttttttgtttttgggcatatagggatacttttatagaattgaaatattttctgtgtactatatcattttctgaattatgatctgtactatgtgatatattcaggaatgcctgttctcatagatgtttctgttgtaagaacatttgtagttgacttactactttgatggtacagcatacatttattagatagtgttgactcagttttattctctcgctaaatgactgaaaatttgtgattgctcatgtggtggaattcgatcagagtctatccgaaaacatgcatccagaatattggttttcccagatgcttttgctcaacttttgttaacatttacgcttcttcactctccaggttgttgctggatcccatccccaccctgcaaacattggtgaattgttttctgagggctcgttgaatccatatgccgaagatccttatgcatttggctagaaggtaatatagtttccctttttttacttattgtattttctaatagtaattatatgtctgcatgaataatccatcaaggactgcatgcaatgttctaaaatgctagagtagtgcttcagcgacttttacttttggtgaatagcattctcagttgtcagacctgaaacttgaactcctctagcaccatactgcaactttcgtatgcttgccgtccttgacttgttgtatgtcaaatgtacctgctttgcagtgtttggaaatgttgatctt

SEQ ID NO: 64788 - DNA, 99653 bp, Oryza sativa
  unsure (1)..(99653): unsure at all n locations
cccaagctcttaaatagtgtgattttttttatatgaaaaatactatctactcgtacatatgaatattgtaaaatactatttttaatccgctttttaattttgtaatagttaattcatttgtttgtgtctcgaatcattcagctattaagtattccattatattccattggattcagcctgaagtatacaagtttgtataaatatttaacgaggatgtaagacatgaaagccagtagtttactccttccttctaactagattgagtgcttaattagttatttaaatagagacaaaaaatgtatattgtgatggagaatatacctctgcgtggattagcagtagagggccaaaccaagagtggagttgaaggaccatgaaagtatctgatggagctcactgccagagccgccggtggctgcggaaaacccaacggatacctcttgtggaagcaatgtgaccggatccggcaaaatcgcactgacctcggccggttgaaacgatggatgatcatcaaaatgcaggttggcaagcagcatccgggtgctgctgttaaaactgatggaggctgtcatcgtgccattcaggctgtagctcggcaaacttgtcgtgttagccgactcgatggcgctgatgtcgacgcccatgtggtcgtaggtcttattggggtcccagatgttgttgtatgtgtcgaactcgacggcgatgaaccggtctgtgccgtaggccttcgaatgattggtggcaaggaggccaaggttgcctccatctgaattcgatggaatcgttgatgggtaagcagcgaggaagaaggccagcccgtccccctttgtgtccgtcgggttgctgatgtcgcttctgatggcgatagcgaaggtgaatcgcgtgctgaagctggccacctcgcccgtggtggcgtcgtagaacttcacggcgtgggcgtacgacatccgccccttgcacttgtggatcgtctccgcgaactcgttgcaggtgaggtccaccagcttgttgctgggctcgcttgcgttgccctcgaacaggaggtcctccaggcggtagctggctgaattggagaagtcgaagctgaaggagagtggcgccggtgcccgcgattcagcctcgacaagaaacggtagcagaaaacacgctacgatgagggtgagcttcgcgctgctcacaccttctcttactggcaagcctatcgtcattgtgtcgagtgtcatatctacagggttgttgcctgggctggctgttcgtgggatcaatatgatgaccatgggtgcatgtatatatatagccttggcagctaggagtagtgtatatgtgcaggcgagattattttagaatacatgcatgatgcaactgatttacttggaaaatctactcaggcccttttgtttaggcttaaacttattggcctagacttttaagtcagcttattggcttatatgatttataagccggtggatttaatgtcctaagtttagtagttgaatcacacatctacctcacataagccaaaaacacttctccaacctagtttttggcttaatagtgttagagtggcttatggcttcaaaaaagccaaacagaaaagctacttgtttgtttaggcttagacttttcgacttataagttggcttataagcctaaacaaagagggcctcaatttatttgtataggaatttgtgatgtactggatggttgtttgtatagtaagttagagggtcattttatcatttggtgttatgtgagaagttagtactatctccatcccaaaatgtttgacgccgttgatttttttaaaaatgtttgaccgttcgtcttattcaaaaaatttaattaattgttaattctttttctatcatttgatttattgttaaatatacttttatgtatacatatagttttatacatatcacaaaagtttttgaataaaacgaacggtcaaatatgtttaaaaaagtcaacggtgttaaatatttagggaaggagggagtagctatgtacttggaatcttggactgtgaggatgcattgatcgatgcagtcaaaggtttgctggtgatttaaaaagaagaagcaggagatgcacagaaggatttcacgttgctgagagaggagaatttggatgcaaccggtctgtgcatgcgcgtgaagaccgcgtgaagcatggcgatttggtgtcggtttgcagctgattatttagcgcgtgcaatgcccgatcttattagttatagttttcttttcagttaagatttgcttattttgtgtgggaccagatatgattatgtcaaactattgtttacttttgccgatatactatatgccagtgccggccgattaggagagctgtgctaaacaaaatatcagtctattattttcttctatactcccaccgtttcataatgtaagactttctagtattatccacattcatatagatgttaataaatctagacacacatatatgtttagattcattagtatctatatgaatgtgggcaatgctagaatgacttacattatgaaacggaggtagtactgtttttatcgactgaaacacgatctgagccgttgattgggcgatgggtctattagggtgaggatccaagaccaagatttaccttatcgtttgggccagggttaccccttcccccccccccacacacacacacacccagtagcgcggtaaccgccgaaaatcgcatccaaaaattcgaattcaaaactcggtggtttcgcggcttcgctgtggttaccgcatggttaaccgcgatattcgcacagttatcacgggctgtgcagctgaaatcacgtaaatgaaaaataaataggcaaaaaaatcgaaaatacggttgaatatgtgtagaaaactagaaattgaggataattggaagaatacgtaggattcttaccgatattgtcttcctttttttctaatttgtaaactattttcggtttcgccctcaaatttgaatttagcttaccctatttcaaaaaaattcatcatcattggcattacatccatgatttttttcatttttttattttttccagaattttgaatttggtcaaaattcatccaaaccatatcaccggtttcctgtaccgtatccctacggtaagtgcgataaccgcggtaatcgcgcggttaccacacgataagtgaaaccctattcaagaccaccactaggctttttttaagtagtagagataaccggagggagtatttcattgcagcagacaagttcattcaacctgaactgtccatctctatctcaagtatagtaaaaataccaaaccggagatcgaacccctcaagttgctggttcaccagttcaccggtccaaccatcaggtcactggtcgaaccgctgcctttttatttattaatattatatttgttttgtattattttatatacagaaacaccagatattgatgaatatgtatgtaaaaataaaagttttggctttcctgctttagttttatccttggggacaagttcaacacaatggtcccaagcaggatcagcttccctctgaccttttactggaacggatttcttgtttagtttcagcagcagagcaatcctcttgagattgtggttaatctaaccggcacaactggtggtagtgattctggagtggataaagaattcactgctgcaaatggataaacatcaggtcacaactcccaaatctaatggattagaaaacaaatcggtagccaataaagttcatcgtatatgtaataccaattttagactagattgggtgatcaacagagcaaatcaaacacctgcacttccgcagctaggctaactagctagcaacagatctggtgcaataagctaatcaaccacacatgcacatatatttcttgaggctagaacacgaagcaactcgcaatgatgtgcccttcaaccttgccaccggcttgctctgctaccggcgtgacgccgcgacggccgtcggcacctcggcaacttcgtgctaccggcttgccgcgctactgttgtggcatgttgatgtgaggtcgccggacactgcgtcgagagagaaatcgcgaggtggcggcgacaaggcgcgacgcaccggggaaaacttgagcagcagtgagtaggggtaggtcttacactactgtagaaatcatctttggtcggtcggccaaattccacaataatctcggttgctaaaaaaaccaagactaaaaaatatttttagtcctggttaaaagcctagcgctattttttttatctttagtcccggttcaatagttggaaggcccccaacgaacttaagtcagtctcggttggtaacaccaaccgggctaaataatctctcccccacgatttacgcactctctctctctctcccttatctcctcacgcacaacgcccactccttcagtccttctcctcctcccccactcctctatccctctccctcctcctcctcctccctctccctctaagtcacagacgcggcgccctgcggggccgcgcccggccaggccgccgtgtccggtggaggccggtgcgagggccacgcccagcggcggcaggcggtggattttttttttcttttcttttttcgttgttatttgtgaatgattgtttgttgagaataatttgttcagtcgatctgtgatttgagaatgagtatgttgttgtgatttgagaatgattatgttgttgtggatgatttgagttgagaatgccggtgtggataatttggcgatgtcgggagatgatattttttcaatgattaggagatatcgagcgcgatatatgtaaatagggaaaaaaaagccttatgttaccaaccggggctaaaaatccatctttagtccgggttatttcaaccaggattaaagatgaaaatctttagtcccggttgcataatcgggactactggaggttacaaaccgagattaaaaaggtttcttcagcaattgagtttgagcttaaaaaaattgaaatgtgagaggttgagtggatctggatgacggccaaatttctacagtatgtcaaaaaccctaaggtggcttatcatttttcaatattacccctgagttcatagtaccaacgaccaaggcaagcaaaaggaaaggtattgtgtgtccaaacacaaaaccacccagttctacagaaccgcaccggttcagcggtccataaaaactacccggtttatccgatttttaccggtccgactgcggggacggtctttgtgctgaaccgagccgtcatggtcaccagttccagtttttccggttcaacagccggaccggtcccttttttttactatgatatacagcagtgtccccaccagtcagtagcagtggcgaaggaagcgtatctcccattccccggagcgctcgagggcagcgaatcgcgatttcgaggtacgtacagctccctcctcccttccatctcttcttgcatcgatcccctccctcctctagatgttcttcacggatcaatcactgctcgagcgttgtttcttgcgctgagatctcgaatcttgctcggagttgtgctgctgtggattcatggcttattgattcttgggtcttgtgcagtttccacgcgcgccacctgttcgacgaaacgcctgcctgagcgagcgatttcgaggtatggctcctttccttccttccttcctcccaactcttcttgcatcgatccttcttctctggatgttcttcacggaaaaactgctcgagcgttgtaaccgttgtttcttgtgttacggtgtcagatatttcttcgaagttaagctgcaggttgatgggttcctgattcttggtcttcctcttctgtgtgcagtttccacgcgcgccatctgttcgacgaaacgactctgcgcgcgtgctcggccaccatggaggggtcgcctggcaagatcaggctcagcaccctccccgacgacatcgtcttccgcatcatgtccttcctgaccatgcgccaggctgtgcggatgtgcgtgctgtcgcggcggtggcgcaacctctggcgcaccgtgccctgcatcaacgctgacatcagcgagttcaagcggagagataccgagcactatgatcaagagacggaattggcgttcaagatgttcatggaaaggctgaatgagctccgcgaccccgcccccttgatacacacgtttcggttcaggtgcatattggatttgaatgaggaaatcaaccatatcttggactcggaagttatcaacggatggattagccacgctgtgcagaagcagccactttctggatattgtcctgctgtgtgacaaattggagctcaatcactctgcattcaattgccgctacctcagaagaattgacttcaccaatgttattttgatgcaaggattcttcaagcaactcgagatgggctgtccagcaatgagaggtctcttcttagatgaatgcagcgttgaggatgttgagatctcctcccagacactgaaggttttgaccatcaagaatactcatgtctcctatggcaacaagactactatttcgacccccagtgttacttatctgaagttgtggagccctttgaatggcacatatgtgcttaatgacatgccattactagtgacttcattactggtactttatcatgtgcaagactctggtgattttttccaaaatctcaggagcctttctgctgctaaaagtttggagttcgattatgttgggagaagaaaacaggtaagcttattggtcttacacatctcactttccttattatatccaggaatcttaatgtagatattgatatgaaaaaggaaaaaactcaagctcggtgtttcttattgacacttcacaattcacaattacaccttcaaaactaagcgttgcataactaattcttatgtgtgaaatcatgatgattttaaggatcactgatgccatcaaccattcgatgcaatctatttcatgttgtcagtttatttgtataccaatcaacctgttggtcaagcaagaagttggctatttgatttcacaatgaaactggagcatttcccatttggtaactcaacatgctcttgtttgctgcaatattgggttcgcaactgaaaatttatcttttaagaaatccgggtgattgtctaacttcaattgacattaatgcacatgaatttgaaaattaagacatactcaaagtcaacatacaaatggaaatgcctcagcaaatgttgaaagtcttactcctgctgcaccgcacaatagttttttgcattgtgattagactagtgtaactacctaactttcaacgaaagtcttggtgaaagcaaactagtatagtatcatttattctggtttttggttggcataatgttagtgctttggattgtgttgtcatgtttagtgtgaaattttgtctataacatggcatgattttttctgttgccacataatcatttcaatattgtgcagctgacaattgaaaacaatttgcaattgtacccaaaattcaacaatcttgtcagcctgactctcggtcaatggtgtctggatgcaaacttctatggattgacggtcttccttcagacctcaccaaaaataagctaactctaaagcttgaaaaggtaaatcttttcctccaaatgcatatttatccttcttgaatcatttttcacatgtcaatcgagaattagctcatcttattttgttgctatattatcaccaggaaaaaccacaaagaatcattggcaaacttgaagatagatcatttacatgtgagcaccttacgcgtgttgaagtcgtatgctcggaggatgatcccctggtcgaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgttaatagtggactgacctctgctcaggttcatatcataacatttgttgctccagttgagtccgaaagcacatataaacatgtatactgctcttgtttggtgctatgatatgagtagaaacaatcatgtcttagtagtactatgtaagtgaaaggtctgtcaccttgttctgttgatgttctattgtcctataaccaagacgtactgcaagttgatgcttgagtactctattattttgcctttatattttcccgacgtgatgttatacaccatgactggaattgagatcacctttgcttgtatgactgtaactttagcagtcatataaccatctttggatcaaataacaaggactcagatcgcaccaatgctgacaaacagtattgctcctaaatccaggccgttgaaacctttgatctgatggtagtgaagatataagactgctaaactgaagatataagactgctaaacttgcagtccctattcaaactgcatgggatcccaatccatgactctggctctatccccttcagtacgactcattagattttttttcctttttgtgtaatgtacacatgaaataaaaaattacttccgctgtttcatattataagttgtttttgactttttttttactagtcatttttttaggtttaacaaagtttatagaaaaattgaataacatctagaaattagttttattaaatgtaacattgaacatatttatattttgcgttggaaatatttttatttttccaacaaacttggtcaagtttaaaaatgttttttaaaaaaagtcaaaacaacttattatatgaatatgaaacggaaggagtggattttactggaaataatgagcatggttatatatcaacaagctgcaacaattttctgtatcagtggaaaacaacaaaatcaaaaagctgttaattttttcatacaactatatatttgttatgaaacaccactgtcacacacatggttatggaatctgtgtcacacattgtattctttgatcgaaaatttcacaaacatggggcaccaacatcgtcgattcagagactcgtgtaatggcggtgcagttgcacctgaagaattcgatgcagtggcatcggcttatcagattttgggtgaagctgtcgtaccactgttgtaggagtaggtggtaaagggagacatatatataaccctatttgtttcacttatgtttgtatgcttataagctacattttaaattttcaaacttaattttagatttgatttgatgttgtttaaagggttaattcgatccatgccactgcaactttgccaaattaaaaaattatcactaatattcatcatatcagctacatgtcactcgaaatttctaaaattaaaaccatgccactcccgtcactttttctgtctcctctccggcgattgaactgggcgagtgggcggccccgcggcatggagatggaggccttggaggccggcgggttctcccttgcgcgggagaggccgccggcttcgatctgggtgagctggtcgaggagacgctcgaaggcggagcccatgaggaagtccgacatggtctccgggagcgggcggaggccggagcccacgccgtcgtcgtagaagagctcgaagctagtaaccgtggcgagggagtcatcgtcgccggcagctacggcagcgggggagcggcaaagcacgatgacggggttgaacggcgagcggtcatcggctgccgcccctgcgtcagcgcagcatgtccgtcgcaggcgcaggtctttggcgtggtgcgcgcacggtggcggaagtaagccgtgcacggtgggggtgcacccatctcctcgaggatgccgccggcgtaattcgggtaagcgacagcggagtctttgtgaggggcggcacgcacgaaggggtcgcaattgtagcaccagtaggaggaggacgccggcgcagcaccggcagcggaaggggaggaggagaaggaagaggaaggggaagaagccatcggaaaccactttttgttctctctcagatctgcttggaaaccactgcaagaagggatttttgtttggtttgttgtttaccggcggtggtcaaggacttaggttcctgagggcggcgcggttgcagcagcaggaggaggaggaggagcggtgttgtggtgggaggttggtcggaggagaggagaggataggagaggaaacatgaggggaaacgaataaactgggggaggggggacaaagacggcgtgagagaggagacagaaaatgtgacgggagtggcatggttctaattttagaaatttcgagtggcattgtagctgatatgacaaatagtagtggcgtttttttttaaatttagcaaagttgcagtggcatgatccaattaaccctaattattatgatcaaaattaacttaattactactcgctctgtttcagattacaagtcatttttgactttgatcaaagtccatctgtttcaagtttggtcaagtttgtataaaaaaatactaacatttttaacccaagataaatatattatgaatatattcgattatagattcagtgtaacttatttggtgttacaaatattactatatttatttataaacttgattaaatttggagtagtttgattttaaccaaagtaaaactgacttataacatgcaacacaaaatgacttataatatgaaatggacgaagtacgactagattctacaaccacattagtattattttaccggacagagtatttcattgcagcagacacatttatccaacctgaaccgtccatgtttccatcgagggagcagtaaaaaaaccattccccggagcgctcgaggcgaatcgcgaattcgacatttcgaggtacatacagctccctcctcccttccatctctccatgcatcgatcccctcccctagaatgttcttcacggatcaatctctcctcgagcgtgctttgctgtgttacgatctcaaatcttgcttggagttgtgctgtggattcatggcttattgattctttggtcttgtgcagtttccacgcgcgccacctgttcgacgaaacgcctgcctgcgcggtttcgaggtacggcttccaactcttcttgcatcgatccttcttctctatatgttcttccctgaccaatcaatgtcttctcgagcgtcgtttcttgtgcttggagttgagctgcgggttgttcggttcctgattcttggtcttcctctctcgtgcaggttccacgcgcgccacctgttcgacgaaacgcctctgcgcgcgtgctcggccgccatggagggttcacctagcaagagcaggggggtcacgggcccagcgcacactgacgacggggactggttcagcgacgtcccggacgacatcattctcaatatcatgtccttcctgaccacgcgccaggctgtgcagacgtgtgtgctgtcgcggcggtggcgcaacctctggcgctccgtgccctgcatcaactccgacatagacgagttcacgcgggactccgactcggaaggatactatgatgaaaagacggaattggcgttcattatgttcatggagagggtgatggagctccgtgaccctgctgccttgataagcacgtttcagttcaggtgcaaatttgaattggatgaaggattcgatgatatctcggaccctgaagatatcaacgcatggattagccacgctgtgcagaagcaggcacgggttctggatattgttgtgctgtgtgacaaattgtatctcgaccactccgagtttgcttcccgctatctcacaagaattgagttcaccagtgttgttttgatggaaggattcttcaagcaactcgagatgggctgtccagcatgggaaagtctcttcttagatgaatgcgccgttaatgatgttgagatctcctcccaaacactgaaggttttgaccatcaagaacactctgttctccagtgacaagactactatttcgaccccgagtgttacttatctgaagttgtggaggcctgtggatagctgtgtgtttaatgacatgccattactagtgacttcattactggtactttatcatgtgcaagactctggtgatttcttccaaaatctcaggagcctttctgctgctaaaagtttggagttcaattatattgggaaagaggtatgcttattggtcttacgcatcccactttccttattatatccatgcatcttaatgtacgtattgatacgaaaaaagaaaacaaactcaagcatgttgtttcttattgacacttcagaattgcactggcaaattaagacgaattcttatgtgggaaatcatgatgtgttgtaagaatgactgatgccatcaaccattcgatgtaatttatttcatgttgtcagttcatttgtgtataaatcaacctgttggtcaagcagacctgaactatcttagctggctattcgatttcacaatgaaactggagcatttcccatttggtaactcgacatgctcttgtttgctgcaatattgggttggcaactgaaaattcatcttttcagaaatctgagtgattgtctaacttcaattgacattgctgcacataaatttgaaaattaagacatactcaaagttaacatacaaatggaaatgcctcagcaaatgttgaaagtcttactcctgctaccacataatagttttttgcattttgttaagactagtgtagctacctaacttgcatcgagagacttggtgaaggcaaactagtatagtatcgtatattctggttttttgttgaaataatttctttctgttgtggcacaatgttagtcctttggattgcattgtcatgtttagggtccctttgagttttgcaatcctctggttttttgttgacatcatttctttctattgtcatagtgttagtgctctggattgtgttgtcatgtttagtgggaattttgtctataacatggcaaggttttctctgttgccacatgatcatttcaatactgtgcagctgacaatggaaaacaatttgcaattgtacccaaaattcaacaatcttgtcagactgactcttggtcaatggtgtctggatgcaaacttctatggattgatggtcttccttcagacttcaccaaaactggagaagctaactctaaagattgaaaaggtaaatcttttcctacaaatgtctactgatccttcttgaaagatttttcacaagaacacatgtcaatcgagaatatagcttattttattttgttgctatattattatcaggaaaaaacacaaagaatcattggcaagattgaagatagatcatttacatgtgagcaccttacgcgtgttgaaatcgtatgctcggaggatgatcccctggtcaaagatgtggtcaccttctttgttaatagtggactgacctctgctcaggttcatatcatacgccggatgtagatcaaggatgtgtaacctgcatggttaattggttatatatcaacaagctgcaacaattttttgtatcagtggaaaataagaaaatcacaaaactgttaattttttcatacaattatatatttgttatgaaacaccactgtcacacacatggttatggaatctgtgtcacacattgtattctttgatccaaaatttcagaaacatggggtaccaacatcgtcgattcagatactcgtgtaatggcggtgcagtttcacctgaagaattcgatgcagtggcatcggcttatcagattctgggtgaagctgtcgtagcactgtagtagtattaggtggtaacggagacatatatatatatatatatatatatatatatatatatatatatatatatatatatatataaccctattagtttcacttatgtttgtatgcttataagttacatttttaaatttttcaaacttgattttagatttgatttgatgttgtttaaagggttaattggatctatgccactgcaactttgccaaattaaaaaaataccaccactattcgtcatatcagtcacatgccacttaaaatttctaaaattggaaccatgccactcccgtcactttttctgtctcctctccaacaattgagctaggtgagtggacggccccgcggcatggggatggaagccttgcaggccggtaggttctccctcatgtgggcgaggccgccgacttcgatctgggtgagctagtcgaggagacgctcgaaggcatagcccatgaggaagtccgacatggtctccgggagcgggcggaggccggagcccgcgccgtcgtcgtcgccagcagctacggcagcgggggagcggtgaggcacgatgacggggttgaatggcgagcggtcgctagccgccgctgctgcggcagcgtagcgtgtccgtcacatgcgcaggtcgttggtgtggtgcgcgcgcgggtggcgaaggcaggcggtgcgtggtgggggcacacccatctcctcgaggatgacgccgccgtagtccgggcaggcgacgatggagtcttcgtgaggggcagcgtgcacgaaggggtcacagctgtagcaccagtagtaggaggacgccggcgcggcactggtggcggaaggggaggaggaggaggaaaaggaaggggaagaagccatcggaaaaggatctgcctaatcactttttgttctctctcagatctgcccagaaaccaccgcaagaagggttttttatttggtttgttgtttaccagcggtgatcaaagacttagtttctcgagggcagcacggttgcagcaacagcaggaggaggaggagcggtgtggtggtgggaggttggtcggaagagaggagaggagaagaagaggagaggagaggagaggaaacatgaggggaaacgattaaactggaggaaaagaaacgacatgagagaggagacggaaaacgtgacaagagtggcatggtttcaattttagaaatttccagtggcatgtagcctatacaacgaatagtaatggcatgtttttaatttggtaaagttgcagtggcatggatccaattaaccctaactattatgatcaaaatttatttattgactactcgctctacttcagattacaagtcatttttaactttgatcaaagtaaatatgtttcaagtttggtcaaatttgtaaaaaaaaatactaacattttcaaccgaaaacaattatatcatgaaaatatattcgattatagattcaatgaaacttatttggtgtaataaatactactatatttatttataaacttaattaaatttagagtagtttgattttgaccaaagtcaaaatgatttagtaatatgaaatggaggaattacatactccctccgtccaaaaaaaactaacaaatctggataaatggtagctcagattcgttgttctataagggatctttttgggacttatggagtagactagattctataaccacattactccaaggacttcctccgttttaccatgtaagtcattttagcatttcgtatatttatattgatattaatgaatctagatatatatatctatctagatttattatctgtctagattcattaaaataaatttgaatgcggaaaatgctagaatgacttgcgttgtgaaacggagtccatattatttaaccggacagagtatttcattccggcagacacatttatccaacctgaaccgcccatgtttccatcgagggagcagtgaacctttccccggagcgcgcgaggcgaatcgcgaattcgacatttcgaggtacacacagctccctcctcccttccatctctccatgcatcgatcccctcccctagaatgttcttcacggatcaatctctcctcgagtgtgctttgctgtgttacgatctcaaatcttgcttggagttgtgctgtggattcatggcttcttgattcttttggtcttgtgcagttcccacgcgctccacctgttcgacgaaacgcctgcccgagcggtttcgaggtacggcttccaactcttcttgcatcgatcctccttctctggatgttcttccctgaccaatcaatttcttctcgagcgtcgtttcttgtgctacgatctcgattcttgtgctgggagttgagctgcgggttgttgggttcttgattcttggttttcctctctcgtgcagtttctacgcgcgcgacctgttcgacgaaacgcctctgcgcgcgtgctcggccgccatggaggggtcgcctagcaagaggaggggggtcacggccccagcgcacactgacgacggggactggttcagcgacgtcccggacgacgtcatcctcaacatcatgtctttcctgaccacgcgccaggctgtgcagacgtgcgtgctgtcgcggcggtggctcaacctctggcgctccgtgccctgcatcaacgccgacgtcggcgagttccagcggagcgacactgagtgggaagagtatgatcaagagagggagtcggcattcaagatgttcatggatagggtgctggagctccgcaacccggccgccccgatacgcacgttccggttcaggtgctgcagattggacggattcgaaggcacctcggacgaggcagatatgaacagatggattacccacgctatgcagaagcagccctgggttctggatattctcgtgctgtatgacgcattgaagctcgatcactctgcgtttacctgccgctacctcacaagaatcaagttcatcaatgttcttatgatgccaggtttcttccagcaactcgagatgggttgtccagtattggaaaatctctttttagatgaatccatcgttgcggatgttgagatctcctccaggacactgaaggttttgaccatcaagagcactcagttctcctataagttcaggactactatttcgaccccgagtgttacttatctgaagttgtggaggcctgtgaacggcatatatgtgttcaacgacatgccattactagtgacttcaattctagtactttatgatgtacaagactctagtgatttctgccaaaatctcaggagcctttctgctgctaaaagattggagttcgattattttgggaggaaggtatggttattggtctcacacatccccctttccttattacatccatgcatctcaatgtagttgtcgatatgaaaaaggaaaaactcaagcatggtgtttcttattgacacttcacaatagcaccggcaaaactaagcgttgcataactaattcttatgcgtgaaatcatgatgtgttgtaaggatgactgatgacatcaatcatcaatgcaatctagctatttcgtgtagtcagttcatttgtatataaatcaagctgttggggtcaagcagacatgaactatctaagttggctattcaatttcacaatgaaactggagcatttcccatttggtaactcgacatgttcttgttcgctgtaatattgggttgtcaactgaagattcatattcatattttgagaaatctgagtgtttgtctaatttcagttgtcattactgcacataaatttgaaaatcaagacaacctcaaagtcaacatacaaatggaaatgtctccgcaattgttgaaagtcttgcaatagttttttgtgttgtgtttagactggcgtagctacttaaattgcatcaaaagcatcctgacaattaaatcgcatgtgctattatggtcttttatcgcataatgttagtgcgctggattgtgttttcatgttttgttggaaattttgtctataacatggcaagggttttctgttgcaacataatcatttcagtatcgtgcagctgacaatggaaaacaatttgcaattgtacccaaaattcaacaatcttgtcagcctgactcttggtcaatggtgtttggatgcgaacttctatggattggttgtcttccttcagaacgcaccaaaactggagaagctaactctggaacttgaaaaggtaaatcgtttcatccatatgtatactgacccttctcgagagatctttcacaaacacacatgtcaatcagggatgtagcttatttgttttctttctataatatcatcagaatacgccggaaagaatcattggcaagcttgaagatagatcatttacatgtgagcaccttacccgcgtcgaagttgtatgctcggagggtgatcccctggtcaaagatgtggtcaacttctttgttaatagtggactgacctctgctcaggttcagatcatacgctggtgctagatcgagtatgcgtgacctgcaattttctggtctgaggagatatgaaacgtcaaaaaggatcaagcattctctgaacattccattcaaaaatcgctctcttgcagttacattcgttgattccagttgagtcagaaagcacatagacatgtttactgcttttgtttggtgctatgatgtcagtagaagcaatcatgtattggttcctgtacttgcatccttctgtgatgttctgttgtacagaagatactgcatgtctgcatgtacatgcttgggtactctatttggcctttatgttttactgacatgatgttacactcctatgactctgctggctctatccccttccatgcttctaatgttcacatgagatcttaattttaggtggttctagaaataatgaacatggttatatatcaacgagctgcaacaatttttatatcagtggaaaacaagaaacatcacaaaactgttattttttttaatgcagttatatctttgttatgaaaatgaaaactgtcacactcgcacacattgttatggaatctgctgcgtcacacgttgtattctttgaaagaaaatgtcgcaaactgtcgtagcaagctgataagattttcagcgaagctgtcatagcaaacggcggagccatgaatttttgtcatgtggggccgactattaatacttcacattttaatgggatcatttatgcaaatcttaatggatttacacatgaaaattttaagactctcaagggtgtttgtgaaatagttgtggggccagccgaccatatagctaataggttggctcaaacactagttataaggggcttgagttaccatgcttgcttcaaaactctatgtaaatcttttagaaattatataaaaaaaataaaatatataatttctaacgtgttaaatcagccctaggcccgcaaatattttggttctgccgctgactgatcgtagcattgttgtagttagtaggtggtgagagagacataagacctgtttgtggagattaagattttgatatacagctggtgagaatctagagaagctatgaaacccaacctagattttgacttttagttcattttctagattccataactacaaattctcaaaatttggataaaaatctaaactgtttgagaaagcttctagcagctaaagattttagggaaaatgcaatttccataagcttctccaaattgacccatagtgatctacaaatgcctatgggatgacaccatatatatgttgcaggcgtgatggtccaacgatgggacgtttcaccattagcataaatattgtttcttataggagtacagtatccattcctcttatagtcacaaaataatgttgttctagacttttgaaagttttttttttgccgggttgacaaaggattagccggccaaatttcatcgatattttgaggagaaactgttaaaaatttaaccacgacagtatacccaaaactacctgagacaagcaagaaagaaagaactaaagtgttggttgtcggtccaaagggaaatctcctccattttctgttaatctgaaccatccatcttccatcagagggactaaagtaaaaccgcaaatacacccagcgtcccaacaaaaacaagcagtcaatcgagcgcttgagacgccaacaccattcgcgatttcgaggtacacctcccatcaccttcaactccatctcttctcgcatctttcttctatcgatgttcttcacggattcaatcttcaatctctgctcgagcgccgcggtctcaaatctttgctcacggttgagccgcggattcatggcttcttgattctttgattttgtttttcctctactgtgcagtttccacgcacgccacctgttcgacgaaacgcctctgggcgtgcgcgtgtgctcacgggctcacggccatggctccggcgcacgccgatggcaaggactggttcagcgcgctccccgacgacatcgtcctccacatcatgaccttcctgaccacgcgccaggccgtgcggacgtgcgtgctgtcgcggtggcgcaacctctgacgcaccgtgccctgcatcaacatccacatccatgagtttgggcggaacgaaaccggctttatcaagtatgatcaaaagatggagttgtcgttcaacagtttccttgacaaagtgctgaagctacgcgaccccgccgcgtcgatacgcaccttctgcttcaagttctacagattgaccagaatcgaaggtgcctcggcctcggaactcggaagatatgagcagatggattagccacgctttgcagaagcatatgcccgagttctggacattgttgtgttgtctggtaaactggagctaaaccactattctgcgtttgcttgccgcttcctcacagcaatcaacttcgttagtgttgctatgaagcaaggtttcttcaagcaactcgagaaaggctgcccatcgttggaaaatctctccttagatgaatgcatcattgtggatagtgacacatctcctctcagacactgaaggttttgagcatcattgatacttggttcccctggaagtacaagactactatttctaccccgagtgttaccattttttccttgtggtggctttgagcggcacaattgtgttcaataacatgccattactagtgaattcattgctggtacttcatgtcgaacaagcctctagtgatttctgccaaaatctcaggagcctttctgctgctaaaaatttgacctgccatttctattatgatgggaaaaaggtattgcaattgatcttagatatatatcccccctgcccttattatatgcatgcatcttaatataggtattgatatgaaaaataataaaacttaagcacgctgtttcttcttgacacttcacaattccactatattagttacctgtaccggcacaactaagcgtggcataaccaattcttatgtcatgaaatcatgactgatgccatcaaccatccaatgcaatctatttcattgtattcagctcatttatacataaataagacttttggtcaagcagacctgaattatcttagttcgctgttagatttcacaatgaaagtggaccatttcccatttggtaactggcatgttcttgtgtggctgcaatattgggttggccactgaaaattcttcttttcagaaatctaagtgattgcttaacttcaattgacattattaaatataaaattgaaaaataagataaatatgcttcagcaattgaaagtcttactcctgctgctacctcactatagattcgcgttgtgtttaaaatttttgacatagcattgtgtttaagctgatgtagctacctaattaacttgcatctgaagcatcttgactgttaatccacacgtgctaaagagattcattgagaccaaacaagtgtagcattgtttattctgattctttgttgacgcaatttctttttctagtggtcttttatgatccgctatgttgaagttatagttgtacctgcaccgcaaatataatacttattgcataatgttagtgctctgaattttgttttcaagtttctaatttaggtaatcatgtttataaatggccttctgcaacatagtcatttcaatattgtgcagctgacaattgaaaacaatttgcaacggtatccaaaattcatcaatcttgtcagcttgactcttggtcaatggtgtctggatgcaaatttctatggattaattgtttttcttcggaactcaccaatactggagaagctaaatctggaacttgaaaaggtaaatctttccctctaaatgtatactgatccaacttgaaagatttttagcaagcacacatgtcatcaggagaatatagcttacctgtttttcttggtatatatagcatcgttggggaaaaacatcacaaagaatgattggcgagcttgaagaaagatcatttacatgtgagcaccttacaagtgttaaagtcaaatgcttggcggatgatcccctggtcaatggcgttgtcaacttttttgttaaaatgggattgaactctgctcaggttcatatcgaacactggagccagccagctctaggatgaaaattcctgtctgagatatgaaaagtaaaaggatcaagcatttgttttttttttatataatggaagctttattgaaactcgatcaattacattcgtttgacattccattttaaagtcgctctctttcggatactagtgatcgtgcacgtgcaaggcacgtataagccaatatcaattaaaccagatatatcctctccaactaatataaatcaaactcgtcatattgcaagagaacatttttattatgcacaaaccatattaatagtggtagtaaaaatatgatataaacttatgatgcttatttcataattaaactccttgtgggtttcataatacattaagggactatatgtcggctattgtaaataaacctgttcaaaacttaaatgttcatgatctaaacagtatatccatcaaatccccgatacttgtgtttatgctatatacaactgtattctcatccacttatcctttcttacataacaacgcacaatacagattacaaagcaattacttgcaaagaactttgctagtgaaaaactggttgaaagagatagtaaacagataagtggaggaacatatagtgcttatgtatatcagatgaaagtaagataaatgtgagaaaatacaacgcacatacatggctataacttcgaatataacctttccatggcacttgcatttcataaagtaacatgagggtatgttgacaagtaactgcattagctatctttttctccctaatcagaatattttggagttacctgccaaatgtagctgaatttgttttaacaaatcgaaatgtagctgccaagcagcaagccaaaaagaggtaccaaaatgtgctgtcgttgttagctagttggatggctgcaagtgggaaaaggtcaaataaaacgcttgtatctcaatttggcaaaagatggactgattaaaaacacacatagacacaattttgcaatagaggcgtgatgtgcctgtatctcaatatagtaagaaaagatcagaatggccaggcagaaggaataattcttagaatgaattaacaacatgcgcttggatagacaataattggcatatggctctatatgagaaaacatcaaacaacagtttccatatttcgtaatttctgtcattcacaaatgaatcgcattacaatataacaagtataacttctaggtacagcaataatatagttaataaaatcatgtaaaaattgccatttatacagtataagcagtagaaatatgaagggccagatcaacgcagaaataattttgctaaataaccatccttgactttcatttgtgatgaacaaccaccttactgtattatatatagctctcttgctagtagtatttcaattagtgtatgtgaagaaaaaaaatcaaatattcaattagtattcatacattggtagaaggtcatgcccagattgttgtttgtgatcacattcttccttttgaagagagtgctcagccaatgtataggattggcctacatgatctgaagtcccctttctaatgcaagtagaaaataattaaggaatgaagctaatgttggtgctgataaaaaagatatggaattgaattctatcaatcatggaaaaagttgaccaataaacaatggcaaaattatggatagtagtgtgtctggcatataccaacattctgttttgcatgggctagaagattcaatgagaacagtgcagataccgtgttcgcaagaacaagacgatagtgcatatatatgagaaaaaaagtgaccataatccctaaccttgacacatgacaataatccctcctttgcatgtgcagttcttcagtgcaaactaaattcaccaaagaaatactcactgttaacaaactgcatctagtagacagtgttgctttccatcatctcgttgtcttgtgctcttaattcctgacaaatcaggaatcaaacaaaaaaaacaaaaatttagatgatggagtgatagtttgaaacaaagagatcaggctcatataatccctggaaaatcaggaatcaaacaaatttagatgatggactgatacagggaattgatggctcatagacaaagaagatgcggtcaagttcatggagctcatccatgaagtcgtgctggcactgacattgaagtcagccaggcctccaaccaatctaatttttgagtaaatacgctgagtatttttctgcaattttttgtagtcttgagaacaatccattggatttttttgtccatgagtgaatgaagccgttacctgcatcggatgcttcttcccggctgcacctcagggcactggcggtggggaaggcacgtgcggggtggagccctagcgctggcggcggtgaggcgcggactggttggagggcaggcaacggcgccggcgccggcagtagagaggcgtagccaccggcggaatttgaggggcaggcgacgacgcccgcggcggcggtagggaggcgcagccaccaggggaagggaggtgtgcccgatggtgccggtggtaggaaggcgcggccaccggtggggtggagggcaggcggcagttttgtcgaagaaaacaatttgcgggcggaagtgcggcgtagtcatcgcggggtcaagaggagatttcacctaacatattcacggatgagattattccaccttgcggatgaatagatgagataagatgaggtgatttggcatgtaggattggaggggtgaacttctcctttttttttatattagtatagacattctttgattccagttgaatccgtaagtatatagacatgtttattactagctttgtgtttttggttagaaaataaattaaaacctagcttctacattcaaaagaatgtacacaaccagtctagcttggtgctatcgtctatgacgtgagtacaaacaatcatgtctttcgttccatttaagggcattcatcttgtacttgctctctgttgtactcaaaccaagacggtactgctctgcgtatacatgtttgctcggggtactctatttggccttcatgttttgctgacgtgatacaatcccattatactggctctacttctttcgttccgtaattgttcacgtgagatatgaattatgtggttttgactgaacatggttatatctatatcattgagctgcaacaattttgatatctgtggcaaacaagaagcatcacaaaactgtcattttttgttcgtactgttatctttcttacgaaaaagcatcatcgcccacattcagctgacaataatttggcctctctaaacgttagcagtctcatatttttttcacttatgcttattcttattagctaaaactaaaatttttatctttaaatttgaagttgattttgggattttcttttccatcgtaatttattttcagcatttgcttttagatcgttaagaccacacatataaaagttttattcacaaattattttttatttgtaaatatgttatttcgttttttcctccaatatgcctaacgatggggctgcagaataaaacaatgctccaatttttgtactggatggacttgctaggcctttcataattttcggttagattttttctacatacagaaaaatatatggtttccatcaaggtattgaagtgcaatttgtatttgagtaattatctgaagagatatgtcattacaataaaagaatttagtaggggaatcattaagctaataagctcccgcgttctaatctttctgaaagaaaaaatctaataaactacatcaaccaaataattataatttcatatacttgaaaaatatcttcaagtcaggccttcgatcttgagcgagcagctgtgaaggctgcctcccaggtcattgaaccttctcctcagctccatgaagagctggatcgccatgacgctgttctgcccggccatgtggcggcgaggcagctgcggcggcagccggagcatccctccgacggcggcgaggccgccgtgcatgtggagcagcgacgccatgtgcttggcgtcgaacacctgggtgccgaagacggcgccgacctgcgccaggaagcccagcctcgtcgccggcagcggcgcgccgccggtggccagcctgaggaggaacgcgacgtcgtacatgccgccgaaggcgacccacgtcacgccacggaggccgaggatgccggaggcggcgagctccgcagcgaacgcgagggcgggcacgccggcgagccgcgcggcctcgaagtcgaacccctgggccctcaagaactgtacggactccggcgcgtggcggtggtagcgggcgtcgaaaccggcaaagtcgaaatcccacatgaactcgacgagggcgccgtcgacggggagacggccgtcggcggcggagagggtgatcccgagctgtagcaggcagagctcgtcggcgttcgccctcaccgccgcgtaccgatcgtcggcggtgacccccgcccctctcgggtgggggtggacgacgccggggaactgggtgtcgacggcgacgaaggggaaggtcggcatcagcgaccggatgagcgacatctcacggtggaggttcaccgccgtgaccttgcgggtgtgcacggcccgcgccggtggctgcgtgtagaacaacgattgctccatcatcctcggttgcgacgacgccatagacgaggacgacgaggcggccatggacgaacaccttgcttgcgttgtgtgtcgcactgtcgatcacgtggtgaggtgaggcgagcccggtgcgaaatatatagggagaacgctgagttctagtcggattaattagagtcgcattaattaatgagttctagtcggattagcgatgtattagtacgtctagtcggagggaggcaggcttctttattaaatgtttcttatagtcaccaccgttgatcaaatataaatgaaatgaagccattgtttagttctaaattttttcttcaaacttttaatttttccatcacatcaacacttttctatacacataaacttttaacttttccatcgcatcgttccaatttcaaccaaacttacaattttaaggtgaaacacacccgaagtactagttcgtttgtcccaccgaaaacgccgggatagaagcgacgccgtcgcgggcgccgctcaccctcgccggctcaccgccgttgcccggcccgcactgagcgcaaagctgaaggctccgtttggatcgtcgccggcggccggcaaaaccctagcgcatgcggatgcggctgcacgctcgagagtcaacaagtgtccggatcgaaaaccagatggattgcatataccattgacgtctacacatctgtatctctcaacggttggttatgtaaaaagtctttctacgtcttgatatgcaggtaatgtgtcttgttgttggtctgattactatgcaaaccacttcactagattattcgattcttttatccttcctccgtttcatattataagactttctagcattatgagtttaaaacacaatgctagaaagtcttataatccgaaacaggggtagaatatgattgcttcgtccttgatcatatatagctttaaatagatgatgcagatatatattatttacattggaccagtttaatctgaaaataatggattattattaatataacaggcagatatagattatttacattggaccagtttgctaggaaagttattacgtaatatggagtagtacttacatggcagaggcctcgattaatacattaagggaatgtttgcttgatgtctaaccttgccataactaagtttaggctagttgaggcatggtggcataagtgtggtttaaaaatggtttaaaaaaaagtgtggcttaaaaatagttggctacaagtgtggcatgcttagctccaactttgagagtatgacatgcttagctccaactttaagagtatgacatgtgggtctaaggctaagaaagtgtgttatgacacaattgcgatagcgaaacaaacacatacctaaaaaattgtgcataaaagtgtggcgtagcaatatgtggcaaccaaccaaacaacccctactatatagatcttcatactcattgaattgattgaattgcatatgtgcttcctatttgcaggtatagcagatgaaaacatgattattgttcttgtgtatgtgggtagaagaatccaatatggagctatgggtgcagaatatagtattcctctaaaaataacacttccagcatatgacactaccacattcaaagatatgagaaatgagatctttcggggacttggatatgatgaggaactgtactcaataagtatacaagctcggtttgattttgaagcccccggaccacattatttctagataattttaatttatgattttgggacgctgagcttaacatagtccgcctaggacaaacggaggaaatagtaaataaaaacatatatttagaaaactaggaagaaggacgctctggctgatagcgtcctaggcggactctgttaagctcaacgtcccaaaatacaaagtcaaaatgttttaagtttgaccaattatatagaaaaaatagtaatatttttgactcaagataaatttatcataaaaatatatttaattattaatttaataaaactagtttgataatgtaaatattatacgtattataacctaaaacggagggagtacttatttaatttcacggtaaataattattatatataaaaatttcgcttgaaaatgtttattttaaaaatcagaaactaaaaaagttcaaattgtttttcataaaaatccccaatcttcttctccattccaatggtggcacactaccaatgcgaggaccaccggatcctctcgtcgccggtggtgtccaccgtcgccgctcagtccaggttaaaggaagcaaacaaaccactcgtcccgtagtgcactcgagagaagacgcgagcaccattggaggtatggctcccctcttttcaccaaacgtttcttgaatcattccgctgatcaatttgtatttcttgtgctaagatcatgaatctttttttttagaaaacaggtcaaatacccggctttttactgaaagccaacgtaggctaagatcatgaatcttgcttggagttgagctaggattcatggtttactgatttttggtctctgccacgtgcaacagcagcataggcgggtgaaattagaaatgtgtagatcaccatcaccacaaggagggtgtcttaaagtagtatataattaagtatacgtatatatttccaagacattgatttcaatgcacacgaaatccaaccattttcaacaaatcatgtgtgtttagaagcaatttaaaattcaacatgtgtcaaaggactgtctaatctccgcttgacagaaaaagaaaaccctaatatgttgcaaattttgggtcgtttgattgctttaagattcgagcaaatctcccaaccctaatttccatcacctctttttctttcctcttttttattccatccccgccgccgcacaagccccccattctcaacttctcctcgtgactatgctcctgtgctgccgccgacccacaacgctgccgcccggcctcatcggcttgacgaaaagcggcgacggcaccagcgaggtcctctctctcgccggcctcctccccctccactctcctcctccacccttctctttctcctcaagccgatggtggtgaggtggtcccgccttgctatcttccccatctcctgtggtctctagtctctggatctaccaccaccaccaaccggcacctcgtagctcgcttgtatccaccacccaccaccgggccatcaccttctagatatatccatctaagcccgacaatacccgccctcttccctcaccctactctcatctcccacaccaaccttagaccctaaaccctaacttgttggattgtggtcgatcgttggatcttcgctggagttggaggagaaagggtcaccagatctagagaagaaggacatggggtcaaagtcgccggatcacaaataacaaagcaaatcttaaggtttgaaatttgcaagttttttttccctaattttctgtcaaataaacatttgtttttttaggtaaatgtcaaataaacatttagcaattagaaatgagatgactactaaaaaggaatcttttcttcttcatatgtgttggcgaacggcttcgtcagactctcgcggcgcgctccacgcgcacgacgcgcaccccgcgcacgacgcgcagcgctcctcgctccgctcgcaccgctgcacgtcccttagatcaggggattagttaggcccaggcaactcccaagccttgttgtacatgtataaatataagctccattgatcaatgaaagttacggttgatccaaatctccttctacatggtatcagtgaccctctgatcttagtcttccgctacctctcccttgctagccatgtcgcacagctccggcgcttccgacgcctcgtccacctctgacgaagagcctgtgccggcgccttccacctctgttcttcaaaccgtcaacatccgctcccacgtcccggtcgtcctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggcnnnnnnnnnnnnnnnnnnnnnncgtcttcgacgtcgtctacaagccccgcgcctctgccttcaccgtgtggagcgacatcgaaggcgtcttccgcgacaacgccgtccaacggtctgtctaccttgagaccgagttccgctcgatcaatcaaggtgacatgaccatcacgcagtacaccgccaagctgaagcaactcgccgacggcctccgtgacatcaacatgcccgtgtctgagcccagccaggtgctcaacctcctgcgcggcctcaacaccaagttccgctccctccgcgccagcatcgccgaccggaatccgccacacactttcatgaccgcgcgctcctacctgctgctggcggagctccagatgcagcacgacgccaaggctgaagccggggaggccctctacgccggcaccgggtcttcctccggcacctccgacaccaccggccagcctcgtcccaagggacggggcaagcgtcgtggccggggcggcggcgccccacctggcggcgctccttcgactcctggcggcggcgctggtgccgggcacgacggccagcctcgccctcctgcgccttggggctacaacccctggacaggctttgtccaggcctggcctttcccgttccgggctcccggcgcgggtgtgttgggccctcgcccgccgttccaggcccaacaggccatgaccgcgcagcacctgcttccggctcttcctccggcatctccaggagttcactccaccggcgcctgggacaacagtgcgctctacagcgccttgcagtccgccggcgtcgccaccaccactcctccgagcgctgcggattggttcctcgacaccggtgcgtcagcacatatgtcctccacccctggtattcttgctcatccccgtcctcttcctttctcctcttgtatcactgtcggcaatggtgccaagctgcctgtcacgcatacagcttccacccacattcccacatcctccactgatctacaccttcataacgtgcttgtttctcctcccttgattaagaatttgatctctgtgaaaaagctaactcgtgataataatgtctccattgaatttgatccaactggtttctccatcaaggatcttcaaactcaggtggtgaagctccgctgtgacagcccgggtgacctgtaccccctgcgtctgccatcgccacacgccctctctgcgacttcctcgccgtcggtggagcattggcatctgcggctcgggcaccctggctctgcttccctgtccaaggttcttggttcctttgatttccaatgtaataaatcagccccccatcactgttctgcttgtcatgtaggcacgaatgtgcggcttcctttccactcttcatctagtcagactctatttccctttcagttagtgcatacagatgtttggacctctcccatttatagcaattccggttacaagtattatgtggtatttcttgatgattttacacactatatttggacctttcctgttcgcaataaatctgaggtgtttcatactgttcgttccttctttgcttatgcacacacacagttcgggctccccgttttagctctgcaaactgacaatggcaaggaatacgattcttatgcacttcgctcactcctgtctctccacggagctgttcttcgcctctcctgcccctattcctctcaacagaatggcaaggcggaacgtatcctccggacgatcaatgactgcgtgcgcacaatgcttgttcacagcgctgctcctttgtctttttgggctgaagccttgcagacggcgatgcatctgatcaaccgacggccatgccgcgccacgggctccctcaagccgtaccagttgctgctcggcgctcccccgacgtacgatcatcttcgcgtgttcggctgcctctgctaccccaacaccatcgcgacagcgccgcacaagctcagcccgcgatccctggcgtgcgtcttcatcggctacccggctgaccatcgtggttatcgctgctacgacatggtctcccgccgggtgttcacgtcgcgccacgtcacgttcgtcgaggacgtgttccccttccgcgacgcgccatcgcctcgcccgtcagctcctccgccaccggaccacggcgatgacactattgtgctgctgcctgctccagcacagcacgtcgtcacacctgtcggcaccgccccagctcacgacgccgcatcgcctccgtcgcccgcgtcgtccacgcccagcagtgctgctccggcccacgacgtcgcgccgcctccatcacccgagacgtcgtcgccagcgtccgcctctccacctcgacacgccatgacgacgcgtgcgcgggctgggatcagcaaacccaacccgcggtacgccatgactgccacgtcgaccctgtcgccgacaccttcgtctgttcgcgtggcgctccgggatcccaactggcgcgcggcgatgcaggctgagttcgacgccctgctcgcgaacaggacgtggactctggttccccggcctcccggtgctcggatcatcaccggcaagtgggtcttcaagaccaagcttcatgctgacggctcactcgacaagtacaaggcacgttgggtggttcgcgggtttaaccagcgcccgggcgtcgactttggcgagacattctcgcccgtcgtcaaaccagcgaccattcgcaccgtgctgacgctgatttcctccaagcaatggccggcgcatcaactggatgtttcaaacgcgttcctgcacggccatcttcaggaacgtgtcctgtgccagcagcccacaggctttgaggatgctgctcgcccggcggacgtgtgcctcctctcccgttcgctgtacggtcttcgtcaagccccgcgcgcttggttcaagcgcttcgccgatcatgcaaccagcctcggcttcgtccagtcccgcgccgacccctccctgttcgtgctgcgccgtggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccgatgtcctcgaacgtgcaggcatggcgaactgcaaggccgtggccactccggcggacgctaaacccaagctgtcaagcgacgaggggcctctcttccaggactcctcctggtaccgcagcattgccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggaccaaacacatcgagctcgacatccacttcgtcagggagaaggtcgcgctcggtgaactccgcgtcctaccgataccgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcacgacgcgcagcgctcctcgctccgctcgcaccgctgcacgtcccttagatcaggggattagttaggcccaggcaactcccaagccttgttgtacatgtataaatataagctccattgatcaatgaaagttatggttgatccaaatctccttctacaatatgtttattttttgctaaacaaaatgtttaggaagtaaggcggtatacgtacgaacccgtcccgtttgttgtaacaccattcaatccaaggtatggttccctcttttcatccaatctttcttgaatcattcctctctcggtgttcttcacagaccgatctgtatttctgctcgatcgaaaatcgtttcttgcgctaagatcttaaatcttgcttagagttgagctggggtttactgattcttggtctaacgcttactgtgcagctccccacgcgcaccacctgttcgacgaaatgcccctgcgtgctcggccgccaatggaggacgccgccggcagggacaggctcagcgacctccccgatgaaatcctccaccgcatcatgtccttcctgaacgcgcgccaggccgtgcagacgtgcgtgctgtcgcggcggtggcgcaacctctggcacaccgtgccgtgcatcaacgccgacttcgttgagtttgattccatcggataccaagggcccgtggtgccgttcaagaggtttgttaaccggctgctggagttccgtgatcctgcctccgtgatagacacattcttgctcaaatacgccatgccggacagattggatggatacaaggcttctaatgaagaagctaacaggtggattggccatgctttgcagaagcaggccaggattctagaggttgccgtgttcttcttcccattggatcttgatcactcagtgtttacttcattctacctgagaagaattgagttctcccatgtgtacttacgcaaaggtttcttcgagcaaattgagacgggctgtccattactggaagatctcttattacatcaatgcttcatttgggatggtgagatctcctcccagacactgaaggttttgaccgtcgatgcaactgaattatacacggtgaaggagatgtctatttctactccaaatcttacttctctgaccttgtctggtcttgagtatcccaaagctgtactaaaggacatgccattactagtgactgcatcagtatcggttacatttgatgcattaaacttcgacggttattatgatgctaatgacctccgccagtatctctggggcctttctgctgttagaaatctggagttccattatgagggtgcagaggtatgcttattgctaataattacatagtataccaatgcatgtttatttaggtaccaatgtgaaaactgaaacttaagaatgctggttcttcttgacacttcattattgctatactttaactacctgtacctgcagaactaccgttcatagctaattcttatgccgtgaaataattatgtatcgacaagataactgatgttaatgttatcaaccacaaggcaatacaattcatgtactctggtcattttttgaacataaatcgacccactgtcttgaaagtttattagttggtagtttgatctcgaaaggaaactagatcatttctcatgcaaggactcaaatgttctagtctgggtgcaatatcagggttgccaaccaaatatgcatcttctccgatatctggttgattgtttaagttgaaatcagtacaaataatcttatcttactttttgaaagaggggattgggggtgattgtaggttgtacactcaccccgagtccagacattttgtagctgcaaacatgcatgttgttttgtaagatgtttatagagaaaattttcatttgtgcccggcgaatatatttcatttgtataggtgatcatttggtcttgtatattcatgcatattttagatttcaggattaattgtttattgcatttatattttatagtatagttaattgggatgtgttacaatgcacggacactatgctagcattaatttgaaaattaagagacattccaaggcaatgtacaaacagaaaattaagagacattagtgctcttagttgggcaagtttggtgattatggaagtgtataatcatttaaatcttttgcagctgatgattgcaaacaattcgcaatggtgtccggaatttgtcgatgttgtcaacctgactcttggtgaatggtgcctggatgcaaacttccatgcactaattgtattccttcagaactcaccgaggctagtgaagctaactctgaaactcgcgaaggtaactgctttcctccaaatgtatattgttcctgcttgaaagatttttcacaagcacgcatatcatcaagaataaagctttacctgttttgtttgctataggatcgttggacaacaccacaaagaatcattggtgagcttgaagaaagatcatttacatgtgagcaccttaagattgttgaagtgatatgcttggagaatgatccccaggtcatcggtgttgaagatttctttgttcgtagtggtatgacatccgttcagtttcatatcaaacactggagaaaagacgaggagtataagttacctgcttttattcaatactaactgagtgcccatgcgttgcaacggaaacatttttctagttctatacaaacaagagatatgtcaccttttaatagtttcatggttcatactgcatttttttctcatggtgctaaaagtttagtacccagagaaaaataacaatattttgtgctatattcagcttgacacatgtatggttcattcatttcatctgcaattagataataccataaaaaacatatatgtttttcatgacagtgacaagaatgaatgatgagagtcaaggttgatttttttttaatcttaatcgacaattgatctgcgcggcagctacaattcaaatttaatactgccaaactgactgagcctaagcatgattgttgtccagatcattgttcgaattgcagtctcatgtagaacaccgaaccttctagccctttatagttttttttttgtgtagactggtttctaaaattgttttagacgggtgccctttatatttttcgcaagcataattgtactcctgatggcattttacactaaaaaactattcagaccaaataaatgttgacctggtttaatttagagagaaacaaagaatcaactgtgaaattactcgctagacatgatgacatgaaaatatataatattcaggatgaggtatgacaatgtgatttatcaggtccttgctatccataattatatcattaaaaggataataaaacaagcacaatatattcatacaattcactgctgaaaaagaagtgaaaattagttcctatttcttccaatggagacaattatccactgcatactacacttagtacactggaaagcccatctttcggactaaagagaagacaagatcattagagagtaaacagagaagccaaaaacaaatacacagtccttttagacagtaaacaaagaggacaaaaacaaatacacttggtgactgctaccactcgatcctcttccttgctaactcgttattcggcagcacaaaacatatttgtgatcaaagagaagttcagagaacatatataaaataactcgacctgtgagggtaagacaacctggacattttgcatagaagaaaaccttctcatgtaggtcgacaaaaccctgaacccctatcccacccttacacagtggtactgtaacccatatgagaacaaccaacggccttggctgggccttagacgtatactttggcgtgggacaaacgagggggttttgtaagttgtaaccccagcttgaaatttgttcctacggggagtcgaacccaggaaatgaggagtgctactagagccacctaaccaactcaggtagaggcccgcacatgattatttataaagatataatattatgtttgagttcaacacgcattgaagaatacgttaaacgtcagttgaaattgcagttcaatataatcttggtggttttgttcctgctcccaataattatttataaagatataatgtttttgtttgagtttcaacacatattgaagaatatgttagttgtaattgcggttcaatataatcttggtggttttgttcccgctcccaataaaattaattatccccccccccccacccccctttccccggtcacggaaaattatagaatctactagtgatgccactattgtggaatcaagatcttgattctttcagtgacaattcaaaaatagttgaaatgcgtcatgtgtaattttggatgatcatattaatttctagagtaaatttcactacaaatattttgaccaaactatcataaaactacaaatttaaagtgttatatcataaagttacatatttaacaccaattttatcacaaagctacagatttttaacgctaagtattgcaaaaccacatatttaataataaatttgtcgcaaaaactatacattttatgtttaaatccttagcccaatgttatgtttgagctagaaacatctaaattaaattggtgctaaacttctagttttattataattttattactataacatcctgaaaatccctaataataaaaatcactaaaatttcgaactttttaaaacttttgcatcatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattttatgttaaatacttgaaccatgtcgacaagtgtcatgacatctaagtaaccacgaagtagtcgccactacaatgattttatatatataggagtgttccactagaataattaaattaatatttataactttcatcgagtctctcatgggatggattcactcatgtaaaataatttgtcatgcaaataaattgaactttatacataaaatatgtttatgtgagtgtttaattaaacatttaggtcaatattgtaccaagtatcaatttacttttatggaataatagattaaacatgtccttgtaaaatacattgttatacaaataaactcgaccaatgtgctattgtattattaaggtcacattagaatatttaattagtttttaagaaatatcaaagcttataggttatattggataatttttggataatttaatggaaagcaaattcatttgggaactaatgaataaccaaataaatattcaaatcaaacatttgaattctcaaaaccaaaatatattgattacatttcaattcaaattcaatcccattcacttttgcaaattagcccctccctttccttcctttccctttttcttccttttctctcttttctcagctgccactattcactgtccgccaaccgttcgatcccgtctaccgcgtgcaccacatcgcttccggccacgccagtcacgcccgtgccgcaccgcaaccgcgcctccttcccctcagccacgtccgaccccaaccctagccgcaccgcacttgctgctccgcaaccgcatcgcgttgtatcgcgccgtgcgtcgcatcgtgccggacccacgcccgcgccagcgtcgtcccttccgtgccgcgtcgtgccagggcccgcgccacgccaagccgcacctctaaccgctctcctggattctctccaggaaacacggagctgcgccatcgcccatgtacgcgcgtcgccgtcgccacgcctgccttcatcacccagacacgtgcgtcccatcgcccccatccacgcccaatggataaaacggagccctctcctccagctagcgcccagacctgcagtctataggttatatgtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatacctctcagccttcttctcgtatgcatttcatcgaacaccttgcgatcaccctctcaccaccgctagagatcaccattgtgaggctccccggccggagctggaggttggacggagtggaggaagagccgtgctgccgccgtcgccatgggggaagccgggtagccgctggacatccagaaacgccgtcgagcaccttacgtcgccgccgtctgcccctgtcctgcaccgcgtcgagctccacttcgccgcgtttcgccatctcgccgtctcgcggtacaccctcgcgcctgtagcgtcctccatacatctaattgctagcgccggctccaaaatcggcgattagcgcccatggccgtgccgccccggccgccgtttcgtcgccggcgagctctccgtgggtaggctatcccgggagctcccctctccatatagttcgtgaaatcgaatccccataccccgtagatgctcccgcacccttcaattcggccggaggatgtccctagcaccgaagccccttgtagccgagctcgggcatggcgtcgcctgatggcgccgcgcgcccccgtctcctcgcgcgccggctgccattggcgggagattgccggagctcctccgcgcctcaccccggccgtcgccgagccgcccgccgccgtcccggctcgggccggccacgccgactgcgccgagccgcgcctctgcatcgctcggtaacgggcgagaggaagaagaagatgaggagagagagaaaccgtgtgggacccacatgtgattagcgcacagtaatcctatccctaacggtgattatcccactcaatggcaggtggggtccctatagttaaaatctaagaaaacacaattatatattttgttcctatgacaggcgggacccaatggtaattaaacaagcaagtttgaccctaagtcaaccatgccggtcccacatgtcaaccacactgggttttggataatgtttccgattaaaaataaatcatttatgaacagtgcatttttacaatttctcggattaactcaaatttgaatctttaaattagtataacttattcattttagctccgattcgagtgaaacttgaacctaaattcatctaaattcataagctttccaatggtatataactcattatttaataaaatatattaatatcaaatgattagattatggtcaacttaaaaatgtgctaataaataaaattgatattgtacagtagagtagatgtcaaataaatatatttaacatgttttgtcactgtagcaaccacataatctaagtataagtgatgtctcaaatgaatggatgtataggaaaatactagtgcttatttaatattcgatggccatataattaaattcatgacttaaaaattagttacataaagtttagcttcatattttgtaactaaaatattaatactcatagataaatctttaacttgtttatgagaaataataacagagctgggtgtgatgaaatcaatcgaatgatagatttaaccagtgcaatatcctatatagtagtatatttataatttggttgacacctattatttaacatattatttaacagaacaataaataactcatgttcggtaaataatccaattaacatattattggacttgcatgtacagtacatccatttaacacatacacagtaagtcaatcacctactgttgcacctattaaactatgaattgtttgataaacatcaaagttagataaaaacactaattataaatctagacctcgttacgaggccacgtagacaaataatctgtacctataacctcacagatctatatagagcatggatgattattaacccttttataatttataatgacaagtaaaatatgatcgtgattaaaataatgccccattggtaaaataataatataaatgattcactgtaattatttgattgatcctaaatctatccaacaacggaacctctagtatatgaccattttatttagatagatgcatgtgtagacataatccttccatagccattagctagactaaaccaccatgacatcagaaagactaagaaaccttagctcttagcttgattagaatccattagcaaacgcaagtagtatgagcaaccctaggttcgacctcaacaattatattttgtttgcgcacattggattgttgtttgaacattgatttttctcgcgtattatagtattggtgtatcgattagtcgtgaggcaacgtatgcagcttccaggaggtgaacgttgatcaatattatatcaagaataagaactatcctaagcaggcaagtcatcaccccattccctgagcatgttgatcccaattgtgaaattgttttgtttacaaataaaattgcatgcagtgatgaatatcctacttgttgttatgccatgcctttgattattgcttatctcattattcccctgtacccataattatgtatgagtccctagtcacttatgacaaatgcttagtaatgctaatttagattcatgcattctcatatttatcaaatgctttatgcttgggaaactaccttggggaggtagttgagatacggcatgtggagacatgagtgccacattgccatgacattgatgagatgatttgtgaaagaaaatgaaaactgaacaaatgttttcgactagggcggctggaggacttgggtggtgtccggaaaaggctagtgccgtccctggttagttaaggaccgagccatgaagctaagcatgaaacgacccccgtacaaccgtacttctcgtatgggtatagacctagcagagtaaatagccgagcggaggtagtatccctgcatagtggttttcttgatgtgtgtgaggcagggcgtacggtggggcagccattggtaggaccacgaggggcaggtgcctacagtggtgtcgccatcggtaggactgccatatgtaaacctaaacttaactataacttaatgcatgtgtgagtcttcccttcccgggagagccagaactcctctcactgctagaaaccttggacgcctagagtgcatgaggactaaagttcatggagcgggtactgccaaagtgaggttattgaaaggctttgccatgacgcgtctcatgtgttgggatgaggctcatgtgttgggcagtcacggagtatgggtaaagtgtacttccactgcagtgtgagtaaaccaatctattcgaatagccgtgctcacggttattgagcaccgggacatgtattacacttggctagactctaaattcttaaaatgatgggtgggatgttgcatgatgattttgtactggtggaacaacttctcgagaggcgagaagaggtagaccccagaaaccatgacgactagtggcgggaagctatccttgggaacacaatggatggtggacagaaccgtcgctgtttaatgaacaatggaattaaaacttgaccagtttatgctaggtcttaggtttgtgaaatgatatttgaaaactcagctttacgcaaagtaaccataaccactccttgtattatcctgtacattactgcatttttttgtggtggcttgctgagtacttttgtactcattgttgctctatatatatcttttagcagagtgttgaagagaagcccttgttagtacgcttgcgtacctaacaagatgatcggagtgtggttccattctaggtctcgttcccagtcgactgcttgtggcatgttaaccgggcccttgtattattttgtctttcgctgttgttctctgatagttatcggcctgcctggccctaatgtaagcatataactcttttagcctgaattcattcgtgatatgttgtgattcggctgtgtgtaccaactactgatccagggattggtactgataaacacagaagatttccgatttccaaaatcggggatcgacaattactaaatctaaatctatagttatgtaatacttcactttaaattagtagtcacgtgataaatttaatattaaacatgtagttttattatatatcatcttgaataaatatatagtcttgtaatagtttgatcataggtttattattttactcaaattttcaaaatgttaaaaaataagttccaacctaattgcataacttcatatcaaatcgctaaaagcaaaaaggaacacatggtatttgagcaagtactataaaatttctaaatactagtcataagataccaatcaagcttaaatggtaatatggaggagaggagagaagaaagaaatgagagtgaaatagagaagttaattggtgacaaatgcgttgaggttagtgtaatagaggtaatatattgtataggttatttttaaatttatgagaagatgacgtggataaaacttgcttgaaccaacttggggatggtgttttcaagcaggaatcctatctcgcgcagatgcgcgagcaaactaactcggatctactaggctcaccctaccctacactgcagttgttagcattttttttctctttttcgagtgatttcctctccttccgtcgttttcccgtgcaactttttgtctctcgtgattttttttctttttctcgcgcaattttttccttttttttttgcaagattattttttcccgtgtgctatcaggctaagtttcaacttcattttattttgaaaatttttgactcaaaatttaaaaacttctaacataaaattgaaaagttctaactcaaatttagaaattttcaactgaaaatttgaaaatttcgattaagatttgaaaactttcaactaagatttgaaactttcaatttaagatttgaaaaaattcaactcaaaattgaaaacttgcaaatcaaaatttgaaaactttcaaatctaatttgaaaactttaaagttaaaaattcaaaactttcaaatcaaatttgaaaactttcaactcaaaattttaaaaaaccatatccatttttttaaactttcaagtccaaatttaaaactctcagttcatcttttaaaattttaattcaaccagtctgttcgttattttgctataaataatcacgcttatgctaatctaatcgcgtttagcgctaagcgaggggaggggcgcgtctgcgtgtggcatggcgccgtgcgcgcgagttactgtagcagcgcggatgcgcgagttacgagagaagcggaaaactgaaaacgcgcgagatctcgcgtattactccttgtcacggacagtttgagagcgggaggcctcctcccaatctccccccttccccttccatagttccatggtggcgctcttcagacgcgagcgcgaggagcaccgggtccgcttgccggtggccggcctgactcgttagccgccgtcccgtccggggcgaaaggaagcatacctcgctcactccatttggaggtaatggcttcacccaatctttcttgaatcaccattcctctctggatggatgttcttcaccaaacaatgctgtattgccgctcaatgtagcatcgtttcttgcgctaagatcttgaatcttgcttggagttgagagctggggattcatggtttattgttccgttactgtgcagcttcccccatccgcacgcgcaccagctgttcgacgaaatgccaccgcgcgctctgcccccagtggaggacgacgccggcagggactggctcggtgacctccccgaggaggtcctccaccacatcatgtccttcctagacgcgcgccaggccgtgcgaacctgtgtgctgtcgcggcggtggcgcaacctctggcgtaccgtgccttgcatcaacgctgacttcgatgagtttgatctcgtcttttaccaaggggacgacgaggactatgatgacgtgctggcgttcaaaaggtttgttaaccgtctgctggagctccgcgatcccaccgccatgatagacaccttctggcttaggtacaccaccagaccagaaggaaacacgaattccaatgaagatgcctacgggtggattagccacgctttgcagaagcaggcccgggttttagaggttgtcgtgttctgctgcttatttgagctggaccactcggtgtttacttcctgctacctgagaagaattgcgttctccggtattgttttatgcaagggtttcttcgcacaacttgaagctggctgtccagcattggaagatctcttcttacatcaatgcggcgttcacgatgacgaaatctcctcccatacactgaaggttttgaccttcgatagtgtttttttctacatgccgatggacactgttgaattcaccttgctgaacaagacatctatttctcttccaagtgttacttctctgaccatatctactcccgagggtttcacacctatactaaaggacacggcatcagtagtgactgcatcagtatcagtatcagttacaatgtctagttttagatttcgttttgatgctaatgatctcggccagtatctccagagcctttccggtattacaaatttagagttcaactatcagggttcaaaggtatgcatatttctattacatagtatgcatctttatttaggtgtcaatttgaaaaacttaaagttaagcatggtgttgtttcttcttgctacttcataattgcaattgtttaattacctgtacctgcaaaacttatgggcattgtttggataatgggatagggaaatgatttcccaactatcaaaaggtatctttaaatcctaaccatttattctccctcttccatttaatcctaacccttcattcatttcctaatcccaatcccacccttcatttcccattatccaaacacacccatgattcaagtgatcattttgtcgtgaaatcatgatgtgttgatacgatgaccactgatgttatcaaccactcaatgcaatatagttcatccactccagccattttttgtacacaaatcaatccgttgaacacttgtcctgctgtttctttgttggtagttttatctcaaaatgaaactggatcatttctcatgtgaggactagaatgttctagtctggatgcaatatcagggctgccaaccaaatgtgcatcttgtttgacatctgactgattattttagttgacatcagttcacatcttaccttactttttgaaagagggggttagcggtgagctggtgattgtaggttctagacccaaccctagtccagatttttcttggctgcagacatgtatgcattttatttctaagatatttatagaaaacaatattgcaattgcatatgcggccatttggtattgtgtaatcatgcatgaaatcgttggtttccggattaattatttattgcattttatattttagacagtatgttgaattgggatatgatgcaacgcacagacattatgcatttatgctacataaatttgaaaattaagagacattcgaaggcaatatgcaaacagaaagtgcttcaggattagttgaaaatctcacttctagtgcttcatcatgaaatatttgtactgttctttttactagtttttgttacatgacttgcatggaaagtatcctagcagtaagttaacatgcctgagactcgcattgaaaatatgaacatgtataatattgtttagtctggtcttttgttgacataatttcagtttctcctgtggtcttttaccatccgttatcctaaagttgaagctattatacatgcactccaaatagaattctttatcacatattgttaatgctctcaatttagttgccatattttctgattatattcatttgaatctttcgaagttgacaatcgaaaaccatttgcaatggtgcccggaattcctcaatgttgtcaacctgactcttggtcaatggtgcctggattcaaacttctatgccctaattgtcttccttcagaactcacctagactacagaagctaactctgaaactcgaaaaggtaaatgctttcgtccaaatgtgcactgatcctacttgattgctttttacacaagagttttcacatcgggatatagatcacctgtttttgttgctgtagagtaatatgagaataagtcgaagaatcattggcgagcttacggaaatatcgtttacatgcgagcaccttaatactgttgaagtgatatgctcggagaatgatccccaggtcatcactgtgcaagatttctttgttagcagtggcatgacctctgttcagtttcatatcaaacactggagcccgtacgcgaatgacctaccggcatttattcggtcgatatgaaatggcaaaggatcacgaattagtttgccatcccattgaagaaaatcactctctttcgcctgtcggctacatctgctggttacagtagagtgttcagtgatcttgtttggtgctttctgctatgacgtgaaggtgagtagaaacaattgcatcttgccttgcatgtaaggtcagtggtattgtacttgtttgctgcgatcacatgatgatttgtagcaataatgatgctccaagaaaaatactgtatggctatggcgtctcctgatacagcctgccactgctttctcaacttggctggtctccggtgaaacgtattgtatttgtctctctcctaatataatcccatgttatagtgttgtatttgtgtttgtattaacaactgattcgaacggccaaacagattgatagctgttagattaatatcgattggcgttatatattaatagaagtttaagtatacatctaaagcctaaaagaaaggtaaaaactgcatatatatacttgcacgtcaggccttcctggcaataatctcgcaatgagcttagagaagtagtacaaccaggcaattccagatctgttccttgtagaacagactttcttgccatttataaactactccccagaatgaccagtgacgaggaaatccaacacaaattgtgtagccgaatttctagcaaaaaccgttgaaaaaaattcatcgtttagcaaagtgttttcataagatcatacttcctccgtttctccgtttcatattataaaaaaaaaattcatcgtttggcaaagtgtgctacgatcttgctgatttgatgtgaggagagtgattttgtgcatgtatatatagccacaaataagcttgagtaacagaagtaggctgatcagcttggacaaacgaaagcaattcatctttcagacccaaaataaagtgattaattagaactaaaccacaaagcaggggatcatacagtcgagtcgaatttgatagaccaactcattgaatttagagcggtattcattcacagtaccagtttgggtcaacaacaacaattcatccatcttaacactgcgcaaatacacatcaaattcaccagaggttgttgatttttatataggcaagtcatgccaccccacctcaagtttccacgcctggtaccaattagcagcttacccaattaaatttagtgcagccgcagagaccataaaaccctcagtaatttaatagaaggagaaatacgtcttacaattatcaatccacatacgaaccccggtaccatcaaacataggaaaaatccattttagtagtccagtggtgatgccccaagtcagccgtatgcgaaacatccaattgaggatcatgatgagatacctgacgttggggtgtacgaggtggcggcgacggtagaggtggtggaggctgtgaggaagaagccgccgatgtcgagtctggagtcggtaagatcagtttgctgacgcggagtggatggggatggtggagacgcaaccactgcggccttcaaggcgcgagctacttgcgtctactcttgctgcacttggccgagggaagtcatggagcaatcaaccttggtctgcacgtgatcctagcgctcgccctactgcgctaacttgaggttgatctacgcgaggtgcttggtgatgtcgtccacgccgtggaccttggccgcaacagctttcatgtcgtccatcaagcgctcctccatggactccatcgcggcaaccacttctacattacctagatacgacgatacggatacggatacacgatacggcgatacgccatcttcccaaaaacaaggatacagggatacgcgtatatatatatatatataaattaaaaatacaaaaaaaattgaagagtaaactagaccattagcagaacagagcatgccattgtcaatatcatgccaccaaccatcatattccagtatcttaccaaagtaagaacaatataaggctaaaccagtgcatatataagtgcaggattacaaatagtacacgaatcataaattaatagttcatcgacatacatagtttcacacatcacatcacagccagttcacagagatagtagatagcatcaactcatcatagagctaataagaacagagttatttaggacttcaaattcaactcaataactagatagttggataaaatcaattgttgctttcttccattgtaactgaagtggttgaagccccattatcgtcttgtatgtccaatgcaccaagatcttctagcaatatctcaagaataggctcatcaggtgacagtccagcgtgctaaagaaaattagcaccaccatcaaataactcaaagctatctcctgcaacatcccacatagttgatgggccactatggtactcttcagatttcctagaaagaagacgcaaattctggtgcacaaacactaaatcctcagcacgtgcagggttaagcctacaatattgcaattgtaatcagtttcaagcattactaatatacaagaaatcaagtaaggaaggaacagaacttatttcttattgaactatggatcaaaccataggtgctccaatttctttcagcacatgatgatgatgttggctgtccaagtaattttagtgccaaacatggaatcctaaataggagatttaccgacggcggcgacgttgcgccctcggagacgacggctgacgacggaggcgcggcgctgcggctgcgcccagcggagacgacggcggatggcggaggcgcggcgctgcggctgctgcagctgagggcggcagagatgcagcccgacgacggtggacagcggcggcgccgacgcagcgagccggcgacgacgcagccacgcaggagagcaagcagaggttgggactgggttgggggaggtggcgctggggtgtgggatttggttcgctcaatgcggctggggggttttgatcgtctgatttagggtttgtacgtatcggagacgtatcaggaattcttttatttatttggaaatagtaaaatggggggatacgtacgggatacgtatcggggcgtatccgatacgtatccgtatccggcgccgtatccgatacggatacatggactgaacggcgtatctaggtaacgtagaccacttgtcgggcttggacactctacttcgccgataccgtggtggaatgccaccgagcacgactgaacccgagcaggggatttacggcacaatccaaaggaaaagcaccaactcaagcaagagaattaccagcactagcccacatacggtggagaagaaccccaagaccgaaagtggttgataccaacttgtcacaacccaacgccggcggcgagactagttggaatcagtaggatagagtaaaacagaggagagagacatagagggagacagaggaagaagacaaagcagattggggaggattttttcttttcatttcataattaatttccaccatacagcctggaggttataaatacatcacagttcaccaactcatatgatccacatgtcattttctaccttttctactttatgctttctttatcaggaaacgactctaggcattatgcctcttctcttttatctactttatgttcctcttcatgtattgtagctgccctaattccctgatgtccgccgtgccattaaggtgtgacaccaacccatttcgtgctgcagactgcaaaggacgctgctcccaatatttcattgtgggctagggggtcgagacgagacgcgatgcgagagccatcggaggtacggttttcttcttgcatctttgccatctggaggcgtagccaaggggaataccccagaatttgggctagagaaccctccaccccaaatagccacagccaagaaacatctagggttggagggagtccagtccaccaccaccaggcgcgcctccagtgctccctgctgtccacgccggcgccgcgcctccccaccgtccccgccgccgtccgctccgtccccaccgtccaagccgccaagccgggggccgcgacggagcgactcctcgggtcgccgcctcgccggttgcgggttgccggcttggtggcttggcgcggcgccttctccagttctcttgcttggcaactgatccggcgctccaccattcaaccgacccctgttgaggtaaggtgaggtgaggtgaggtgaggatggcgatgatgaaccggacgcgggatctgctgatggaggggttcgagggcctcgtgcgggagggctccttcagctgggccctcccccgccgcggggcttcgccggtggacgacgccgatgaccccgacagctcctcctcctcctcctccggcaagcagccctccatctccggcctctcccccaaggccaacgccgtcgtctctcgctgctcccggtaatggcctccctacacacgcaattgcctagattctactgaaaattgggatttcttgggttgggtttctagggatgggaaatgctctggggaagcattttctttctgatatactactaggttactgcgttggatgtgacaattcttcgaaattctgcaattaagtggctgttcggtggctttatcagcaaccaatattactttgcatatgtttgaagatcgattattagagtatgtagtgctcaggatgtgctctagggcctatgagttcgtgttggatctgaaatgggtttggtttatgatgtccaaagtccaaacgtcaactgctgtgtgcaatgtagttcgttgcgtccattgtacttgttccgagggaattttaatatagaatcaaaaccatagctgtttaatatgtccctaaggtgggttttctttaagggatgttggtaaatgaataacttgtgtgagctaatatagtttatgtcctttcagaatgacctgcaattcttttattagcttgattggaaacatgttgatgagcatcctatgcttcatggaaccaatatgatgttgtttgcatttgctactgttctgttaagccaattggcatagttgtgtaatattagtttttccaaatcgctatgtcatgtaaaatcaattcccttttcatgcacaaacttatgtaataccagttttgctttcattaggtgctgaacatttgccttttgtgttaattacatttcagggtacttggtacttccacggatgagctgcagtatgactttgatatgcaagcatctgattccataaagcagccaagaaattatgcaagaaattttttggaatattgttgtttgagggcacttgcacatgcctcacaagttgcagggtatctttctgacaaaagctttcgtcgcctaaattttgatatgatgctagcttgggaagttccctcttcttcaagcgagctcactgttaaggttacaattttcctttctttactttcttaaatagttttcttttgttcacgccttatataatttgttagcgttgcattaataaaattttcccaggttacttcctcgtattaagggcttttaagaatctttctacatattgaatttcatctcctttcccttgcaggttgaagtagacaacacagtcagtttagaggctttttcaagaatagcacctgcaattccaacaatcactgatgtggtaacatgttcaaatctatttgatgtactttcatcttcaagtggaggccggcttacatttcctgtatatgataagtaccttacaggattggacaggtcactttctctactggtctgtccattcaattttatttgttgttggtttggatatttacatggtcagcaatagacagtgacaaactgccttttctaatttcatatcagcagtaattgaatgttatggaagttctcttgatgaaatgtctaccactagtaatatataatttatctgacaaatctaaatagttatatgcctcttagttgtcaaaatttgaatgtttgtatgcaaatgttgtaaaatgatgtccttttgagaatatggggaggcagggagtattacttaccataattatcatacatattgacttatattttctcttttgtttaccttccaaacgtacagatacaacttagatttacatggtgcagtgtagcagaaacaactagtttcttgtcccatgatgaatattttttttttcaaaatgaaatgcataaacatgttgtgcatctctttagtgcttattctcatcagtgataagtggataatccactttcttgatttaagatagagaaaatttgggcaaccattataggtctatagctctttatttctggatgtttaacctgttacaaccttacaatagatgttgttatcttcctactttgcactgataagtatatcacctgtttgagttaagattgatgtagtagatccccttgttaactattctccatagaaaattatggggcatatttccacaagccctctgttgatgtttatagaaacacacacgcacacttcccaatccatattttgttggtaattttcccatagtgcccatgcttaaagaggcctgtacgcatgcacgcagttagattttagtgaggtgatgcattaataccgtgcatgcaactagaataaatggaggtatttagataaaatagttggcttcctttggtctatgagccccaaaactatatgccgtacaattttctagggagggagtacccttttacatgctcaaagttgtacctgctaatacagggactagggtgtaatgtttatggtaccatagcatgtaaacaattttggagaatgaataaatgcaatatggtgcataccattatataggcatggacatagattctactatcaagttcaatggttcaatagcaagcaggttatctgattgttgaatatctttacatccttgttcatatagagataccattatatttccatcagttaatatacataacctactagtttgtactctgaatttagaattagtgtctgaagtaatataataattgggattcctttaaaacattaaccatttcttcatgctttaccatttttaaaggtagatctgtcataaatgaatgggaatatgggattgcatattgccaatttttgttaccaaaataagttcaattatgctcttttttttttctggagataggatatgcaagcataactttctgttggatcttgtttcataatgtcaggactgagagtatgttttacctcatgtagagcaattaagaaaatgaaaggacaatctgagtcctcgcttttatctgcccagcggtctcagagaggagaaaggattgtagaagtagatggaacattgacgactcaaccagtacttgaacatgttgggatttcgacatggccaggtatgtctgatttctcagtgaggagaaatgatttcttcttgtttacatgctggcatgttcttttaacttgccttgttacggttttatatcactgggtttcaacttttcctttcctggcacaggaaggttaacacttactgatcatgctctttacttcgaagcacttcgggttgtgacctatgataagcctaaagcttatgagcttgccgaagatctaaagcagtctgttaaacctgagctgactggtccatggggctcacggctatttgacaaagctgttatgtataaatcaacaactttgtaagttttttcacacttagcaaagcaaataagcaatagagtactacatctatgctacttaaaatgttagtagtggtggtgtccgttctgccacaccacccctaccactgatatttaggaccaataatctatagtattacacaaacctccaacgagtcctctcccgtttcactgttggtttatcttaaactttgaaatcacctacttattcaatctatactacttcaaatgtcagtagtggtggtgtctgttctgccacaccacccctgccactgatacttaggccccacaatctatagtattacacctacctccaacgagtactctcctgtttcactgatggtttatctacttatttaataaggaaaatcataaaagtgttaatttgactaaatatgtgcttaattgacttgataagctagaaactgaattcgttttccgttgcaacgcatgggttcttggctagtaaacgtaatagctgattcctatagtggtattttgctaattagttttaatttacaggtcgttgctatccattcctttttattaggagatagtagcaacatgtatccctcacctgatatccttataactagcacatagatttgctcttatcacctttagttacatgtttttctttattgttaatgcaaatgcagaacagaaccagtgatcatagaatttccagagttggctggccactttcgtcgtgactattggctggccatcatatcagaaattctctatgtccacagatttgttaggaagtttgacataagtggagttgacaaagaggaaacaattttgaaggctgtactaagcattatgcggctacaagctattgaagagttagccattccagtttctaatcgattcgagtctcttttgatgtttaatctatgtgacaaacttcccggaggtgatgtaatacttgaaacactagctggttctatatcatcgagaagatcaactcaagttaaccaacctggcactagcagtggaaggcattcaatgtccccctttactgttctgtcgaatcttggagtggtatcaccaattaataaaggtgagagactctttgttggcgagatagttgttggggaaatgagtgccttgcagaaggtagttaatgagtcaatgaacaactataagaaggttgaattggcccaagccacagttgatggagtcaaagttgatggcctggatacaaacttggcagtgatgaaggtatactcacaacagaattagccttttcaactgttaaggatctgttcaattcaatgtttgggtttagctactccctcatttttcgtgagcaggcttcctgatatgtgaacggggcctaattaatcagaataaattgtggtttatccaaattgatttcagcaccattttgatctgttaaattattcagaacaaaactaacctatttagagcttgtgcatcacaaaaataaaaagtaatttttgttgaagtatatatattcatggaaatagaaattaatcagcaattctttgtttgtgaccattcaccatatgttgtttttagacttcactgagatccttattccaatgtaatatttttgctgaagtattttgttggagaaatttgcctgatcatacctatattttccagcttttacatatttctgcatgatacataaaattccaaaattattacctctattttagagattgtatatgaattagaacttgccatattaccacttgttttgaaagttgtgaatgtagtaatttgaattttgatgaagagaatttattcgcttatggaaatttgaaggtataaacatgttcaatgcaaatcccgttgggtatgtactccctctgatcataaatatttgatgtttaggtcaacatttggtccaacttttcaaactttgatcatcaattatttctcaatgcttagtttaaaaaggaaaaaaatggtaagcatagattttccttgaaaagcactatcatattttctttatgattttataaacttattctattataaaattgatggtcaaaatttcaaaagtttgaccaaatcttgttttaaacatgaaatatttatgatcagaagttgtatattgtttttagccagaaggtttttgttcacaatattttatactattgttgcttgaaacatgtctagcaactatacagattcatccccgcaaaaaaaactatacagattcatgtttccttttttttatatcctcacttgtatttaggaattgctatctcccgtaagtgagctatggaggtttttggtgttgctggcatcttgggatgagccaattaagtccatggtattttgcttttcatcgtcttatatcattatcaggtatgctaaactctcatggatattttctttttggctttatgctacatgatgctttttaactgtggtacactatcgtgatttttttataactttgtgcaacttactaatataatgtaatataaacataaatcactagctcctttggagtgaatgttgcttcgattgcctctaatataatccaccccaattttaactagttcacgtgctttccatccaccttgctgctgccccgttgacttgaattcaaggataccatatactcccatttgagttgcaccatggaatgatgtcatcggaggtggtggaacagcagatggtgctataggaagctcctcatattaagaagagtggtgtagatgattctcatttctttattaaacacttgaatgatgattatgccttcctgcttataattacgatcagcgtaaaacctacctgatttaggaaggaagttaaactgggtcgaggtgaaaacaaaacactagaaaagtcctgtccttagtccttattatactgcatagcaatacctccatacaaaaagtgatagaatacttaattcaactgtacatcacaaattcatcagtatctagcatcttattgcagtgacactttaagcctagtagtagtaccacactagttctaaatgttgtacccaacatcaatccatcctcaacatgtagcctgattacctggtgaaaacaaccgtaaccactggattttgacattggttgaatactaagcaaaaacaactgtaaccactggattttgacattggttgaatactaagcatgtattaaatttgttgaatgaacaattaagaagcatagatcatatgtgaggtatattttcatagttaacacttgcagcaaattacttcagttcgacaaacacttcagaaatgagaaataatacttaaatatatataattatttggatgtttggatgtgtcgacatttttcagaaaattgtgaatccttgtgccaagaagactcaagctgttgatttcagctttcatatggttcttgtccatgtccatgtatcattgtgatgtagttacatctatatataccaattagtccttagccaaagtactaatgtagctgctacttgtgatctatgttcagtatttttaggaaattcttggctatcataacttgcatttgcacttgcactcatccacaaagtactgatgaggcttttcctagcttgaggaaggtacagttaataggattttagcattgctaataattttactctaataattattacttaacaaagtactttccttatcttccccagtgtgttcctataacatttcacccctgttggagataactcgtctttgatcaagaagtctggatagcacaagctaaaaccacccttctccaaagttgtacgcatagctgccatccctttccactaagcaaatacttacgaaaggcatattactaatctgcacgtgtaccacccagtcgtaactcgtaagtagggacatacttccataaaagatgtccgaggtgccttaggccctgtctagtattatgtacacatggcatggcatggtgttgaacctgttcgaaatagtgctgggacaatatgtcagcatcttcattctggtcgccatgccctacaatttactcacccaacattgctgcggaattctagaggcactaagtttcagtagtcagtatggactgcaaatctccacccctgtacagccaatatcaaattgcctttttcagtacaatgagctccatgtcttaaggtatgaatttgacatggtgggctacaaacctagaaccatatgtattttgggcttgcagttggccatgagtgtatatagaagttgagaagattagtataggttctactagtgatcgtagtgataaatctaagaagtaaagctatctcttgtgggctttgtggaagggaatgagagaaaatatgaggtagcatgtttctggccttggctggagagagtaccaaaataattcactggtgctgaggctatgagctatgtccaattattcttcctaattaaaatatattttacagtccttgtggagaacaactcatctaaatgttactaaataagtgcagccgtggatatccgtgcccaacgtttgaccgtccgtcttatttgaaaaatttatgaaaaatttgaaaatatttagtcacacataaagtactattcatgttttatcatttaatagcaataaaaatactaattataaaaaaatttcaaataagacgaacggtcaaacgttgaacgtgaatagtgcaaaactgcacttattttgggacggagggagtatcgttcctaacagccttagctataatgacattcttctgtaataaaacattttccttgaaatccaaggggacctgcaattattgctgttcctagaagaatgcgcccataatatgatgaatatttgttcttttgtgatggatactacacaattttttcattcttcacatttgtaatatcctctgtttttgtgatggcacagggggtggttagtctattttcttgttttggtgctcttgttttcggcagctttcatgttccttacaagactaactagccatggaaaaccaatgacggaggtcaaagtgacatctccacctccaatgaacacaatggagcagctcttagctgttcaaaatgctatttccaaagttgaagagcttgttcaggatgcaaatattgttcttctgaagattagagctttattgttggcttttccctcccaggtaactatatttcttagttcttattcttcatccttttagggagctagttactttgttcattcattttttgtgcttcctaggctaacaaataacattaacaatagtatactatgaatatatgtgcggtattcaatgagttagattttattgcggaaaggaaaccaaaagctacacttcagcttgttgatgaatgatgctatgaaaagaaaataatgatatgcgaactcaagaaaaacatagattcaactagaaagatcaggttagctaatcatttgaaatcaaatttactaacccactctgttttttctaagcgtactacagcatatgcatcttgtctgatatactgctaattattctacacatttagcatatgaacatttggtcttccatttatttttcttgatggtcaatagagactttttaaattttccagttaaattccttttgtaatttcaatcctcataacagattacgcatgtaacttattgtttcgaatttgtgtagtctatagaaacgagtggatgcttctgtgtttatgttacttttgagtcccaattgatattttcccttaaataaggtatcttcatcaatcatgaggtacaaactattgaagttgtttaaccttctgcatccactattattcagataatgattatttattattattctgaaagagagcatatcaggtcccaattgctccccctcttcattttatgaattggatgagcaaacaatcatttcatatttagttggaaggatttggaaatttgaactgaaaagtagtaaaaattagaagaaaaaaaagtagtcatcaaagaatatatgaggtaattccaggattgaagacgatatacagtctttcctccatccaattgtacagacctttctgccttgctggaccttggtctcaccttcagtcttttgattgtctcatagaattggaagatagatggcatcaattgggttgcaaaacttagatgaatatgttaaaactgttgataaaacttctgcatttttctaaactttgctgaaccttgtgagatccaacatatcttgcaccttgagcctatctatactcctatgaaaagaatccaatggtggtgcattggatctgccacgccacctattcccgttatagtttttacatattacacggtaaacttcttaacaatatgtaagaaccaaatcaaaatggagagccacatataaaattaaattaacgtgagtattacttatagctaaaaggtgggtaacatatttcatgaaaagtatgcttttatttattataggaaatgttatgtttttttttccgttctatcagtagctagttttttttttttgtaaaagataacatagcacccttcacttacctacattattttggttgtcatatttcacaggctactgatagagctatacttgccttggtagtgatggctctgagccttgcattcgtgcccacaaggttgcttgtcctgatgatgtttctggaggcattcacgaaccactccccaccaaggagagcaagcacagaaaggtggaccagaaggttaagagagtggtggttcagcattcctgcagctccagtagtcgtggagaaggataaagaagacaagaaaacaaaataaaagatatatatgtatattcaatgtaattatgtgccatgtttggccgatgggttggggtggatcaccaacgctcgtcttgtacagtagcagctagtatttttcaataaaaatgcgagttctcacctagaattaattgcttgcctcgtactttgattatttcgtatatagtttcatcgggtgatcgggaatgttggacaacaccccaggtttatgtgattttagctgaatttcttactgtttgtcgtcatttttcttttaggtgacaagtgggtttaacaacctagttttgccagttagggttcgtcttttggattcacatcacctgtctttgtaagttgagaagtgtccatgtattcacgataccctttgcatttcaggatttgccatccaattaatgtgtcgtccatggttctatatttgacgggtggtttttttagacagacccagtagtcaagggtgtgtaataaactctatattcgaagtgtggttagtataaaaaatcataaaatctataacgagaggcatctctatctggtcttacacatctatctggtcttacacatcgacacctggcgtggccatccgatttagtcggaagtatcagagtttagaatttgagagaaacatgagagtgtcaggcatgcatgtctttttttcccttcttataaagttttctcttaaatttcttatccgatatacaatccgattatactattttgatcattgcaattaaatctttacaacaagatattacatgattatattatgatgaaaaattataaattacttttataatatatctaaattacttttagatattactaaattacttcttagacaaataaaagtaaattcaataaagtcttatattatagaagtaacttaaaaaaaacattgtcatgacattagaagtaaatttgttatagggataaaaacataactctatatagaaattaaattaatcagcacaaattacggaattacctaaaaaaaataaaagtaatcacctcagagtattatgaatgtaatttttatatatgattaaagtaacttatgtatataataaaagtaatttacaaacataaaaattttttcatcataatgtaatcatgtaaaatcttgttgtacagatttaattgcaatgaacacaacggctaaaacgaaaagttgtatatcctggctaaaacgaaaacgttcactgcacatcatcatccaaattaaagcccatgacctttggaacgaatcgggtccactctggagcagggccataagggcgatggcctagggcccagccaaccctgatctagtatatatcctgtataggtatttagcccaatagcttagaattgatccttctcgttgattagaattgatgatccaatccatcgatccttctcacttgatcaggtgatgatccaatccattgatccttctcgctgattagaattgatctgttcttctaatttattttttccccattaaattaccaagattagggacttagggttctaccgttctgggttcaaccgttcaagggatcaatacaagtatacaaccattcaatgcacgataagtccataagctaattaaattaaggtatatggtggattagttttcattaggcctaggctcttgattatatagatttttccctcactgattttaggtcatagtactttgtttctactgtgttttttaagttttcaatcatactatcgatattatttatcgagaacaaattactatattgcaacttacaaactgcttgatttattatttaacatgttagaaatatttattgatattacaagttaacaaaaatagccttaacttctgaagggcctgtagcgtgaagttcgcctagggccctcgaaaatgttgagccggtcctagaatatgaggaacctggtgagcgagttgggtaggaacttcctcgcgaacatgaagtaggccgtcgtggtgtcgccgttgtagtcgcatgtcgtcccggtcccggccctgagccaccggaggaagtccggcgccgtgacccccattcttgtgaacctcgccgggtgtggacccacgtcacgctctggttggcgacgcgcgacaggtgaaggatgcccaggaatgtgggcaggtagtgctcgtcggcgtagcagttgcggctgcggtgcctcactaacacagggaagtagatgacgtcggcggcgaggcccctgtctacctcgaaccactgcgagtctgcgagcccttgccccactgcgcggcagtgatgacggggctcatgctgcgcttgtaccggccgcgccccgcgtgcctggcaagtcgtaggactcgaggtacaccttggtggtggagttgatgaggtacaagtacaccgtggacttgcttccgagcccccgtgtcgctccgctccagggcgacacgggaggcgactcgaggccgccccgccgccagccttctctccctcgcctcgtccgcctcgccgccacccgagcagccgccggcaaagccgggcggcagcaaggacggcggcggtggggccttctaccccctccaacacccgacggctggggccctgacgggaaacaggcggagggacggcgacgcgtcgaggtggctccggcgccaccgacggccagaggcggcagagccggtgtcgtcgctagcggatctggcccatcccccctcccccgcgtggccagatcgggacagagcggcgctggccgggcgccgcatcagaggaggacgaggcgccagctggggcagtcgtggcaccgacggagaaggccgacggtggctgacgcagcaccggctagggcagtcgcgacgtcgacggaggaggcgacgtcgctggcggcggggacgaggcgccgccggatctggctccctccaggccagatccaacgctcgctgctgggccatcgaaggaggctagctcccgggtggtggggcagaggaggcggcgacgggatggaggtggcgatgggatggaggcggcggcggcgacaacgacgagatggcggcggcaacgacgacgggacagcggaggcggcgctggtggcgggagaggcatgggcctggctgcgcacgacgccgctggctctggctccccccagttcggctccatgttggtatttcttaacgacattactagaaataattcccagcaatggcgcataaatactcctagtatattatggttgcagagttcatccgcaagcgcacagatataccattgtagtttttcacccgagagtattccaagggtatcgtatttgtttaatcatgtgggaagatcatagcagagagaaccgtactaataatttatatagcacacattcggcattccacaagacctacattcttttttaaattcactcgcagacaatactacaaaaagggccataggtgccggtttcccaaccgacacctattggtcggcaccaatactaacaaccgcacctatgatgaaaattgaactggtacattcagctttgctcgagccaaaaaaaaaagaggaccggtgttgatggtcgttagcgatcagtttcgaccgtcaatactaccaaaataaaggagaactagttatgcttgcaatgcatatttgtgttagaataataaatattccactagtactaggattactaaccacttgccgagaatgaacataaaatggaggagaatcgacatcaaaacaagcgatcaatcaatcggacgatgtcgagaatcagacttgtggaaagataggacaagaactcagaaataacacgaccaattgggccaaaattcacaagtttacaaagtatatcaagaggggaggccgccagccgaaattgggctggtttggcccggcccatggttcagctgaacccccacctgctccgttggatgtagggtttggcgtggacgtccaggattacaccccaatgacagttagagggcatttccaaccattccaattgccataaccgtcattgggaggctataaaaggagtttccatcctcactctctgtagacccccgattttaaaaatcggaaatcttctgtgtctatccgtaccaatccctggatcagtagttggtacacacgtacatagttggatcacaacatatcacgaatgaattcagtctaaaagagttaaatacttacattagggtcaggtaggctgataactatcagagaacagcagcggaagacaataataatataagggcccggttaacatggcacaggcagttgactggagaacgagacctagaacaagaccgcactccgatcatcttgttggatacgcaagcgtaccgacaagggcttctcttccacactctcctaaaagatatataaatagcaagggtgagtaccaaccgtactcagcaagccaccacaacaacaatgcgtatgatagaaggtatttcaaggaatggcttcaggttcttttgcataaagctagttttgcaattcttttcacaagcctaagacctagcatagactgttcaagttttaataccagtgtttacattaaacaacgacggttctgtccaccatccattgtaatcccaaggatagcttcccgccattgagtcgtcattgttttctgaggacgtccaccttccctcctcttgggaagtggctccatcagcataaaattcatcatgcaatatcccatcccacacaagttaagaatttagagtctagccaagtgtaatacatgtcccggtgctcaataaccgtgagcacggctattcgaatagatttattttactcacactccgcgactgcccaacacatgagccttgtctcaacacatgagacgcgtcatggcaaagcttttcgataacctcacattggcagtacccgctccatgaactttacatcctcatgcactctaggcgtacacggtttctagtagtgagaggagttctggcgcacccgggaagggaagactcacacatgcattaagttataattaagtttagattctcacatggcagtcctaccgatggcgacaccacgtagacacccgccccgcggtcctaccaacggctgccccaccgtagagccccttcctcacacatcaagaaaccactatgcatggatactgcctccgcttagctatctactccgctaggtctatacccatacgagaagtgcggttgtacgggggttgtttcatgcttaacttcatggctcggtccttaattgaccagggacggcactagccttttccggacaccacccaaatcttccagccgccccagtcgaaaacagttgttttcactttattttcctttcataaatcatgtcatcaatatcatggcaatgtggcgctcatgtctccacatgccgcatctcaattaccttcccaaaggtaattgcccaagcatatagcatttgataaatatgagtatgcatgattctagaatagcatttctaagcaattgtaataattgactagggactcatatgtaatcatggttacaaagatttaagggtgatcaataaataaggcatggcataatcacaaataggatgttcatcattgcatgcaatcttatttgtaaacaaaaattaatttcgcaattgggatcaacgtgatcaaagaatagtgatgacttgcctgctcaggatagtccttattcttgatataatcttgatcaaccttctcctcctagaggttgcagacgttgcctcacgactaaccgatacacaaggtctataatatgcgagaaaaaccaatattcaagcatcaatcaaatatgcacaaataaaatatatttgttgaggtcgaacctagggttgcttatactattcgtgtttgctaatggattccaatcgtgctaggggctaaggcttcttaatctttctatcgtcagcgtggtctatttaggagttaaccaacttagtataaatgagatacacatctagctattgtgtggtttagtctagctaatggctatggaaggattatggctacacatgcatctatttaaataaaatggttatatactagaggttctgttgtcgtatggatttagggtcaatcaaataattacagtgaatcatttgtattattattttgttgatggaggcttcactttaattatgaacatattttacttgtcacaataaattataaaaggttaataattatccatgctttgtatgttagagttgtttagattaatcatattatggttacagattatcccatcacataattttacaatgaataatcccaatttacagttgaactataattataattatatgaggtcaagatttataactagtatttatctaatgtacatgtttgtcatatactccctctaatttaatatatgcaacacgcaaattaatactataccgtacaactataatgggatgtatagtataggtgtgtgcgcaatgtcttaatattgaatcatttatttgaatagctactatttactacgagctacacagtacatgtgattttaagtggatttatgagtgagttaccgtctatacaacttaagagtcgatttccaacctaaacatatactactgtataggaaatgctgttaattaatttcgtgctggtgattttagtctcactagctctgttattatctctcataaacaagttaaagactcatctacgtgtgttcaacttttagttacaaaatatgaggctaaactttatgtaaataatttataagtcatggatttagttatatttggacatagactagtaaatggcattaatattttcctatacacccattaatttgaacgattgattataactaatttatgtggttgctactgtgacaaaacacattaaagataattatgctattgtacaatatccatttttatttattggcacactatttaggttaactattatctaatcatttgatattaattaatttataattataaatatattttattaaatagtaatttatataccattagaaagcttatgaatttagatgaatttaggttcaagtttcactcgaatcggagctaaaacgaataaattatgctagctcaaagttcctaattcaactaattgcgaaatggcactgttcctaatagatttatttttaatctaaccttatccacaagctatagtggctgacaagtggggtcaaggtcttgattttcttttctacagaattatttttctaagggaaattggatggaattaatgacaggtgggcccactctaacctctctcctccattctcttctctctctattctctgttttctcctctctctctcacggcttcggctagaaccggcgggcggcacggcccgacggcaagcggtgggggagggggaggctcaccggttcggcggcggggtcgacggagacgaggcggcgaggtcgacggcggagcacggcgcggcgacgaggcacatcgcggcggcggggcgcgtcggctcagcggcggcggcggcggcggcttccaacgaggcggcgacgccggggatgggaaagagaggggaaagggaggggaggtggtgggggtagtgtggggagcgatgggcagccggggaggggtttatataggcgcggggagggcggtcggcctaagggcgctgggacggcgcggcgcgcggagagcgaggcgacggtgacgcacggcgacgcgacggcgcggggctcggagcggcgacgcgacggcaggacggcgacaggcgagcggcgcgcggcggctccgggcgcgaggctgacggcgacggctcgcggcgcgcggcgatggcgacgtgacgggcgacgcgacggcggagtgactggcgcgcggcggcgcggcgcggcgcgcgcaggggcggcgcggggctcgagggggagcgcggggctcgagagcaccgcgacggtgagcggtgcggcaatgatggcgacgacgcggtagggagacgacgcacggtgcggctcacagcgatggcgccggcgacacgcgcagcgcacgcggagggaacggcgatgggacgcggttaggtgagggatggcgcggggctcggcgcggcaggagcggcgacgcgagggcgatgggacggcgcggcgcgacggtgacagtgcgcggcgcgggcggggctcgaggcggtgatggcgacgcgctggcgcggtagtggcccggggcccggggcgcggcagcagctcagggcgacagcgacgggcggcgagaggacgggcgacagagcgcggcgggatggcgggcgcaggcgcgaggcggcgagaggacgggcgcacggcgacgcgcgcggcttggccgagatgacgcgacggcgacggcgcgcggcgatgcgacggcgacggcgacggcgcggcgatggaacggcgcggcgacgggacggcgggctgcgcggcgtcagatggcgagggcgacggcactggcggggcgcgaggcagcggcacggcagggctaggcgcagcgcgggcagggggagggcagcgataggacagggtcgagcacctaggggcaatgaacagtactttttcctattttgcctatttgattgatttccttttcaaatcttgttttataaacctaattttcaccccaatatatgttttaatttagatgaaagtttaccaaattttaatattacccatattttattcttatatatatttttctattgtattatttaaatgaggtctaattctaaaattaacctagataattttggaggctcgagggctctaaaattaattaaaatatcctaatatggcccttattattacaatagcacattgaatgaacttatttgcatagcaatatattttacacggataggtttaatccaattattctataaatagtaaattgagacttggtacaatattaatctaattgtttaattaaaactcacatattcttatttatatataatcttaatgtatttatatgaccattattttatatgagtgattttcatgtcatgaggaagttggcgaaatgttgtgagtatcactctatatattccggtgaattacttatttataaacacgatcattataatggtgatcatcatttcatgtgttcttatatttcatgtgagattggattcaaatgaattggatttaatcttactatttctttagctaattgtgacatcaagctatcaatcatggttcgaatatttaatatctgaattgtaatttataatagaaattaatatttgactttactatcttgtgcataaatattggtagggttattaataaataacatattctcgtaaattatatctattgcttaaatttagatcttttctttactttctttgtgatcatttacggtttggcaaccaatagcaatcataacaaccagcatggtgcaaaagttttaaaaagttcaaaattttagtgatttttattgtcaggaattttcaggatattacactctctccacactcttcaagctaagctctctcatactctctcaagctttagtttagtattctcaagctagtggagtaggaagagttcgggtatggctccagcagctctcatttcttcttttgtaagacttgtactttatttagaatattcttctttatacatttctagtattgtaatactttccaagtatatgaatgctaactttactttatatccgaattatattgtttatattgctagcttatctgggagatgcaatggaacatgtatagtgtttgcttatgcaattactctatgtgatgacgatgatattagattagtatctggtagtttaggcgtagtgtctagattacaggatatcattatttggggttatatgctgcagatgagaggtgggccgctgatggtgacatctcagtacgggtactcctccgcgcgtgtatatagtcctaagttaatttcatggggagggtactcctccgtatttagtcccggttgtatggtcatgaagggcagtcataaggaactcgatagtcaggggtggcttcttgaagcaccaggagggcattggaaagagggtattagctagttaatcttatagctaggatgtatatataatatgtatactagaagtatatgaatagattcttttctattttctttccacttaactcagataatttattatgagaataagtagtcttatgcttgtgtgtcactctaccctttgcttatattaacccactctacaagtaatatataaattattagtacggttctctctgctataatcatcccacgggattaaacaaatacgatacccttggaatactctcgggtgaaatgctacactggtatatccgtgcgcttgcggataaactctgtaaccgtaatataccaggagtatttcgggcaccattgctgtgaattatatttctacttatgtcgttaaaaaataccaacaaccggctcgaattgagccgaactcactaagcaccatcactcccaaatcaaattgaaaaccccaaatcatccacaaatcatcaccaaaatcgattgacatcacataatgaacatactcaacaacaaaatcatccacaaatccaccaaaacatctaaagaaaatctacaggagacgtgggagggagaggggctggccctcgggcttcatgctccaccatctgcttcgttgctggtggttaggggagggcgctaccaccgctcgccgcctcccctcttgtgccgcggcctcccctcccgccggatccgatggaggggagggcaccgcctacaaccatcggcgaggtgcgccgcctcccctcccgtcggatccgacggagggggggggggcgccgccgcggcctgtcgcccgccgcctcccctcttgcaccgccactgacgcctctgccgggccgccatgcacaatagagagaagcaagagaggcgagagagagagagagagagagagggagagaggcaagaaagacagcgagagagaatgagagagatcgagagaaaggagatataaggctagctggatagggaggccgatgcttatggatagtttggttaatcaggtgcttatgatcaggtaattatatacatgatagttaagcaatgtgtatggttaggtagatgtaccttgctggggatagtgtggtgatggaaaacggatcggaggcctcgccggggtcggtgtggacatagacggattagagcccgcggtgcccctcaaagaacttctcccacagcggcgccaaacggaaaaaaattcatcatttggcaaagtgtgctatgatcttgctgatttgatgtgtggagagtgtgattttaatttgtgcatgtatatatagccacaaataaagcttgagtaacagaagagcatgagacaagggtgacacgggtggtgaccgccgccggtacgccaccacccccgcccaccttcctcctccgcctcaccgccgcccgagcaggccaccagaaaccacgcggaagccgcaaggatggcggcggcggggcctccttctcccccgaagtcgcggggtcggagcccacgaccccggccagctcttgggacggcgtcgtgacagcctagccgccggcgtcgaaggtgacgagttcggtggctgggtggaccgggtggtgacggcgaggcggcgacgccggtctggcgccctccccgctagatctggcaccctaccgtccggatcctgcctcctcggtgtgggaggccggccccccgtgctggcgacgacagcgaggtgctggggtacggcggcgttgccgcgaagctaggtctagcgccccttgccagacccggtctcctgagccggtggcggacgtggagtggacggtacgacggtggaggccggtgagacagcaggacacgactgtggaggtgacggtgtgaacgtctgaggcgagagcttggcgagagggtgcaacgacgcgacgtcgacagtggccacgcccatgcggtgcctttggcggaaggaggagacagcggtggggatggaagaagttcaggtgttggctgggatccggtcgcgccggaggtggatcccccctcccccctcccctgagggcggatctggtgcggggagagctcgcggcaacggcttcggtggcaacgacgcagagctcgtggtgacggtggcgacaatggctggacgacaacgacagcgggtggctggccaacggcagcaacggctgatggctgctgtggcaacgaggtgcacccgcggcaggagcggctgtcacggcagcgacagcggctggacggtggcgataatgtggctggccgatggcagcagtggctaccgtggctgcggtgggaggaggcatggcggacttggactgctagctgggggagtggcagacggccacacctggctggcgcgacagcgattggacggtggcgacaatgtggctgggggggcgctggtgcagtggtcccacatgtcgccagaggatgagcggtggtggagcattggtgcgtcagccgtggacttgtatgtggtgagcggcgggtgaaaacccagcccggccttggctggaccgacaacaatggttcattccccctcctgagggtgttgtcatgccgtctcatcccttaagggtggttgccgggcgaaagcccagtcttggctctttcgagaccctgacggacagtggcggctgttttccgtcgcttctctccttggagatgtcgtttaggcatccccttgccaaaactactcgaatgattggtgcaagcacgcttaggatggagttgggctttgtgttggttgtaagggcgttttttgggcgatctcgtctgtgttcctttgttggcctagcgatagtcgttcacgcttagcgacggccggtccggtgctagtcttctcccggacctgtgtgttggcgctgtcgatgtgtgggtagtggtatattttttttcctttttcctggttacgatcttcagggctgtaatcttgtaattttttcctactctatcaatagaactttacaccgtctcttgcgagtcgttcaaaaaaagagtaacagaagtaggctgagcagcttggacatttaaatgaacgcaattcatctttcggacccaaaataaagtgattaatcacaactgaacctcaaagcaagggatcatacagtcgaatttgataagaccaactcgttgaatttagagaggtattcagtcacagtaccggtttaggtcaacaacaacaattcattcatcttaacactgcgcaaatgcacatcaaattcaccaagagattgctgattttaacataggccagtcatgccaccccacctcaagtttccatgctagataccaattagcagcgtccccaactaaatttagtgtagccacggagaccataaaaccctcagcaatttgatagaaggagaaatacgtctcacaattatcaatccacacacaaaccctagtaccatcaaacttaggaaaatccattttagcagtccaatggcgatgccccaagttagccgtatgcaaaacatctaattgaggatcatgatgagatacttgatgctggggtgtacgaggtggtggaggctgcgcggaagaagccgccgatgacgagtctatagagtcggtaagatcggtttctgacacggagtggatggggatggtttagacgcagccgctgtgaccttcaaggtgcgagccacctgcatctactcttgctgtacttggccgagggaagtcatggagcgatctaccttggtctgcacgcgatccaagagctcgtcctgctgcgccaacttgaggtcgatttgcgcgaggtgcttggcaatgccgtccatgccgtcgaccttagccgcgacagctttcatggcgtccatcaagcgctcctccatggactccatcgcggcaaccacttggcggacttggacactctgcttcgctagtgcagtggtggaacgctgtcgatcacggctgaacccgagcagaggattacgacgcaatccaaaggaaaaacaccaactcaagcaagcgaattaccagcactaacccacagacggtggagaagaaccccaagaccgaaagcgactgaataccaacttgtcacaacccaacgttggtggcgagactcgctgaaatcagtaggacagagcaaaacagatgagcgagaggtagagggagacatgggaagaagacagcatattggggaggtttttttcttttcatttcataattaatttccaccatatagcctggaggttataaatacatcaaagttcaccaacccttgtcggtccacatgtcattttctactttttctactttatgttttctttaccgggaaacgactctacgcactatgcctcttctcttttctctacttcatgttcctcttcatgtgtcgtcgctgccctgatgttcaccgtgccatcagacgtgacaccagcccattccgtgctacagactgcaaaggaggatgcctcaagccacgactgctcccattccgtggtgcgctggagagtcgagacgagacgcgacgcgagcgccattgaaggtacggttctcttcttgcatctttgccaagagctcggactaccatagaatttggcccgggccccccccccaaaaaaaaggcccaaataccctgtttggcccaagaagcccaaaaacagctagggttggagggagtccagcccaccaccaccaggcgctgctccacgcgaccacgccgccattgtcgtccacgccggcgccgcgccgtccccgccgtcgtccgcgccgtccccaccgtccaagccgccaagccgggggccgcgacgctgcgacagcgattcctccagtcctcctcgccgcctcgccggttgcgggttgccggcttggtggcttggcgcggcttgcccgcccgccttctccagttctcttgcttggctgctccacgtctccactgatccggcgctccaccattcagcccaggtaacgaacagatcaacaaaacactagaacggctgcctaaatcgatgtgtgattagagatcagtgaatttgtgaataagaataactgaatatgcaatttataagttgttactgattagtgaatgtgtgctattgtttgtaggattggtaaaacatgaagaggagcggagatattgcgtcattatttgggaaccatgaagcaaaaacaatggagattccagaatcttctagttcttcgaatgtattcattggtgatgaagctcctgtacctgaagaagaaccacgacaagttcctacagatgctgtaagacattatttttatcgcattttcactaaatttgtatttgtatatcggctttatggtacaagaaaattttagcatgtgacatgaacgtgtgaactagcactacccaagaaaaaattcctagctgcgccactgactgggagttcttcaccggtagattctgctcgcgaatcgttgcttgcactgcgatctcagttcttgcttacttgcgctgttgattcgtatgaattcatggcttcttttggtcttccgctcttgtgcagtttccacgtgcacctcctgttcgacgaaacgcctcttcggtatcggccaccatggataggcgtcctgggaggcacaagctcaggcgggtcaaggcccatgtgcgcgctgcccgaatggaccggatcagtggcctccccgacaaaatcctccaccacatcatgtccttcctgaacacgcgccaggctgtgcagacgtgcgtgctgtcccggcggtggcgcaatctctggcgcaccatgccctgcatcaatgccgacttcgatgagtttgatttcattgcttaccaaggggacgatgaggactacaatgacgaggtggcattcaagaggttcgttaaccaaatgttggagctccgcgatcccaccgctatgatagacacattctggctcagctacataatatgggacgggtacaatgaatacaaggattccaatgtagatgccaacaggtggattagccatgctttgcagaagcaggccagggttatcgaggttgtcgtgttcgcctttccattggagctcgatcactcagtgttcacttcatgctacctgagaaaaattgggttctcctgtgtttctttacaccaaggtttcttcaagcaacttgacaccggctgtccagcattggaagaactcttcttacatgattgcatcattgcggatgaggagatcttgtcccagtcactgaaggttttgaccatcgacggcactgaattctccatggctaacaaggcatctatttctattccaagtgttacttctctgaccttgtctattgaggattccacacctatgctaaaggacatggaattactaacgaccgcatcagtatcagttaaatttaatacattcatattcagttatggttttgatgctaatgatctccgccagtgtctctggagcctttctggtgttacaaacttggagttcaattatgagggtacagaggtatggttatttgtattacttagtgtatccacccaccttgatttagttatcaatatgaaaaaactgaaacttaagcttttcttcttgtcatttcataattgcataagtttagtagcctgaacctgtaaaactaacatcgcagagctaattcatatgttgtgaaaccatgatgtattgataatatgacggatgttatcaacatttgatgcaatctagttcatgtactctggtcatttgtgcattaatcaactagccctgaagttttttatttggaagtttgatctaaaaaatgaaacatgatcatttctcatgtgaggactttacatgtcagtctagatgcaatatcagggttgtcaaccaaaaatgcatcttatccaatatctgatagactattttactttagttgtactttttgaaagagaggtttattggtgattgtatgttctacacctgccccaagtccagattttttgtggctgcaaatacgtgtgcatgctatttgtaggatagtgaaagaaaagtattgatttgtataggcagtcattttctcttgtccaatctttcatgtaatttttagatttcaggattaattgtatattgcattttatattttagatagtatatttagttgggatgtgtaatgtgttgggtgttacaatacacagacattatgctagcataattttaatgttaggagacattaaaaggcaacatacaaacagaaaattcttcccgggaattgttgaatgtctcactcctactgcttcctgatgatatatttgtgttgtttttttactggttttggacttccatggaaaccatcctgacagtgagttcgcatgtgctcgagagattctcggtgaaaacaaacaagtagaacattttttattttggtcttttgttgacatcagttcattttctcctgtgatcttttgccatccattatcttgaagctctcaatttagttggtaagttttgtgattgaggaagtgtggtgtataatcgtttgaatcttttgcagctgacattcgaaaacaatttgcaatggtgcccagaattcatcgatgttgtcaacctgactcttggtcagtggtgcctggatgcaaacttctatgcactaattgtcttccttcagaactcaccgagactagagaagttaactctgaatcttgcgaaggtaattgctttcctcagatgtatactgatcctgctcgattgtttctttttgcacaagaggttgtgcattgggaaataacttactgtttgtcgtgctacagtgcattgcagataaatctccaagaattgttggcgagcttatggaaagatcatttacgtgtgagcaccttaagattgttgaagtcaaatgcttggaggatgatccccaggtcatcagtgtggaagatttctttgctagtaatggcatggcctctgttcagtttgatatcaaacactggggccaatacaaggacgagttacctgcatttattcggtatgaggagagatgaaatgccaaaggatcatgcatttgtttgtcatcccattgaagaatcaactcgctttctgctacattcactggttacagtagagttttaaggtctcctgcatttttgctggtctctaggaatggcatccaataacttgctagttttcaactgaacaaatcgagtaatgtgtcattctactcctaatctctggttacattagcagttgttcaaccaagaacctatttatcccttgtacaacagaatttctttccattcatcaactatttttgtcgagtctcttcagtttcgttttcattttacaaaaacattcttatgtagattaaacttttttcccatcacgacgtgagcaagtacatatcacagcaccccaccacacaaactgctcacttaattggcttcgccaagaatgtgcaacaatcacgatcaacgaatcttcatggcgacgaaatccaacaatttgtgttgccacatttttggtaaaacctttgagagaaaaaaatcatcctttaggtaaagtatttatggagtaatcctttaatagataacgctgttgactttttacatgatatttccattcgttatatttaaaataatacataaatttatttatgttgttgtgaaaagtttaccattaaagagacttttaaatatgaattatattttagcatatttacattaattttgaataaagcaaataatcaaacgttatttcaagacaacaaatcagttgatgctgccacttgagattttaatctaggtatttgctagattttcgaatgcctaaaattttgtaaattttcaggcatcataaatcttacattgttagtcctaaatttgcaatgctatatgatgtgtaattttcagttcattttatcttcaacttctttgttatataccgttttagtttatttactttatcaaagtttttttgcatgtaattttatgaatttcatatttagattcatttttttagtttctatttaaaagagaagggactttgtttataaataagtaatagacgagtgatgatagcaaccatttgattgtcatccaaagaataaaaaggtgattgaaacttctgaatatttctgtagcctgaaatcaagagacaccctgtaatatttcatatggccatcaaaggtagctcaaataaactggccatttcagaaattattgcacttttttttactggtatggaaaacatttcgtttcacctatcatgcataatctctcatgttctgttccataatatgcaccatgtctaacaaaagagaaactatgcgtggtaatgccattatcttcttgatggtaatataagaaaaaaattatcattgtttcttaaacataataatataagaacaaaatattttttttgaattttgtggaacaattagagtggacggtaattgtggctttgcaaaacacaaaagaaacaagaagacagttgtacatcttgggccagaatagacaacagggcccagcccattggcgattatcagcccatctaacagagtagtcaggttttttctattaaaatggaaaagacgtggtgcgctcgagacgcggccgccattggagctggaggtacggctccctccttccttccttcccccatccttgctgcatctttcctctctgggagttcttcacgggcacattcctgctaggcattcgggactcgatcctttcactgacatctcagcttttgatttgatttgtgctgtggattcatggcttcttgttcttccgctcttgtgcagttccccacgcgcaccacctgttcgacgaaacgcctctgcgtgcttggccgccatggaggggcgttcttgcagttgcacgcaggaaggtcaagaccccggcgcacgctgccgggatggactggatcagcgacctccccgacgaaatcctccaccgcatcatgtccttcctgaacgcgcgccaggccgtgcagacgtgcgtgctgtcgcggcgctggcgcaacctctggcgcaccgttccttgcatcaacgccgattgcaaagagttcgacttcttcgggttccgaaggagcgaggtggagttcaagaggtttgtcaaccgactgctggagctccgcgaccccatcgccatgatggacgcgttctggttcaggtaccacaaattggataccgacactacttcctctgcagacaccaacaggtggattagccatgctttgcaaaagcaagcccgggttctagaggctgtcatgtacccctgccacctattggatctcgatcattcaagttttacttcacgctacctgagaagaattgggttctccggtgttcgtttagaccaaggtttcttcaagcagcttgaagctggctgtccagcattggaagatctcttcttacatcactgtaccattgaggatgacaaaatatcatcccagacactgaaggtgttgaccatcgatagaacttatttcttaattgcgatcaatgccactgatgttcagaagaaatctatttctgctccaagtgttacttctctgaccatgtatagtcctgagggttcgttacatatactaaaggacatgacatcgctagtgactgcatcagtttcatttagtgaattcagagttcattttgatgctaatgatttctaccagtatctatggagcctttctggtgttacaaatttggagttcaattatcagggtccaaaggtattgctattacatagtacaattactgctactacatacattcactcttctttattttggtaccagtatgaaaaactgaaagttaagcattgtgtttattcttgccacttcattattgcaaattgcaataatttaattacctgtatggctgtacctgcaaaactgacgttgcagctaattcttgtgtcttgaaatcatgatatatcgataagataaccaatgttatactctatgcaacatagttcatgtcctccaacctttttttttttgtacttaaaatcaatccgttgaacacttgtcctgaagtttctttgtcggcagttttgatcttgaaatgaaactggatcatttctcatgtgaggactcaagtgttctagtctaattcttcaggaattgttgaaactctcacttctaatgcttcctcatgacatatttttgttgttcttttcctggttttggctacatgagtgtcatggaaaccatcctgatagttagttaacgtgctcaagagattcacattaaaagaacaagtataacattgtttagtctggttttttgttgacataatttcattctctcatatgatcttttaccaaccattattttgaagttgaagctatagttatacgtgcactgcaaatagaatattttatcacatactgttagtactctactgctctcaatatatttttgttggcaagttttctgattataattgaatcttttgaagctgaaaatcgaaaacaatttgcaatggtgtcctgaattcgtcaatgttgtcaacctgactctcggcaaatggtgcctcgatgcaaacttctatgcactaactgtcttccttcagaactcaccaaaactacagaagctaactctgaaactcgcaaaggtaaataccttcctccaatgtatactgattccacttgattatttttcgcacaagtttgctcatcagaatattgcttacctgtttttcttgctatagtgtacttcggaaatacaccaaagaatcattggtgagcttacagaaagatcatttacatgtgagcaccttaagattatcgaagtgatatgcttggaaaatgatccccaggtcatccgtgtgaaagatttctttgctagtagtggcataacctctgttcagtttcatatcaaacactggagccagctaaaagaggataagttaccggcgtttacccgcattcctattccgtcccattgaaatcactctctttcggcttacttggctggttgagttctaaggcacgtcgacatatttactggtctggtttgatcctctctgctgtgatgtgggtacaaacaatcttgtctcgttgcatgtataagtaagtatagttttttttttggggggaaacacaaattcagtcgttagcctaaaatgttcctccatgaactaggactgtatatggtatcatatttgagtactatatatatgatttgcatgttgcaatcccatgacatgctttcacttgtagcatgcttctgtccggatgagtccattctatagtactttcattttaggctgatttggtattctggtcaagcttcagctggtgattacggggcatactcgatacttcccgtcgacaactggagtagtcattaacaactgtgttaagcccttaccctgaagtcactaacaactggagcttcattctcatttctcattttaatctaaataggaataggtctgcttcgccccttaaagtatgaaagagaattttctacacccaaaaatatcaaaaccagttcaaatagcctcctagagtggttttattatacacacgatgacatggactatagaggagactattgaaatgggctaagcactttattcacaagtgaaatgggctgataatgatttaaactagtgttaatatataatgtttaggcttgccgacatgtaagtgaaaaataatagtaagatcaacttggatttgctatgctaatctttatgccatgcaagctaatgccgctaccacatacccatctacatgtcaaaaccacctacaaaaccacttttggggttatttaaaccggtttttcatatcagtttcgtactttagggggttaagtaggccaaccttaatacttcagggggtaaagtagacttagaccctgtttagatgggactaaaacttttaagtccctatcacatcggatgtttggacactaattataaatattaaacgtggactattaataaaacccatccataatcttagactaattcacgagacgaatttattgagcctaattaatccatgattagcctatgtgatgctacagtaaacattctctaattatgaattaattatgcttaaaaaatttgtcttgcaaattagcttttatttatataattagttttgtaagtagtctatatttaatactctaaattaatgtctaaatatagagactaaagttaaagttaagtctctggatccaaacaccaccttactccatccaaataattgaaaggtgaaaatgtgaaaccctctatgcaaaactacagcgtcacatcatcaaaagaatatggaacgactgattttcgctccagaggttgcagactgttggatcattggattggcaaaatatctcaatacttcaggaaacttcttttatgttataatcattccatgttcctagagccttcataaaagctcaaggctcgcgagctgcccgagctcgactcgttctaggctcgattcgagctcggctcgagctccaaacgagcccagcccgagcctctccctaagctcgcgagctttgtcgagccgagctcgagcttccaacgagcctagtaatatatgatttttgttgttatattatttatatatcttgtattgacatcatatgtttattttattcttttttcctcttctattaatatgaagaactagaaattaattattttttaaatattatccttaaaatatatattgttttacttaaaatttaagctctgtagtcgagctcgaactgagcctgtcggaaagctcgaatattttataggcttggctcaagcttgtattgagctcgagcctaggcagacaagcgaactcgagctcggctcgttgagagccctagttctattgtttctttttcattgcctacttctgtccggaggagtccattctgattgtggaagacatattgttttcaaattattgttattctttactccacctacattccagtttactaacagaagtgatcgcaaatggcaagtttaataccaatttcccccttttttccaaccagtcattaacaattgtgctaaacccttgaaatcatttggccgaccaatttatatcctttactaacattttgtttccgaatcaggagcttcattctcgttttaattgaggattaaaattataaactggacaatcactccattctcaaatataaaacttttaggagtattttttagattgcttattcttccatcaaccacggggtcatttaatgtttaacctaattaatcccaagctaaaatgttagatttcgtaacattagcttagagcaatgtcaatagtatagccaactactagctccaaaacatctatagccaatctaatagcccattcatacaatatttaactataaaaatatacttcactattaatacccggtcccacctctcatatacacataacattttggagtccgtgttgcagccggctataaatatgtagctcgctttcttctctctcttctcttttcttctcgatatatggttatagctggcttatagcctgctattgtacttgctcttatagttcgttttttaattctatataccgattaactcttacgattacttttcagagtgctgattcttccaccaaccgcgagtcatttaattttgagtgaagtgcaccagcggtccctaaacttgtgtgggtgtgtcatctaggtccctaaactctcaaaatgcatttttgggtccccgaacttgtcttgggtgtcatatagatccaaacgggctccgacccgctccatccgctgacgtggcatgccacggtagcgcctacgggtcagcggggacccacatgtcacctctgtgcatcatctccaccgccctggaagccgagagagagagagagagagagagggaaagagagacgccggcggtgctcgacgcatcacgcgtgcccgggacgtggcaacgctgagctccactcttttcttcctcagacgtgtcgccttctcttctacattcttcaggagccgaacaactcggacgagagagagccctatgcctctccgtcgcccacattctcgtcgtcggtcgcgaagaagacgacgctcgctgttgccgacgagtcgtctccatctccaaatctttcccgttccatacttcccacatcatgccgagcaaatctccttttgaccccatctcgttttatccactgcagcaacggaaacgcgaccttgcccacgagagctccagaactcgcaccgggcgccgccgccatgacgtcgtcgctgttccggccgacatggtccatctcaagccaagccatcgcgccaaagtcatcgcctcaccatcatggccaaaagccctcaagaaattttaagaatcgtgcacagacgagggagatcaccgtcatcttctccaattccggtcaccgagtgccatcgccaatccctctctcctcggtgagccacggactaattaatcgtgcatgcaactctttagaaacctcactgaccatccatgcaccttctctaagcattccaccacccaagcgagccgtcgccgtgaagccgacgttatccaccaccgccgggctgtcttttccattgctgctgttacccagacgccatgccgcaatcaagttccagtgagcacctagggacctgctagactcgcatgcatgcatctttttgcactaaatcgggctggggctctacatgcacaagcgtaccgaagaccaccgccattcgcgacaccactggcatcgattccggccacctccggcgatgagaccaccttcaacaggatcgcaaggaagttctcagcatttcttcttgtggttgtgtcggccaaagaatcgtcgttcgccgacggcatcgtcgtgaaggaacgccggccggcaaactctgcagcagcagctgctgctgctttctccctgtgcctatgacaggtgggccccgctccattagcacgtacaggatttgattagagtaagtttaaaacatgtaaagttctttctgtaaatattgttatcatgtcatatatttatttttataaatatgactgacatgtgggtccccactgacacgtaggcgctaccgtggcatgccacgtcaccggatggagcgggtcggtgcccgtttggatctatatgacacacaagacaagttaagggatctaaaaatgcattttaagagtttagggacctagatgacacactcgcacaagtttagcgaccgctggtgcacttcactctttaatttttaacctaatattaaccccaaacatcctcttactcctcaactacacatcatttaatgaggcaactgtagtcttttcttctcaatcttactatgctaaacaactccttgtttgtgaagttggagattctaaaaacagccggtgaagatctagtctagaaatggtagattttttaacttaagtttatagttcattttctaaattctatatatacaaattaatccttataacccgagtaaaattctaaactatttcgggagccgaagattcgaagagaagttgtagctatggaggctttccaaatagagcatagaaatacttatattctactccatccgtttcaaaatgtttgacaccgttgactttttagcacatgttggactgttcgtcttattaaaaaaatttgtgaaatatgtaaaactatatatatatatatgaaagtatatttaaaaatgaattaaatgatatgaaaagaataaataattacttcaattttttaaataagacgaatggtgaaacacgtactaaaaagttaacggtgtcaaacattttgaaacggagggagtataacggagaaaggaggaaatcagatggaacaaatttacaagcacgtcgtcctatacatacaagcaagcgtctatctaccgaaatgaacagccaggtgtccaaagctgacgcctcccaatctcgaattcgaggtatgcgcatggctccctccttcgatcgatccgttgtttgtgttccttgcacctatcatcatcagttcatccacaaatctttgcttagaattgcatgcgggctcatgtctggttgattcttggttggtcttggggggtttttgtacgtgcagcttccacgcacgcgcactacctgttcgacgaaacgcctctgcgacgtgctcggcttccagcccgcgccatggaggcgccgcctgtcaagagtgggtggcgggtcatggccccggcgcacgccggcggcagggaggaccggctcagcgacctccccgagggtgtcctccaccgcgtcatgtcgttcctggactcgcgccaggccgtgcggacgtgcgtgctgtcgcggcggtggcgcgacgtctggcgcaccgttccccgcgtccacgccgatttctgcgacttcactctgaactggaccagcgacgacgacgaggtggacgaagcggccgtagcggaggacgaggtggtgttcaacaggttcgtcaaccggctgctggagctccgtgatcccaatgcctcgattcgatcgttcttcctcagattctgcagatcggatggaggcgatgatggctcagcagaagggaacagatggatcagctacgctctgcagaagaatgtccggattctggaggtttccgtgctgtcctacgcattggagctcgatcactcggtgttttcatcgcgctacctgaggacaatggacttcagcaatgtcgtgatgaaccaaggtttcttcaagcaactcgagatggggtgtccagaattggaagagctcttcttggatgaatgtttcattgtggatgatgagatctcctcccagacactgaaggttttgaccctcgatgccactcatttctgctgtggcttcaagacttccatttcaagtccgagtattacttctctggccttgcactatcctatgagtggcaaacctgtactgaatgacatggaagcactagtgagcacgtcgatgctgctttgtcatgtgaaagacgacgattttgctgctaatgatctccgcgactatctctggagcctttataatgttgaaattttggatttcagttatcacgggaagaaggtatgcttactgatcttacatattttcccttgtcttatgtgccctaactgtggtatcaatgtgaaaaggtgtgttgatagggtggatgatattatcaaccataccattcagtccaatttagttcatctgttcatgtactctgtctatttctacataaacgaaccttagttagcaatttgatttcacaaatgaaattggatccatttcccgtttgatggcacaacatgttcttgtgtggctgcaatatttggtttggaaactgaaaatgcatcctgtccaaaatccaagtgattgtttaacttcagttgacattactgcacatttacaggaattctgcatatatatttgaaaattatgagatattcaaatctcgaagtcaagaaatgaatggaaaatgcttcatcaattttcaaaagtcttattcctgctgctacctcgtgatacttgcatggaaatatccagataattaattcacacaagctctataaacttccattggaactaaacaagtatgtcattgtttaatctggtttttggtagccataattttttttttcttgtagtattttactatgcattatcttgaagccatatttgtacctgtactgcaaccagagtacttatcacataatgcccatgttctcaattttgttgccatattttttgaatatttttgtctataatatggcatggcttttatacaccacataactccaatgttgtgcagctgacaatggaaaataatttgcaattgtgtccgaaattcatcaatcttgtcagtctgactctcggtccatggtgtctggatgccaacttctatggactaatcgtcttccttcagaactcaccaatattggagaagctaaccctagaactcgcaatggtaaatattttcctccaaatgtatactgaccctacttgaaagatttttgacaagcacacatatcatcaggaatatagcttacctgtttattcttgctatagtatcgtacaggaaaattacaaagaatcattggccagattgaagaaagatcatttacatgtgagcaccttacgagtgttgaagtcatatgcttggaggatgatcccctggtcaacgacgtggtcaacttctttgtgaatagtggaatgtcctctgttcagattcatatcaaacaatggagccagagcgagtatgagtaacatccacttttccagtctgaggacatatgaaacgtcaaaggatcatacattcggtggtcattccatccaaaaaatcactctctttcagctacattccttgattctagtagggtttgaaagcacatagacttcttggtcggtgctatgacgtgagaacaaacaatcatagtcctatacttgtatatatgttgcttctgtttaaatactccatttggcctatgttctgctgacgtggtgttacattcccattacatgctttcacttcttctggtttctattaatcatatgcttggaggatgtttaatcccctggtcaactgcgtgaaaggcttctttgttaacattggcatggcatctgttcagattaattgatatcaaacactggagccagttccagcgtgaggtactgcaattttcctggaaatgtttgaatgaaatgacaaaaagatcaattcagttgttgttccattgaagaagcctctctttctgggctggttatacatttgttggttccagctgagtttgaagaacatagacatgtttgagtacaaacaatcgcgtgtcttgcattgggttgcttcattgcttgtaacttgtaagttgtatggtcagcagttcttctgctgtttgatgatgtttgtttctgccagagcggggataccttgttactgcaaattaaaacataaatcacatgatgtaagtagattgtgttgatcttgtgatcaactttcaaggcagatagaaatgtttactgctcttgtttggtgctgtgaaaattttaacagtcgtgcctttagctgcatgtaagatagtcttgtactacatgtctgcggcaatcacagaatgtggacaacatacaaatggaaaatgtctcagcaattctggaagtctgacagcactcttaccttgtgaatcatgacttcaggctgcgctcaggagtggatgttgtaatcttgtctcttgcgcacgcaaaacgtagctgactcgctaacatataattaattaattattaactaacgtaaacttaaaaatagattaatatgttttttaaaacaactttcctacaaagatttttttttaaaaaaaatgcatcgtttagttcggaaaacgtgctcgtgaagaattaaggattagaagttagaaagttgtggtaccaacacacccttaatcgcgtaggcggctatataaattaatacgaagtgtttacatgtcagattcaaaatggtcccaataaatacacaaccatttcaatgggggatgggggcatataactactttacatcctccatttatattatacgtcactttgattcttttttaagttgaacttttttaagttagaacttttttaagtttaaataagcttataaaaaaacatagcaatattttcaatgcaaaacaaacataacatcaaaataaaatatattgaacgaaactaatttagttttgtaattattgctatatttttatatatatttggttaaatttaaagaagtttgatgaaaaaatcaaacaatttataataggcaaaatttgctacacgacatgcaaaaaacgtgtaattggctgagatacaccgtaaaaacgtgacacggctgatacacactctaaaaattgtataattggctataggacaccggaggcaatatttataatttccatatcgaaaaaggtgataatatttttcaaatggcgagattgcccctgccatggagcagggccaccgccaattcatcggatcggattgcctccgcgcctacatcgccttctcctcgctctccgtcctcctcctcctcggcggccacgtcgccctcctcctcctctcacggtgcctccgcctcccgctcgacgccgtctccttcgcgctgctcctccccaacaccgccgccgcgctggcgctcgtcgcgctcgtcgccatcgccgccttctggttcacgctgctcccagagtggatcaccgggcgctactcgtcgccatggcgttggtcctcgacgtcgccgttggtcctcgctgaacgaggagatcccagcgctgctcgtcgccatggcgttggtccttgctgaacgaggagatcctggtgttggtcctcgccgtcgcctgcagtggtaccccggcggagcgccgccgcttttcctccgcgcgccgagccgccccgtctcgggccatcgcgctggccgagcgccgttcctccgctccaccgcatgcgtgaggaagaagaaggataggagagagatgtgggcctcacttatgattagcaaatagtaatcaccctactaattaggaacaaattagtccatgacgcgtgggccaggtggttaaaaacctattaaaaattagattaagcatacactatccataacacgtgggacccaccggtgtttaaagaagaaaagagaaagggcaatccagacatttagaaaaataacctattttgacccgcaaaaaataaaataatgcgaccgatgtcctacggccaattacacgttttgtttgtagtatccatcagccatatcacgttttcacggtgtctctcagtcaattacactttttttttttttgtcccgtggcaaatttttcctttataatatgaacttataattcgaaacttagttactcacggatgaagcgggtcaagcttacattctgtggctattgggctctgatgggaagcccatcaaagtagctgaaactaaatgcgcgggaaataattagagttgtggagggaaaacgaggcatcaccgctttatttcggcgctggaaatacaaagagattgttcgtcttcctcctcttcacagcccaaacaccgagagacgagcaccaaaccaatcgaggtttgtttcttcctttcttccaatcatcgttgcttgccagagctgctgccttgtcgaatcttgcttacggttgatctgctgcgttcttggtttcttggtttttcccctctctgcagcgggcttccacgcgcgccacctgttcgacgaaaggcgtctgagcgggtgctcggcggccatggaagagccgcctggcaagaaaggtccggccatggaccccgcgcaagactcgggcagggactggctcagcggcctccccgagggggtcctccaccgcatcatgtcgttcctggactcgcgccaggccgtgcggacgtgcgtgctctcgcggcgctggcgcgacctctggcgctccataccccgcgtccacgccgacatctacgacttcaccccggacgggaccatcgacggcgagggagaggaggacgtagaggaggccgaggtggtggtggtgttcaacaggttcgtcaaccggctgctggagcgacgcgatcccaccgcctcaatagagacgttcttcttcagatgctgcataccagacgaagacgacgatggatccgcagacgcgaacaggtggatttcctacggtttgcagaagaacgcctggtttctggaggttgtcgtgcagctcaactcattggagctcgatcgctcggtgttcaattcaatctacctgagaagaattgccttcggcaatgttttcatggaccaaggtttcttcaagcaactccagattggctgtccagcattggaacgtctctacttagatgattgcatcgttgcggatgacgagatctcctccaacacactgaaggttttgaccttcgatactactgaattctgctatgagcacaggatttctatttctattccgaccgttactactttagccctgcgcaatactatttgcggcaagcctgtactaaaggacgtggcatcactagtgagcgcatcagtggtactttattgtgtggaaagcggcaatttcgatgcttatgatctccgccactatctctggagcttttctcacgttaaagatttgattttcagttatcaggggagaaaggtatgcttaccgatcttacatattccaccttgtcttatgcatcttgacttaggtgtcaatgcgaaaaggtgaagtgtctcttcttgatacttcacaattacatgacatatcaataggataactgatgttatatcaaccaatcatctaatatagttcatgtactctgtttcatttctatataaatcaacatgttgatcacttgacctgaagcatcttagttggcagttcgatttcacaatggaactggagtatttcctgtttgataactgacatgtgctttgtgtggctgcaatatttgggttggcaactgaaaatgcatcatccaaaatctgagtaattgtttaacttcagttcacattactccatatatatttctttcctgagaggagtactacacatatatttcaaaattatgagacattcaaagtcaacaaatgaatggaaagatgcttcagcaatttttcagtgtcttactcctgctgctacctcgtgatacatttgtattgtgtcgactggcttagctagttagctacccaacttgcatggaaaaaagcctgataaataattcacacatgctctatagactttacgtgggaccaatcaagtatggcattgtttaatctggtttttggcagtcatcatatctttcttctttccttgtggtcttttactatccattatcttgaagctatattttacctgtactgcaaccaaaatacttgtcacataatgttcatgctctcaagtttttctttggcaagttttgtgaaattttatctacaatgtcaatatggcatcgcttttatgtagctacataatcactccactcttgtgcagctgacaattgaaaacaatttgcaatggtgtccaaaattcttcaatcttgtcggcttgactctgggtaaatggtgtctgaatgcaaacttctatgcactaattgtcttccttcaaaactcaccaagattggagaaactgactctgatactcgctgaggtaaaacaatttgaaatgcatcctgcatacgtgaaagcttttgcacgagtgcacatgccaatagaggatatagcttacctgttttcctttctgtaggataattgtaaaacatcagaagtattcatcggtgagcttgaggaaaaatcatttacatgtgagcaccttacgagtgttgaaatgaaatgctgggaggatgatcccctggtgatcaacgtggttgacttctttgttggtagtggaatgtcttcttctcagattcatatcgaatacgaagacgacgatgaggatcaatttcatatcgaatctgatgacatgtttgggtttgagttcgagtatgaggacgaggacgaggatgaggatgaggatgaggatgagtaaagctcactcagtctaaggacatgaaacatcaaagcggcacattccatccaaaagatcgctctcttccgtcttcctctgattccagttgacttcgaaagcagagacatgtttactgatcttctttggagctatgatgtgaagaatcatgtctttcgttgcatataagctcagtcgtcttttgcttgtttgcttctgtgatattccaagaaccaagactatgtgctacatgtctgagtacttcattaggcctttatatatgacgtgatattaaaattccatatcgtacttccactttctattactcgtttttatctatcactgcctactgtcaggatgtgaccattctgacaatggaagagatacatcatttgtttctgaatgattattccttgatctactccctccgtcctctaatataagggattttgacattttgcttgcactgtttgaccacttgtcttatttaaaaaatttgtgcaaatataaaaaacaaaaagttgtgcttaaaatactttggataataaagtaagtcgcaaataaaataaataataattctaaaattttttaaataagacgaatggtcaaacagtgcaatcaaaatgttaaaatcccttatattagaggacagagagagtataaaggaagccaagtattcccctatgtccctaatcccattctagaattataaatctggacatgagatatgattagacatatcctagattgctactcctgtttcaaaatatttgacaccgttgactttttagcacatgtttgatcattcgtcttattcaaaaaaatttgtgaaatatgtaaaactatatgtgtacatgaaagtatatttaacaataaatcaaattatatgaaaataataaataattacttaaattttttgaataagacgaatggtcaaacacgtactaaaaagtcaacggtgtcaaacattttgaaacgaagggagtacattttaagatctgggtattaattaacacatgcaattcatgttagcatctctcttcgcctcataagttttttttatgcaaaatacaaccaagactttgcccagtagttatatattataaagaaagaagagttatttacaaaaaaataaaaaaacaaagctaaaacagaagaattacagattttgtaaccagctaagttgttgttatatattatatatgtgtgttaaactttatcactcatcacgccaatataaacttgtgaataggctaaaaatggaggtgaaaatagaacagaaatggacgacaaagctatagtggataatagtattgagcctcgtgggttgtcgatggatggcacgacttgtgttcaagtaaataagtaatcaactagagatgaggaaataaaacaatatctttctaagataatggatagaaatctggtctctatatccacaattggatacacataacccaaggttaaggttatatgaatacttagatttcatgtacaaaacacattaataaaaaaacaaaaccccaggtattaacgtccaacttgtagtatttttatc

SEQ ID NO: 64789 - DNA, 5351 bp, Oryza sativa
ataatatgagaaagggagtattcacttacaacttctgaattctaatcatgcctccctttgcagctcacatttgaggtgctgaccttcagaagcatgatgatgactcccgagtgcaatccccaagtcggattgaatcaatgatcttgcggccttaggcatctgaccatcctgttgtacgaaacgacaatcgttaactgcgttgtatctgcaatactgttacgacacgggttatggcatctgaccatcctggtgttcataacatactatcactacctgtgatgtatctggaatatcgatacgacagacaacgattctcctgcgcgtacagcatcaactgaaaatgccagtgttagttttgctatttctaacgatttgcggaaggattttaatacattgatattccattgccggcggagtggacaggcaacggaaaacagtagcaaacttggtccgaggacaaagcatctagttttaatttgagcaattttaccatacaacatttggtatctcgaggtatcacattttacatacaaaattttgatacctcgagctggttggtaaaattgtttttttttttcagtttatcagtggctttttatggcttgcgcatgaaggtcctctcggacatgaatttgggccgagtgaatacaaatatctcaataaagtgcgtgtcactggattcaaagggtccagaggacaacttgagtttcttttgcatctcatggaaaatgcacctggactagaagtcataactgtggatacagctgaaagaatatggaaggatgaatatcataagaacgaatatctctgttctctgcaagactgcaactttgctcgtcagaccgccaaacaacatccttcgtgaagcacttccaccggccgcaaagatttccgtcctttagcatggatttgtgtaattgtttagtagtgagttcatgtgatctctctatatatatagtgttacatacctatcgatgatttgaagtttgagcaatagatgaatgctcgatttaaaatactctttggctggtgcaagtgtcatgcattttattcactagtacgaggactaaagggaagtcgtcgttgactcctctatagttggtactagctgttaactccttccgttatacggagtactagtaaaaattaacaaagatgagatacatgttaatactataaatgaaatgtgagataagtatgtccatattcatatttatagtacgcaatgtttagattcgtaatacaataatacatcttattctatattagattactaattttttttcgggaatacacaaaaggattgcgtacttttgtattaagagaagtaaagaattacagctagattactatattttgatttagattcgtagtacgaagatgtatactttctcgtattagattacttatttactttacccacgagctgctcctcgtggtctacactctggcagtggcaagcattcgcgaccttgtagggggtgtgtgacagcggacaggatagcaggaagcgccatggcggcaggtgtcctcgacgccggcggcgctgtcccggccgcagcttacagcggggagctcacgctctccgtgcttgtcacatgcctcgtggcggcctccggcggcctcatctttggctacgacatcggcatctcaggtctttgttcttctcccagcttgtgcatccgcgtccacgatggattgcttggattctttggtcgattatgatctctctgatggtgctcgactgtttgttccaggcggcgtctctcagatgaagccgttcttggcaacgttcttccccaaggtgctgatgaggatggccgacgcgaagagggaccagtactgcgtcttcgacagccacgcgctcacggcgttcacgtcgtcgctctacgtcgccgggctcgtggcgtcgctggccgccggccgcgtcaccaggtggctgggccggcgcggcgtgatgctgatgggcggggcactgttcttcgccggcggcgccatgaccggcggcgcggtgaacgtcgccatgctcatcgtcgggcggatgctcctggggttcggcgtcgggttcacgaaccaggccgcgccgctgtacctcgccgagatggcgcccccgcggtttcgcgggtcgctcaccgtgggcttccagttcttcctctcgctggggatactcatcgccaacctgaccaactacggcaccgcgcgcgtcccgtggggatggcgcctctccctcggcctcgccggcgccccggccgtgttcatcgtcgtcggcgccttcttcctcaccgacaccccgagcagcttcgtgatgcgcgggaaggtggaccgcgcccgcgccgcgctcctccgcgtgcgcggccaccgcgccgacgtggacgccgagctcaaggccatcgtccacgccgtggaggccgcgcggggcagcgaggacgtcggcgcgttccggaggctggtcacctggcgggagtaccgcccgcacctgaccttcgcgctcgcgctgccgctgtgccaccagctcagcggcatgatggtcctgaccttcttctccccgctggtgttccgcgtcgccggcttcggcagcaacgcggcgctgatgggcgcggtcatcctcgccggcgtcaagttcgcgtcgctcatcctctccacgctggtcatcgaccgctacggccgcaaggtgctcgtcatcgccggcgccgccctcatgatcgtgtgccaggtaagtacgcgtacgtaccataccatgcatgcaaagtatgtaacgttcgttgcatccgtcgtttagaattattgctgttttgtgatcaaggtggcgaacgcttggatcatgggggcgaagtccgggaagcacggggaggtggcgatgccgagggcgtactcggtggcgctgctggtgctgacgtgcgtgcagggcgccgggttcgggatgtcgtgggcgccgctgatctgggtgatccccggcgagatcttcccggtggaggtgaggtcggcggggcaggcggtgagcgtgtcggtcacgctggggctcacgttcgtgcagacgcagacgttcctggcgctgctgtgccggctcaagtacgccacattcgcctactacgccggctgggtcgcggccatgacggccttcgtcctcgtgttcatgccggagaccaagggcgtcccgctcgagtccatgggcgccgtctgggcgggacactggtactggaggcggttcgtcggcggcggcgacggcaaaccggagcagcgccgttgacgaatcatctccgtggatctacacaagtaccacgactacacttacttactaataaagatgtgtgtgataagctttcgtgccggtcatgcatgctgaactagtcaattataagccttgtcactttgttcagagggtcacaaaattcttgggaccagttgacaacttgctcaaacaaatattgtgttatcggtgatgacttgcgcgcggtgactttgagatcattgatatagtaccacggatgggtaattatcaatactcaatcgtagaaagaacgtgcttccgctatatatcagtgtactactagtctactgctccatccgtctcaaaatataagcatttttatattttaacatgatcttcgaaatgttacttttaccaacgttatctataaaagtaaaatgttttaaataaaaagagttgcatattgtgatagtttgtttaatgataaatctagtagcatcaattttatatgattgatcttttttatttttttgctattaatagttaaagttacaaatatttgatttggtattatgttaaaaatacttatattttggtacagagggagtagtatactcaactctactttagtaaatctactttgaattttatatttctgatactcgaatttggttagctagtgcctagtggactagtaagtgaaagagaaagacacaacttgaccgtaatcgccttttttaatggagggagcaagagaaaggacagagatataccgaaacggatggctagagctgcaaattaaaagatataattaaaccattagaggctaattaaagatatataaaccattttcatcgtctaaaaagatggctctacggcggactatctaacagtatcctctgccgtacagtccataccgtaccaccaatatgtgtatgtatccctatatatgtactttagggtctatctctcagtacgacacgtacgtacggtagaaagatgtgcatcccggactattgagacggtttaggtatcatgactcatgcggggctatttggttgccaattttgcaccctgatagaggattttttctgcatttaatttgacaatcggacacttttcaaaaactaatttcacaaataaactgtagccaaaacttatttcaaaaataattctttttttcaacgccaaatcatatggtgctgaacttagacatatcaacgctaaatagcacgtcactgaatgcatgttggcacaccgactcagtctcccatccgtggtggcacatcattcagcatcagttgacgtggtgttgaggtatctaagttcaacgccgtatgatttgacgctgaacaaaagggtaatttttaaaataagttttggccacggttcatttacgaaattagttttcgaaaagggtcaaattatcaaattaaatgattttcctaggcggagacttcccagcgttggtttgcgtcctgagtggctgaagctttgcctcatctgagctgctcagacgacacaaaatcatccaacaagcatgaaataaaatcatctaacaagcatgaagataagtgcccacgcaaaacgagataaatcattagcacataattaattaaattttaattattaaaagcttgaaaaaatgatttatttgattttttttatagcaacttctatgtagaaagttttcgcacgaaacataccgtttagcagtttaaaaggtgtggtaacgaggaaaaatctgtatcttgttggagttatatgtatcatgtgagacgtgattcgtcattcgggcatgttactcgggttgccaaccattgttacccttgtaatgaccaaaattttgttcaacggccgatgtgagcctcaactattagaattttgtccgctgctctagaattttagtaaagttgcagtgttccatttccattaaagcgaattgaagacaaaatcttgggagagttgcttatgctattgtttagtttgatatatcaataaaaagtaccaaatcgtaatcgaagaagttttcaacaagagataaggtctaaaggtgtaagtggcgtatataaatgggaattaactaggaatggttagttatgtattagttgttgctcaaatttttatttcaatatgcaacttg

SEQ ID NO: 64790 - DNA, 18382 bp, Oryza sativa
cattggctataaaatcattgaaatacttagaatcataagaatattataaaatttgaatcctagaaatccttatattttgttttggcactgtggtgagcttgctattaccaaattttgtagtaaaacaaacagtaccattaaatggtaaaaaaatgtaagaatttgttaggcatcaattcaaataatcccttaatccaaaatggcttgatgatttttcgaaagttggcttgaacacaggaagacaagatagaatatacttgcttttgttgtgtcttatttaaagcatttgtcagatggttggaatggttgcacacgaaaggagcacttggtatcggtagcttaaataatcaaacaatggaaatttgtgataccttgaaccttgttacaaatagctatctgtctgatcctcaaattcaagctagtggggttaagagcgagttgacactccatatatatctttcatgtacacctctgaaacgtaagaaagctcatctgaccgcagtttagctccctcttagacagaggccagagggagaaagagagagagagagaggagaaggctgagactgaacattcaagatggccggaggtgtcatcgtggcgaacgacggtgatggctccgccgtggaccacggcggacggctgacgttctcggtggtcatcacctgcctcgtggcggcctccggcggcctcatcttcggctacgacgtcggcatctcaggtgcacgcgcgcatgcgcctctcgattagtctgatcttatcaaaggaattaactgacctgacctgcttctgcgtccatcaaggcggcgtctcgacgatggagccgttcctgcggcggttcttccccggcgtggtgaggaggatggcggaggcgaggcccgggaacgagtactgcgtctacgacagccaggcgctgacggcgttcacgtcgtcgctgtacgtcgccgggctggtggcgtcgctcgtggccagccgcgtcaccagggcgatggggcggcaggccgtcatggtcatgggcggcgcgctcttcttcgccggcggcgccgtcaccggcttcgccgtgaacatcgccatgctcatcgtcggccgcatgctgctcggcttcggcgtcggcttcaccaaccaggtcagtgtcacagtcacacctcttccatcatcttccaccatgctgtaaatgcgtctgaccgtcgattagtattgagcgacacccttaatcctgcgtcagcggattgtccaaagtctttggctgatagacacagagacggagccatcatcattgctcattggtgaacttatctgctatttgctttcagacagctatgttagtatctttatattatatcaggatatgcttcgaagcagccactgccatgatcccaagtgttttttttattatttttggcttaaatataagggcaggtgaatccgcacatacagagaaaaaacgagagccaatccattcgtcaaatgactcaaaccaatgcgatctccaagtagtagtatactagtattcttaattatctgtcagtccactcatgaaactctaagtgcgattaagctatgaagaacgttgcagttaattacagacagctagtagtatactgtagtacttaggtcgattaccacatggcctattccgacatttggtgcaactaatccaccgatggtggtggtggcctggtgcgctgacctgtacccgccgagatgccgcgccttggcctcggtggcgtcacgcatcactagtaccaaccacgtcccgcgccgcgagtatcacacgagtgcaccgggcgttgcagcacgacgggttcgatcgtgtcgtgtgggttcttgacgaacgaaatgggcaggcggctcctctcttcctcgccgagatggccccgacgcggtggcgcggctcgctcacggccgggttccagttcttcctcgccgtcggcgtcgtcatcgccaccgtcaccaactacttcgcgtcgcgcgtcccctgggggtggcgcctctccctcggcctcgcgggggcgcccgccgtcgtcatcttcctgggcgcgctcttcctcaccgacacgcccagcagcctcgtcatgcgcggcgacacggcccgcgcgcgcgccgcgctgctccgggtgcgcggggctggcgccgacgtggaggcggagctgaagggcatcgtgcgcgccgtggaggtggcgcgccagggggaggacggcgcgttccggcggatggcggcgaggcgggagtaccgcccttacctggtgttcgccgtggccatgcccatgttcttccagctcacgggcgtcatcgtgatctccttcttctccccgctggtgttccgcaccgtcgggttcggcagcaacgccgcgctgatgggcaacgtcatcctcggcgccgtcaacctcgtctgcctcatgctctccaccctcgtcatcgaccgctacggccgcaaggtgctcttcatggtcggcggcgccatcatgatcatcgcccaggtaatcaattgcccaaaacgttcacttcatcagtagtactcgggcttgaactttttttttctcttgaaggttggggtggcgtggatcatgggggcgcaggtggggaagaacgggtcggaggcgatggcgaggccgtacgcggtggcggtggtggcgttcacgtgcctgcacacggcggggttcgggtggtcgtggggcccgctggggtgggtgatccccggcgagatattcccggtggacatccggtcggcggggcaggcgatgaacgtgtccatcggcctcggcctcaccttcgtgcagacgcagtcgttcctcgccatgctctgccggttcaggtacggcaccttcgcctactacgccgcgtgggtcgccgtcatgaccgtcttcatcgccgtcttcctgccggagaccaagggcgtcccgctcgagtccatggccaccgtctgggcgcgacactggtactggaagcggttcgcgcgggagcaaccaaagacgagcgccgacgaaccgaccgggacgtactgatgtttcacgatgtgtagatgtacttaattctgtggagtacatgtcttgtataacttttgaatcatggtacttggtcctagttcactcgtctgtttcaatcgaaatcaaatgtatagaactccaacatcggtcgctccgatcctacatagctcaagtgttgaaaaatcctcacgacactgttgcaagtgatttaggatttgaatagcccacgtgggtgtctagcgtggcaaaaaaaaaaaaaaatcgtcagcataacaaagttactgacaaagctctttaccctctacccctctctctccccccccctatagatggccatgtgggccaggccgtgccgtgcctgggccgaggcttgtcgggccggcacggcccgaccgacgcaccgggccatgccgtgccagcccacatgccgcactcacggcccaggcacggcccaacacgcctcgggccgtgccgggccggcccgaaggcacgatgggccatcgtgcttttcctcagaataagtctaaatttcctctctcctattgggctgtgacatatgtatagctaaaaaagtctattttacctccctcttctttgggctgtggtatataaatagctacgataaatctatttaaggtccctattctttagacaatgacatttatatgtctatttttagtccctatactttgtgtaccgggcctggcctgccggcccgaccgtgccgggtgtcacgccccgaattagtcctgaccggaactaacccgtgacgctccaaattaacctgttaatcgataccagtcccaggaaacagtgctggtatcacagggagacagaatatcacagcaacagaagtctcttcattatagagtagaagtacagtcatgttgggctgcggacagatcccgagctcacaactgcattacaaaaagaaagcggaagctaggacttggactaaacaatcacaggcgcgacttgggaactaggccgaaaccctaaaactcatcgtagccggcttgctcctggaaaaactcctcatcagcaggattcgcttcatcttcttcagcaactgaggggggggatatttatatagagcaagggtgagtacgggagtactcagcaagccaggggaaataagtgtttaatgcaggcttcaaggaatggctgttgtttttgcaattgattttatttgaactattttctaaaggcaactaagtgagtgcttctcaaacgacacggatgagacagtgcgtctcgtccgatcggagtatgtgcaatgtgtcagtctttagatcttgaaacaaggttggcacccggccaaaagctttttgaacggccacccgggccaacaacttttaaactgccacccgggcctagctgatcccatcagctgcaggttttccaaacatcgaacccagtttcacaacagcaatttcacaagcagtagtcaaacaaaactacgctaggaatcacctcacatccgcccgtgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtcttttggaaaactccagttttacccaagttgttactcagattttaagtttgaaggcgaccgtcggtactcgcacagagtgcgcgagtatcgaggcgcaactgggtggttacaaggggacatggtatagcaattaacaatggaaggatcaaatgcgacaatttaggtaagtccgccaatctgcttcgcagacgggacaacagattaagtgtgatcctatcaatgcataatattttgcaagcaacataattaaatttcaaatataggctcaaggtgttcaaaggtggcttgccttgctcgagatctggagcttgatcctcgaaatcctcgcactgcgggtcttcgggctccgaaactacacgcgaaacggggcaactcaacaaacagtgaaaataaagccctattaatgacctctgagcgtgccactagatagatctcgagatttgatgaattttggaagttgaacggagtcaaacggatttacggttgggaagatatagaatttctaagattattgaatttctaagattatttaattaaatccttttttggaaaagagaaagaaaaggaaggagggaggaaatttagactttcctcgggcggctagggtgcggcccaagggatctggggcggctcggccgagcttaatggtccggccggcccaaaacggcccaagcgcgcgcgcgcgcgggaggggagagagagtccggtggaccgggctcaccacgcgcggtcccgggtgggacccgcttgtcagcggctcggctcaccgtgcggagggagcacgcggcgcacgcgcgcgggcggggaggaacgcggtgcacgcgcgcggtccgctgcggacgcagatgcgacgggcccacgcgcagcctcacggcttgcggtggaacgcgcgcacggggagggaccgaccggggtcggctcgacccggtctaagctgagctggcgccgacgtggcgcctacgtggctgccacgcaggacggcgggaggtagacgacgacccggccgtgaatggacggcgggcggcggcggcgagcggcggagcgaactacggagatacgggcaaaagcgagcacaccgggcggttgttcgtgacagggggaggcgagccaacggctcggattcgccggaggtcgctcgacggcggcggattgcggcggcggcaaccggcggcggaagaagagggaaacggcgacgagagcatctacggcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcaacggttggggcggcgccggctagctacggggggtctattcgagctactaccgaaagctagggggaggagacggagcgaggagggggaacggagagagacatcaccgagaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcgaaggacggcggaggtgagacagagcacggggcggcggctatggcgcggagacgaatggaagaggaggggtaaggggaggccgggggtttaaaggggacggcaatgtcggtttgagaaccgacttgcgcagtcaaggcgcgagctggcgctccggctagcggccaaattggcgacagggaggatgacgccggcggggaggaaaaggggaaaaggaagggggaaaaggggcttgcccctttgccgatttgggaaagaggaggaggggagcgggggcgacgcggcagagggagggggggcgctgcctccgtcccttggcggcttgcgcgcggagtggcgggggccgggcgatgacgacggcgatgacggcggcggtttggagcggagcggcgacactggcgacaggcgcgggcaggcgctgacgacggcggcgaccgagcggtcggccgcgcgcgcgggaaacagcgagaggcgcgggcgcgcgcgagcaacggcacgcggggagcggcagcgagggagagagacgctcggggtggctctcgacgcgcgagcagcgcgcgggcgaggctgagcgggggggggggaaggagcgcgccgggggaggggaagagagagagaaaaagagagcccgggagagagagagagatgggccgagcggaattcggcccatcgaaccccgggggaggcaaactaaactttgcggagggaatcgatttggaaggatttggattcggatttgaactcgacgatagatcggggattgagatcttgagagggcacggacactagacaacaatcaaagaaacaaatttcgcagatagggtttttaagagataattttcccgctaggcgccacgacggaacgggcgctacaccgggccggcccgaccgtgccgggccaacccagcgtgccggtggggaggcccaagcacgacctgacggtcgggccgtgccgtgcttgggccgggccaaaaaggcgtgccgtgggccgggcctttgggcctcgggccttatggccaactataccccccccccagaaattcccctctccccctctcaaatgagaattttcaaaatatgtcattctattcgtaccatcctcaggatttgccattcaattcataacactccgtccctccgaagccgcacaccgtcgcaagtccatgtcgcgccatccgtctgcctcatacgccgttgctcgcgagcttctccttcccacgcacgggcattttactagtatgttaatataagggctctaaaataaataatgaaaactgcaagagaatcagcgtcgaatacaacaatcacaatctttgttgtacgcataggaaattcatgtccgtggaggtggcgcgcccggggaaggatggcgcattccagcggatggcgacgaggcgggagtaccggccttattaccaggtgttcgccgtggccatgcccatgttcttccacctcatgggcatcatcgtgatttccttcctcccccccgctggtgttccgcaccgtcagccttgtccgcctcatgctctccaccctcgtcatcgaccgttacggcggtaaggctgcaaggtgctcttcctagtcggtggcgtcatcgtgatcattgcccaggtaattaagtgcacatgtccacttcgtaagtactccctccgtccaaaaaaaacttaacttctagagtttgaattttttctaaaaaaaaccaacttttatcattcttcctacccttagcacgtaaaacgagaaggcttattccttcaataccctttatctacctatcactcttactattttcttactgtttttttcaatgattaagaatattttattcattctcaccctccactattttcatcttaggatgataggaatggattttttgtgagacggagggattagttgtttgttccagcttgagtctcacatgtacggttttgagtttgagcttttcttgaaggttgggttggcaatgtggcatggatggtggtggcgcaggttgggaagaacgggtcggcggcgacggcgacggcgtacgcggtggcagtggtaggcgttcacgtgcctgcacacggcagggttcgtgtggtcatgagtgccactgcggtgggtggcgccgtgcgagggagatatttcccggtggacatccggtcggcggagcaggcgatgaccgtgtccatcgtgtccaggggcgatgagcgacgacgaaacgaaccaaccgaagtgactgatcgagattgatgtttcacgatgtgtaaatgcacgtacttagtcctagttcactcatctgtttcaatcgaaaaatcaaatgtatagctccatctttatatgctattgttagaagaaagactacttccattgctagtgtcaagaaaactgttccacttaatatttttttagaagagttttaattggttagaatattgtatattggctgctattgtacatattcagttgaatcatttctctgattattttagatggaattatcatcagaatattctgatagattctcggtgaggtcaatgcacctagctttaatcaataatggctatattgagaggaataagtgtatttggaagcttaagatgccacttaagattaagatctttacgtggtacttgcttaaaggggttgtactaaccgaggacgatttgataagacggaattggaatggtagtttaagatgttttttttatgaaaaatgagactattcaacatctttttatggactatcattatgcaaagtttatatggagagcagttcagttctcatttggttttaaccttcctactagcatatcctcatatttttgatgattggctattggggttgacaagaaaaagagtaaactgatatttgtaggagcatctgtcatatattgggctttgtggttgagcaggaatgatatggtttttaacaaatcaccatctatttcatatatgtaggtaatttttagggcaactcattggctctggttttgggcacaattacaaaagtgtgatgaagatggagagtttctaaaagttgcatgtcgtaatcttgagacgacggtcatgcaactgtttgccaactatggatggagattcacaaataagcttgaataaatgtgttctccttggtttggtttcttcatttttatggttggtgtgttcttctatttatggactacactctattctagggtgctactgtgctagtttgtaataattagctgtagctcttttgagcaaagacagggatgttatattacactagcaaaaatgctcatgcgttgccacggaaagaaaatacgagaaaattgaattaaaacatattaaattctaattaaatgaaatacaaattttctggaatatttgggtattttttaaataggtagatataaaattaaaccaatttacaagtaaactaagtgtgagaaataaaatgatatggatggatttaatttttattaaattcttcatattaactacaccattttaaattttcttggaatttacagagcttaattgctaattttgctaatacaaacatcatttcagcatttatttaaataaaaatccttcttttctctatgggccatttccagcccatgttcttcagcccgcaagcgacaaaagtctaaataatattcccatactcctctcacttgccgtgcggcctgtaacctcaaatgtgttggaccaacagcccgcgtgcggcccaagtggtccggtccgatgatgtaggccagcccagcgaacgatcgatgattggacggctcagtcgattccaaatcaatcaaaaccctaaccataaccctccccctcccccgatcggctcgccgtcccccatcccccctcttaccgccggccgcctcccccgccggacgccgcctatcgccctcccccatcggcgccggctctcccctctaccctccagcggcgccgcttcccctcccctcccctctcccttctagcagcgccgctccctctccccctctccctcccgtctcaccggcacggtgcggggaaggcggggtgcggcggagacggcgtccctccccctctccctctcctcgtcggcctcgacagccgtccctccctctcggtgacggcgccctctccaccctcaagatccagcagcgccttcccaacggcggcgtcgacagcgacgacagtgtcaaaggcgtctgcgggtggatccgtcggcgatggtggcgactgcaggcggatctggcagcggcagctccctccgccgcctctcttctcgatccctccgttggcggtggcaacggccgaggagatccgacggcgccccgtggatggatccggtggcgacaacggcgttggtggcttcctggtgatgtttttatttttcttcccattctttttctcaatttcgattggattttgtatctagtttttttttgctttatttgccttatgatgcactcggaagataagatagatagattgaatcggacttttttttttgttttcatgtttttttcgccttttttgttattgtgaatgacggaaacgtttttaatttttttaccgcttcacatataatcgaatccatgccacatataattggattcgattttttttcacccttttttcacggatggacgatgaaaacacctttaattttttaagtagtagagatacagatagagattatctaaattggctgctccgatcctagatagctagagacctgaagtcttgaaattctgaagtgagcgggccaccattttgcattcgaatcgaggacggcggcctcagatgggaagttacgttcaagactccgagtccaattcttgtgggccctaatgtcgtattgggccgaagaatccctacttcctacgcgtggccgtagcctaacgatttctgtgctgtgggcctgggcttctattcccactggactataagacattgtgcacgcgcgctctctctttcttcctgcgattacaccgaagatgtgcatgcacaccccccgctaatacagtcatacacaagagttgaagatcagtgttaaattcctaacatcactacatatttctataattctattcaaatatactcgtgtgtataatattcgtgagcaggaagatttaaacttctcagtggagtaatatactcacgatttcaccatcacacaaccactcttcccttctgtgttatatacaaattaaaactgcctccatgtgaaggtaaatggtggataaaatgttgggtgaaattacagcacaagccaaagctatggacaaacgtggggctgtacatcgaagaaagaaatggaaagataatatactgtaatatgggctttacctggttggcttgacccaaattatttgtgggccctgattacatgcccattgtatgcacaatttatatacgtactagtagctctcaggtcacatctcatactacactaatggcaacttgtatacccagaaagaaaaatggcaactagtataagactggatagagtagaccaccacttcattggatgggttcttttgtagatatatatcaccattcagttcattttacatgaccaactctgcatttatcgtttgcagatttctgtatcttcttttattcttttatacttcctggtggacgatagttaggcctgaactttgtagatagtacaaaataaacttctttactagtaattagaactagaactcgatcattgttgtgttgttataaataccccgtcgtattgctgcggaaaattaagctgtataatatttataaataagttgtaatatattttgtaaaccaaagcaaaatgatgtcttatgttttatataatttacgcatggttgcaaatataatgcaaggtgaaattgatacttcaaattttgagcttaaaaataattgagattgtatggttttatgagagaagaaaaaagaaactatgtgtatatagatctatcattcgcaggttagaaataattggaatgatgtggctttatgagataagtaaaaaataacattaactaaatttagtgggatgaactatataagtatatatgatagggtttaacagaacggtcaaaccaaaatattggttaatctggcattgccttaatgatgtggtttttaaccataaaaatatataacattatgcaggttatcttggtgtgttataactggttgtattcttgatgtatgatgctatcatagaaacaacataatactatgtgtaattatgctaattagtacacatttgaaattggtaaccaataagcttttgttctagtttggatgatgtaataccaacagaatttcatattagaatctgtgtgattttaaaaacgttatttcaactgattattttattggtgaaagttaaaggtttgtgacgtttgtcccatcacgttattttttttagttcttttctttttacttccgagatctttttggttgtctgtcctttggtaaggaccggagacgtaattcatttcctctgtctaaaaacatattagcatcaaacaataatcaataagaggctaaactgcagttactgtactttattcatgattatgcttattttttgaagcctcgatgtgttccaaaatcacactttgaattttctatgtgctcggtgatgcgtgcctttcaactttttgatgcggatgtgacgaactaaaatttgacctgagttaacatacaagagatgatgcgccttatgtacatatggacagtagatagttgccggacagccccgctaataatgtactagtcctttggaacttttttgttaccagcacgctctcaaagcggaagaactactccggtggcaaacacactcaagatacatcatacatgcatccatttcgctaattaatttgttcccttaattggcactttgaatctaagagtgtgcggtttgaacattgataaaacctgcacatcagcgtgaacttgatagagtttttttttaaaaaaaataattaggcggtgaacttgatagagttagatcaagccttcaactgccgtgacaggagaggctttgtctctgtgcatgtccacgtgttatcgctttcctcacaattcatcgcactctcgctcgttgatgtactgcctccccggctcccccgaagtcagaaatccacaggggatcggagcacagtgtgtgacgcgcgcggcctataaagagaccccgagacgctgcccctctttccccgtgtagagttcagaagctcctttgctgagacagatttccgagtagccggcgaacgctttgccttgctcgctgtgtagctagcggagggcttggagcgatcgagcgatcgagcgcgtttgcacggggctaagcgtggaggagaggccggtggtgagccagcagctgtgcaggcagccaggcaggcagcaagctagcggccggctagtcgatcgcgcgcggctccccgcgcaatggcggcagggacagaggcggcgcgggactacggcggcggcgtgacggccagcgtcgtggtgacctgcctcatcgccgcctcctgcggcctcatcttcggttacgacattggcgtctcaggtatagtagctgcctccctcttctcatcgtatattctctgcgaatccgagttgatcaactaggtagaaatcaacctcttgcgcgtctcacccgggctccggccggtaaaacactaaaattttcgaataatcaggtgcggttcggttgggtcgggggtagggcagtagcattttcttgtaatttcgatgaaaggggatgggtagcgctgtaattagttttggagcgaagctgcgaagcgatgtttttgccgctccatctcgatagtataattttttggagcgattcaccccgctccgctctattttttggtggatctatcgtttggcacagctccagctctagataagttggggctgggagctagacctatgttaaacggggcgttaatcaaaacacacaaaaaaaaaatcctcatgtttgactgctccagcagcatgtttgttgatcttcgaaagaaagacgcattcatcaagcatatatcttattcttcctcaccagctgccttgatttactgacacagtaccctgatatgctaatgggccagactaggttggttggttgggaccaccgaaccatcctaggcaagtactattctgttttgggatttgggttgtggaaaaagccagatttaattatgtggcgctaaaagaaatacttgcccttcacataattttggaggccgggtttgtggcattttgcctttaacgtactgtcatgaggttcattttatcagcatttgggttccaataattaaggccatgattccaaaccaacaaaggaattacttcttccccttccaaagttagtgggtgataatatggtgtcacgccccgaactagtcccgaccgggactagcccgtgacgctccaaattaacctgttaatcgataccagtcccagaaaacagtgctggtatcacaggaagacagaatatcacagcaacagaggtctctttattatagagtaggggtacagtcatgttgggctgcggacagatcccgagcttacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaactgggggggttatttatatagagcaagggtgagtacaggagtactcagcaagccatgggaaataagtgtttaatgcaggcttcaaagaaagactattgtttttgcaattgattttatttgaactcttttctgaaacaacgaagtgagtgcttctcaaacgacacggatgagacagtgcgtctcgtccggtcggagtatgtgcaatgtttcagtcttttgaattgatcaagattggcatccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagagggggtacactttacccacacgacattactaacccggatcatccagcccgtgcagaacggccacgactagagaccttaaggctttcatgacaaggcatttcgaaagccgacacaggttcaccatatgccaacgagaggggtcccagaccaacaccagattaggtcccagaccatactgtgccaggaagcccaggggtcctccccgataccaccccggcgaatccacatgtctcttagtatcaaggttcccccgataagctagttactcagccaggggtgtcccattccacccatgtggtcgtacttgtcttatgttcggaggagatggattgaggagggagaacggggagatgcgctatcgtgcggacggggcgcagtgacgatgggccgacggcacgggagtgatctctccggccttgggccagggaagaggaggaagacgagctcccggagtccccttccgcgtccacgaacgcaccggctctcccggtgcttggcgatggacggcggaggcgagatagaggggcggcaaaggcgcggtggcgcgagcgaaacgggaggaggaattgatgggagggcgccttggtttataggacgacgatgtcggtttggaaaccgaccttgggcggtcaaggcgcgagctggcgctcggcgctcgcggccaaaacggtgacagagacggatgacgccggcggggaggggaaaaggaaaaaaggaagggagaaagggagcttgccccttgcctctttggggaaaaggaggagggagcgagggcgacgcggcagagggaggaggagctctgcctccgtcccttggaggctagcgcgtggagtggcggaggccgggtcgtgacgacggcgatgacggccgggcggtttggagcggagcgacgacacgggcggcaggcgcggcaggcgctgacggcggcggcgactggccggtcggccaccatggcgcgcgcgcgcgggaagcaacgggcggcgcagcgatttgggcggcgtcggcgggaaacggcagcgagggcggagggcgctcggctcggcgcggctcacgcgcacgcgtgcgcagcgcacgggcagagcgggggagagggagagagagagagagagagagccggggagggagggggagatgggccaagaaggattcggcccattgaacccgagggaggcgaaatagacttttgtggagggatttgatttgggaaggatttggattcgggatgaactcgatgatagatcgaggatttgagatctgagatggcacggacactagacaacaagcaaagaaacagatttcgcaattaggatttttaagagatagttttcccgctaggcgtcacgacggaacgggcgctacatatgggtgggtttagttcacaccaaaattaaaagtttggttaaaattaaaacgatgtgatggaaaagttgaaagtttgaagaaaaattttggaactaaactcggccatgtagtgtaggtatcgaatacttctgttgtttgattggtcgatcaaaaggtagatactaggttacccagaattcttctgtcgcgttcgcgaaaaataaacccagaattcttttgtcagagatgggcacacagttctacgttttccttcgcgccacaggcagctttagaactcatttgatatagaggatttataggaatttttgcgtaaattgaactgcttcttgtgaaatttatgtaaaattttatccttccgaaaggtcgaaaggagcccttatattgaataccgtagatatttggattgaaatcaatttctatttaaaaccattttcgctcctagctagaaacatctccatcctcctaaatttagtagcgccgcctaaagttttatcaagatatatagagaataaacttatcctttcagttggccttttgttagttggaaaaattgctctctagttatatatgatgtagatgtcatcgctgacttggtggataaggtgctcaattgtttgttcttattaatagttccatttgatacagagtctgatgcaaggaatattgtattatcagagtcactacatagtacatatctgggaatcaaatttgacttagctttaaaaaatccacaccatatatattgtctacaagataaagcaagatttagctaaaatattgtacaggtcaaaaataatcttggacatattcattagcaatttttttaagatcacagattttttttaaaaaaaagaaattgttttgtcatggagagctccaagcctccaaaaactagctaggctgtccttgagaggctacgatgcttgccagctgagcctgagtacctgttattttcaccgttgctagtgatcgaccgatcgcttgatagctctagctctagctagaatcttattccaatcgaatttgatcgagtttcattatgttgcttaacacggaagctaacaaggatatgtcaaaagcaccaacacattttgccaaaaaagcatgtagggaatcagatctgcagcaatgcttcagggacgtaattaacaccacaaattattcactagattattgaagcagattatttgctgatcactcgttttaagtcatcttttaagtttgtttttttctaaaacatctaatttatcaagtaaataatccgtcacaataatccgctaaacaatccgaaaggaaaacgacctaagctaggcacttcacaattatattagcaaacgcag

SEQ ID NO: 64791 - DNA, 53684 bp, Oryza sativa
tgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggtgagcttagctgccgctggattctgcctttggcattgccgccttgctaatttgctttcatgcgttcgatggaattcggcgagtaccgcgtgcgtggtgctagcaagtacgtgaattcatactactagtgagtaggaatgcgtgctttattcgacttggaattcggataaagaagatgtcctgacaccgtgactcggtagatctagatttgagctcaggttcatgtttgcacagtgaaggggaacactagtattgttatggaatattcttccatgaaatgctactagcacccaacattccctggagtggggataccagtttggattttgcgcaactttatcgcaagttgggtgataacatgaatccagattctactgcagagaatataagagatgctcaggtagatgcaaaagagagagccacatcataatctcacttgagcaagtgctccagccccttctgggactaccatgttatagacctgtcaacaagctaaattaaccacctatttaagcgtgtaaccattccaagtgctggcctccttgttaactattgaatactctgcaacttttcatgctattgtccacgctggtagagaaacacagttagtttggcctaattgtcagctatgtatgtgttttgtacatggcccaacaggctcttgttcctgtaatgtcagcctatagtgtaaatcttgctttccagctgaaaaaggaacaccgcatctgaattttgtttattagattcagcagaagcatgcaggcatctgtagtttgagttttattgacttggtttggcagtcataagctctgttcttgctctagtaaagaattgaagtttcacattaaaaaaagggtaaagaaattgaagttaacaatatctgatgctccaaagtttctgtatcacctatgtcaatgaaccatgacataatcttagagattaatgaattctctcatatgactggctcaccactctcaaaaataagattcttgcataatttttttcatttgaaacatattacaagtggcttgaccgctatctagcactccctcctagtcatatccaatgataactactttactttttctagccatgccttttattggttctttttgggttttcctagtggcaatatgcccctctaatagttatttattttaatcctttttttttcttttgttggatttcacaggatggagaaatatggacatttagcgtaagatcctttgaggcacctcccccagaacgaactattcatgtgaactacgaaggcttcgctgaaggttattttcaagcagatctcttctgttggtcttatttatatttctattcccctctgtaatgtgttttttgaacactacacagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggtaaattcactagcatggcaaatttgttgctgcaagcctgtaatcaaaaagtaggctgaatggttatgtcattttgttgcacaaacagttcatgttttacatgttactactgaggtcagcccaaatgaattacctggtttactcaaaccattgtgttgtaatagtgaataatatctgcatatattcgaaaaagtccaccatccatttcttagaaagctttatgtggactgttaccaagagttattgttgttgagaaatgatgattcttatttctgtgcaacttctgcaggattggcttgacatagactttggaatttctgaaggcgtagattttattgcagtttcgtttgtcaaatctgcagaagtaattaaccatctgaaaagctatatagctgcaaggagccgtggcaggtaagatgagtataaatactctcttcttgattgagctcatacctccatgaagctaagtacatggtttgatggttgaactgatggcaccatatgtatgactaatactgtaactatccaactcttgtgcatttgctgcttttggttcttgtccaattctgtggtaccagttgggtaagcttttcagtcagctacccctcagatgatcagcttagtatgaacgcactgtttttaactagttattacttaaatgttgagttagccataacttgctatagtgtcaactcttttgcaccaacaatcttggtttttattaggacatggtctctttgttgttagtttctccaatcaattttttcgatttgtagtagagccaagtggactatggcagtaagttctgatgtgttgaagattgtcttggttgctccatacctgttcaaacaaaaaaactgatcaatatattattttgtactgtttctagtttagatttgcagtagtgtagtaattcacttttaggttgctttacgtgtattcttttatttctagaagagtgaacatgattaataaaatgcatgaatttagatggcttaagaaaatggaccatacaaatatatcggtatagtgtatagtgtttatatgtcccaaagaaccaagaaatattacatatatttctattaaaaaagctaggcattgcattcccgaaatattagtttcctttttgctaacctttatggttattgtatattgtcactcatcagcgatatagcagtcattgccaagatcgagagcattgactctttgaagaacttggaggagataatccgtgcttcagatggtgccatggtagcccgaggggatatgggtgcacaaattcccttggagcaagtcccctcagtacaacaaaagatagttaaactgtgcaggcagctcaacaagccagtcattgttgcgtcgcagcttcttgaatcgatgattgagtatcctacgcccaccagggccgaggttgctgatgtttctgaagcagttcgtcagcgtgcagatgcgcttatgctttcaggtgagtcagcaatggggagatatccagagaaagctcttagtgtcctccggagtgttagcctaaggattgagaagtggtggagagaggagaagcgccatgaggaactggaacttaaagatgtttcatcttccttctctgacaaaatatcagaagaaatctgcatttcggccgctaaaatgggtaaccactgccaactctacttctattgttggactgctgctgtatatatgaatcgttttttcgctgttacttctttttgttattgtgcattgccatggttattatcaactcagactactgaattttgccatttgcatatctgggcaaggcctaaccacagctaatttgagttgcagccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaagggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagcccagtaaagattctttaaaaactccttgcacatcaaattagaactgagtagttttactttcatatggactttggccaaactagtcactaaccttttgagtgaaatttttaccttttttttttggacatgtatgtatgcagggtattagttgacctgatgtagccatgaatagtttttgcattggtacgtttgtttgaatagtttttgcattggtacgtttgtttggcatctgtcacaacccacaagtaggacgctagcaacgacataaaaatattttattggggcgtgaaaaatgggagaattatgttcgcaagagggtttgaccaggtagtcatgacattcttatgctaatctcaagtctcagccatatatcaaacatcttaatgcacactgcaacgtgttacgtgagtctcctgctaccgctagtctcccaagtctaccaaatacttgacccgtttttaaatacactcagtttgaaaccctccgttctaaattaagatgtttttgtttttttaccaagtcaagctttttttagtttgaccatatttatagaaaacataactgcgtttttagcacaaaaacaagtgtactataaatatagccagtaatggatttaatgaatttggtgtgttactacgtatttctatgagcttgctgaagaaatctgacttagaacaaaagactaaaacatcttacaacctagaaagtagaaagagtacttattagcatattctttccaaaatcaaaatttaacaccgccgcaaattttgaacatgatattctgtcaaaatattgtatttccaatttttttttcatggccaaattcaaaataacattgaaggtactaacaagtaaatgagaacgagatagtaaatatattattaggggcgtgaataaaaaagttgaacacagggttaccctactgttgtttgggggttaccgctaccccgtggttggcggttaccgtagtaaccacaaaaaaccgtgtaaaatttacctcaaaaaatttgaattaaaaaatcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcggttgcaatttttattactatactgcagtcaataggaacagtgtttgtactgcagtcaataggaacaatgttttgtattggcagctgcagcagtgcagccgctgcatataacagccgaacagactcaatattaattgtcagatatgctaatagtgaaacgacatatgtcgttggataaacatagattacaaaactacaggtgctggtaaatcttcatgaggcttccagagtctccaaatccaaactgagataaatcggtgaggagagagatgtgcaatactgtaagctgaggacatatgtcaatgcaattttgtaatttgatccttccataaaattcattatatatataagctcttaatttaatatatctttgatttcttgaaatggtcgcattgtactaccttctcaacatataagaagtttaggattcaatacggatatttaaaaaataggtaaaattcaatgatagtagattacgattgattgaaatgaggaaaactggtggaatgttgtaattggttatttactcaattttttatggattttttttacaatttttgaccatgtataataggcgggtttgagtcacgcgaatgcgtgacttcgtagcctagtgaaattgaaatttcactagaaaaaattcgaaaaaaacacttaaatgtgtgcataaattggggataattggaataatatatctaacttttggggtgtaaaatacaaaaattcggcattaatttttctatattatggacttcaaagcaattcaacattttatagcataatagcattacttgcatattgctaccatatttcacacgagcaacaaatgacccattattattacaataaatatccatccctaaacatgagcatatctactcacccaacaaataacatatcacctctacaaaaccattttccgcatcactagcaaaccatttttcacctattcacaaaatttcaaatctcaacaaacatcaatctttcacaatgtatttgacctaaacccaatacattttttctttttctaatttctaaactatttttgattttgccctcaaatttcaatttatattactctatttccaaaaacttcttcaccatctgccactaaaaatcaagaactacatccatgaattcttttgattttttttggaattttcaatttgctcgaatttcattcaaaccatatcgcggaaaaccgttactgtgccccgacggtaaccgcaattattgcgcgataaggtaaactctgattgaacgatgtagtatgaaatctgatactccatccatcataaaaatataacacatatataaggtagagtctctctacctttttgcttaaaaaatataacacatatatctctataagtgaatggtgaatcccaagaattaactaggatgagccacataatcaacaaaataatagccactggatccacatgaagacaaaatagaaagaagaaatctgagccattggattcactttatctagaaacttccttaacctactaaaaaactagtaaggttatggatatgattttacaatgtacacttttatttaaaaaactattttgcaaatataccctattactctatctatgcaactttcctttgaggaaaaaaatacaaatagatcattgacctatatttagaaatattcaacaaatgttgtgcatataattttacaactctcacggtttacaaataaacctcattttttaataaagattaatatgatccaactaagctttatatcattcaaagttatatatattagtgatgagcatatatatgtgtgtgtgatatgctgatgtaactattagttatgcacccattaaagatgttatgattaatcatcattacaaatttaagcttattattgctaccacaatctatagacatatttaatagagagggagtttatagttgcacaatgcacaacttaatataggatgaaccacataatcaacaaaataatagccactggatccacatgaagacaaaatagcaagaagaaatccgagccattgtattcactttatctagaaacttccttaacctactaagaaaaaacagtaaggttatggatataattttacaatgtacacttttaattaaaaaactattttacaaatataccctcttattctatctatgcaactttcctttgaggaaaaaaaatttacaaatagatcattgacctatatttagaaagatccaacaaatgctgtgtatataattttacaactcacacggtttacaaataaacctcatcttttaataaagattaatatgatccgactaagctttatatcattcaaagttatatatattagtgatgagcatatatatatgtgtgtgtgtgtgtgtgtgtgtgtgtgttgtgtgtgtgtgtgttgtgtgtgtgtgtgatatgctgatgtaactatcagctatgcacctattaaaaatgttatgattaatcatcattacaaatttaagcttattattgctaccacaatatatagacagtatttaaaagagaggtagcttatagttacgtgatgcacaacttaatatactagtatacttgagtagatacaacctaataaaagatttggtactatatttttttatagtactatatggtatatatcactatattttattttatgttggaggaagtattcataggaggatatttcatctcgaacctatattaatgaattgacctgcagccggtctgagtcgaaggaggtattcgtcatggactatgactccttctacgagtctcctgcaaatctcgagtctcagccgtctaaccaaacatattaatgcacactgcaattgacttctgttgctagtcccctctagtcgtctcgcccgtccaccatattagtgcacacgctcatcatgagtaatgacaattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaactttgcatggaagtgcatgcatgtgggctggggatacattaatgcctacaccctctattttgcaagttataaacattcatggaaattttagcagaaattaagactaaagtgagaaataattgtgattgcttgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcaaacatgaacatatgtcgaactgaaacatgcatgtgccctaactgttgggtgtgtgtgtgtgctgctgggatcgccactgatcggtgttcaatgtttcttaattatgctttccattaatacattatgacaatataatgatcagaactccagaagagtacttggctagcttgccacttgaattgttgtaatgtgaaagatcatctgtgctatatttatcatcaccaggattcaaaatgttggcctgtaactatatagaaccagagacccattacgtaaatttaaattaattgttcaaattttgaatttatatttaaagcttatttttccacacccggttataggttggtaattaacctcctagttgctgataattttctttttcaaaatttcagtttgcaatttcgtcctgtaaatttccggtaaccagcactccagcagtaattaattagccagttaccggtctgtgttttcttttttgttaattaaagactgtcatggtcgggattacgtacaagcgatgaagccagagaatagtgacaatgatcgattccatttgttttgattcagtttgtcacttgtcagcttgttatccttgagaagaccagtagcagggccgtcccgtcaaattcggaggtcctgtgcaaagttgaaggataacaacttaattgatgatataatatgaaaataatttatactctgtaatatatttcatagcaatctagaatgacctaaaatgataatccaaaattagggattaccggattagaaattatcagaaagaattagataggggcgcggcaggcgtcaggtggcacgaccgcacgagagaaagaggtgaggcgtcgtttactcctctcgttcgttgtgattggcaattggcgaggttcacagtgggaggcgattcaagattgtgaaccggtgcaactgtgcgaaccggcaaaggcgtaatcgaagccgaaacgacgagaaaaataacagattttcggaactagctgggctaccaatttacttattgagttgtatatctagtgttgaagttttgggcctaggggccttaaaaattgggggccctctgcgggcgagctggccgcacacccctacggcttgtttggcaacttgaaggaaggggattgtgagtttacacgagggaattgatggttagattaagatgggaatttgatttttaatcccagtatcttatttggtagatgttgtggaaattgatagggagtttagttggagattaggtcattaatgaaaacggatggctgagatttgtttagacaaaataaatgaggaattccctcctaattaccatcccctacccaggtattgaaaaggagggagttcctccctcaattccccatctccatcccaccaaaaatcctatgtatcccattcaaacaaagcagttaatagcctaatccctctaaactcccaattccttctaaaaactccctccaaccaaacggacggggacggccctgaccagtagcaaaacaaatggaattggttgttgctaacaaatcctgtaattgaagtacaaatgcgaatacacctagatgtacccaccttttatatgaacacatacatatacattaccaatgaatacacatctaaaagactaagccggtatattgaaaatatattgaaagtaacgaagtaataagagctttgttgtagtttggcacatatctacattagtgaaaagtaaatttcaagatttcatcacaatgagccacgtcacatattgattcagggccattggatcagaagcaaagaaaaggtgaaatgaatattaaccgtccgatgtacagagagaaaggcaatcaaaaagtgggattctagacaattccacgataccttacccagcgggagaacaaaataatctactactacttaaaaaataagaggtgcttccatcgtccgtcaaaaaaaccgggtaaaaaaaaccgggcagaaaaaaccaagtttgtccgataaaaaaaccggacgaaaaaaagtccgatccaaaaaaaaagtgaaaaaaaaaccgggcgaaaaaaacacccgtccctggtaaaaaaacacccgatcccttaaaaagggaaaaaaaaagtccgagagacaaaccgtttaatgaataaaaaaagcgaaaaaaaagagtccgattccctggagaaaaaaaatctgatttccctgaaagagatccgatctgtattggattggagaaaagaaaaaaaacacttctctaggtgcttctgtcgtccgtcaaaaaacgggagaaaaaaaccgagcgaaaaaaaaagaaaagtccgataaaaaaacctggcgaaaaaaaaccgggcggaaaaaaaacaaatatgtccgacaaaaaaaaaaaggaaaaaaaaggaaaaaataccgaaacgaatccgactacatcgacgcggtaaaaagagtttaaaaaaataaaaagaaaactgtcctattccaaagaaaaatgaattatatgtatcatggagcaaaaaaaaaaagaaaagtccgataaaaaaacctgggcggaaaaaaaccgggtggaaaaaaaacaaatctgtccgacaaaaaagaaagcaaaaaaaggaaaaaaatcgaaacgaatccgactacatcgacgcggtaaaaagagtttaaaaaaataaaaagaaaactgtcctattccaaagaaaaaggaattatatatatcgtggtaaaaaaatcgaccgggcgaaaaaagaaaaaaatagtccgatccgaaaaaaacaggagaaaaaaaaatgggcgaaaaaaaaatttgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatccgactccgtcgacgcggtaaaaaaagggcgaaaaaaatccaaagtaaaaggaattatatgtgacgcggtaaaaaaaatcgatcgggcgaaataaaccaggcaaaaaaaaatctgtccgatccaaaaaaagggaaaaaatcaaaacgattccgactccgttgacgcgataaaaaagggcgaaaaaattgtctgtttctaaagaaaaaggaattatacgtgatgcggtaaaaaaatcgaatcctattatatcttgaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaagagaagtttctacagtatattaaaaaaggaaaaaatgtgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagtaataataaaaaaaagagagagaaaaaaacagctacaacaacgaagcgaaaaggcggaatacggaagcgtggagggcggaggggtgatgggctgatggcagatgtaactaccttattacaatttagtcctacgataaaaaggattttaaaaactagcctcataagtacaaaatgtatatccatgttaattaaataattagccctatgctagggatataaatttatagctaacaactttagtacctctacatatgtgaaacaacaagcgttttaaaaggaggatgagctacatcatctacaatgatatggaccgttcgatgaactggtaaatgaaaatacaccattggatcatcatgctcatctatgactgtggaaacacgttgaaccaatccggatgattccagatcatcatgctcatctcaaaaagcagagaactcatgtgcttagtctatttaacaataccgttcaaaaatagtctttttaacactatacatatgtttaattaatctcctgactaaataaaggaaaaaacatatgacgtcttagctgtaaatttatattgaatttatatgcaaatttatatctataatgtacgagagtgtacacacaaatgctatgttatactactttttgcttggcattggaacaacacacaacaactaagtagcatccactacgtaccaattttattttaaaatagtccatacgaatgcacacacgcacaccctacagttaggagcacttagtgttattactgtctccactctaaaatataggtgcctttaacattcaaaatttatcctaacattcaaaatttatcctaaaatatagctatttcttcttctactccctcatcttaaccaacatagtcatatcctatttaatttcttcgcctattttctaatgtcaatcaattacaacgttcctccatttacatctctagctactgcatcattcccaaaataagtatttctataattcaaattttatatacaaatataaacatttctaagacactaatttcaatacatattggagtagctcgtgttcggaaaaagccaattggagtagctcaaattaaatttgatagtaagtgaaaaaagagatcattcctccttaatcttactctttactaaacaaactagaaatacttatatatagaaattaatgaagtatattagagaacaaagaaaataacgtacttacgaaaccagtcccttcaattaatatcaggatcaatggtctaattatataggtaggttatgctaacactcagagtcgcgcaaaacgcgactaagtagctagtctataattgaaaactaaatctagaactcaaactttcaaacttaattagataaaattatttcaccattaaaaaaaaatctaaccttcgatttgtactacgtacgtacataatccggatcatgagacaaaggtggtgttcttttcttctaaagatgaagatgaagattaagttttttatgcaaaacgatttggtattaacgtatgattaattgagttttaattattacaaacttgaaaaatagattaatatgatattttagagcaactttcatatataaagttttcgcacgaaacacaccgtttagcagtttgaaaagcgtaccacagaaattttaatcttcatccaagtcttgttggagaaaagaacgaggccaaagcctgttttctaaacattaatcatcaaaccatgtttttttttttgctaaaaccagtttcaaaaaccttgatcatcacaccgtccaacatgcttttccaagtttccagcgtctagtcaactttccgggttacacaaatcaaacaagcttttattattattttttgtcaccagtttatacagctcagtaatttacacaaatcaaacaagctttgaaaggatcaaagctcacagttaagcatttacactcgtctaatttggtccatttcttcaatccccgccattaatacctttgacttttttttaaaaaaaaatagacttcatccttgatagtactttttaataaatcactggagggatgagattcctcacaataattttccattacaaaggattgaagagaaacaggattctttgaaacaatataatttttttaaacaccaccataattgattggccgcgttataataagaagagtgcttcattttagagaaaaaacaataccaaaccttacaataaatagttgataacaggaaaactgtgctaaaaccccagacacgacctagctttcctaaccaccaagataggactagcaccatccaattggacgactccgacttccccagaaaaatcaagggaacaagatgtcaatagcccgaccgataccaacttctaactccctggacttaggaactgctccctccatccataaatatttgacgccgttgactttcttaaacatgtttaactgttcgtcttattaaaaacttttgtgaaatatgtaaaactatatatatacataaaaatatatttaacaatgaatcaaatgataggaaaagaattaataattacttaaattttttaaataagacgaacggtcaaacatgtttaaaaaagtcaacggcgttaaatatttagggacggagggagtacatccctatgtctatcagggtttaactgaacatgacaggtcgtgtacaaattcaagatgagaaatgaggacccaagtaaatgttggactagttcaagagatgtacattcctcttttaatgcctacactatcgcagcaagagcacatcgtaccaagttgaacaaaaaacaagtggcagagctctataagttcttaagtactccttgtcatgatgcatgcccccttcaatctcgatctgttaattaaatccatagaagagtgaagcctttatttttctcctttttcgaggagaagagtgaagcctttcaatctcccgttggtacgcttctccgaactctagctacgtcgaaaaagtaatgcttatcatttgattgatctcttattttgtacttgttgtgtatcacctcatgcaaaacgatatatcttggcctcaaaaatagttctttcgcatagaaaggctttatttgccaaggcaaatacctgattcttttacatttacagttataaaactgtcacgatagcggcattagtagacggcataacgctattgaagattcaaacttgacaatactgagacaatttgttaacaagatttagccaaaatctacaacccgaacttgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataactagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaatggaggttagcatcggcaagccagatgacgggcaatcgcttcttgctaatgttgaggcctccgatgaccatgccgcctttgatgccatggccacaagctcgcgccgtccacctagcttgcgccctctgcggcaccccaatgtgacatcccttgcaccagtaagtcacctcatactcaaacttattgatccattaattctgccatagcagacatgaacatgaaagggtgggtgagaccgtgtttagatgggactaatcttttaagtccctatcacatcggatgtttgacactaattataaatattaaacgtagactattaataaaacccatccataatcttggactaatttgcgagacgaatctattgagcctaattaatccatgattagcctatgtgatgttacagtaaacattctctaattatggattacttaggcttaaaaaatttgtctcgcgaatcagctttcatttatgtaattagttttgtaactagtctatatttaatactctaaattagtatctaaatacagaaactaaagttaaagtccctggatgcaaacaccacccgagtcattgtcgtttgtcttctttacagttgccaccactccatcgctgtgtaccacgacaaaccgaggtgatattcccgccacttgactcaccggactcctccgagctgaagaaggttatgtccatcagcctgccagcaacaccaaccggctttgccgcacctgttgccggtgccagcgactcgtcgggcatagatctccggaggcaagccatggcgtcgaacatgacacaaaggctacagcagcgctcgccaacgtcgcagagcaacaacggccggcggctcacagacgagacaacagcgttccagtcacccccgcctacccccggtggcggccggtcgtcgatgagccgggacaaacgctatgattcattcaagacgtggtcggggagactcgagaggcagatcagccacctggcgggcatcgggccggacatcccttcacctgcagggcaagtcgtggatgccgccatggatagtcaccaccattctcacactgtgtccacgcccgaggttggccgcttctttgccgcactggaaggccccgaactagaccaactcagggtaagctatagaaaaataaatgaaacaaccaaaaaataattcatatatatattagcggtttaaaagccaatgctgaaaaataagctacaactcgtatagtcggaggaggagctggtgctgccggtggataggacatggccattcctgctgcggttcccggtgtcggcgttcgggatctgccttgggatgggcagccaggcgatcctgtggaagaggatcgcggagtcgccgccgacgacgaggtacctgcacgtcgccgccgacgtgaacctcgtgctgtggtggctctccgtcgcgctcacctgcgccgtctccgccgtctacgcctgcaaggtggtcttcttcttcgaggccgtccgccgcgagtacctccacccggtcagggtgaacttcttcttcgcgccgctgatcgcctgcctcttcctcgccatcggcgtgccgcggtccgtcgcgccgtcgacggcggcgctcccggcgtggctctggtacgcgctcatggcgccgatgctgtgcctggagctcaagatctatgggcagtggatgtcgagcgggcagaggcggctgtccatggtggcgaacccgtcgaaccacctgtccgtcgtgggcaacttcgtcggcgcgctgctgggcgcgtccatggggatcagggagggcgccgtgttcttcttcgccgtcggcgtggcgcactacgtcgtgctgttcgtgacgctgtaccagcggctgccgacgaacgaggcgctgccgcgggagctgcacccggtgttcttcctcttcgtggcgacgccgagcgtggcgtccgtggcgtgggcggccatcgccggcgagttcgcgctcggcgcgaggctcgcctacttcgtcgccatgttcctgtacgcgtcgctcgccgcgcgcgccgtcagcctcttcggcggggtcaggttctcgctggcgtggtgggcgtacacgttcccgatgaccagcgccgccgccgccaccatccgctacgcggcggaggtggaggacacccgcctcgccagggcgctctgcgtcgcgctcgccgccgccgccacgctcaccgtcggctgcctcttcgccaccaccgtcgtgcacgccgtcgtgctccgcagcctcttccccaacgacgtcgccattgccatcaccgaccaccgcaaggtgaagcccaagcccaagcccaagaccaccatggaggtgcactacaagatggatggcaatggcgacatcgagggcggtgctcctgccatgacgccatcgccatgcatgccgatggcgacggcagcttagaggatttcttttcttttctttttgacctgccaagccaacgcgtccacatgcacatgcatggttttagcggtttgaatttgataagatgaatatttgaaatacaaagtgcctatgaaaatttatattgttaatattttttgagtaagttgaactttatgtatctactagaagatggtatgtgctttactgttaaatactccatccgtttcaaaatatttgacgccgttaactttttctcacatgtttgaccgttcgtcttattcagaaaaaattatgaaatatgtaaaactatatgtgtacatgaaagtatatttaacaataaatcaaatgatatgaaaataataaataattacttaatttttttaataagacgaatggtcaaacatatactaaaaagttaacggtgtcaaacattttaaaacggagggagtatatggattagatgactatatattaaatgttatagaaatgataggtaaaatttagtttaatatatcgtgaaaataatgtaagtaatgatgatttagcatgtttttatgttgaactttaaaagataataaatcataaatataatattatagttttaggtgtttaatgggtaggaactttagagtaggtataagtttggttacatactttgagcctgtgacgccctagaataatcggggaaaaaaaaagatggagcaggcagcagcagctagctagctgtagctggcggcccattttgctggtggccttgggcccatttgcaataagcataaataaagcggaaaaagttcacttcagttccttcatctgtcatcaagcttcaaaccgttcctaaaccggaatactaaatataatacatccattatctttcaaaaccgagtcacactaaaggtgtgtttagttctaaagttttttttttccaaactttcaacttttcatcacatcaaaccttacttttcagtcacatcgtctccaacttcaaccaaattccaatctaaacacagcctaggtagtaaggcaatgttgcttccggttttaacagacgtagcactcttaaagcaaaaattaaaaaaaacataaaaaaccacgtgggatccgcatgtcagtgaagctttagacggttgacttaagtgaacgagctcctgctcgcgcatcggcctggcgcgcctctcctgctctgttggaccgccgcgcccagagcgctcgaccagtcggcgggcgatggtcgccgaggtgggcgaggaggcgggcaccgcggcggaatcgcatcgggagcggaacgccatcgccagccgcatccgccgcgccgacgccaccgcagcgcgtcgcccctacatcaagtgcaacaactgcggtgatgtccgcatcgtcaagtgtgaccgcgccctctcgacgactggctccgcgacgacttccccaaccaccaactctgcaaggtgcttggccccgatcgatcgagctctttttctcgccgctcctctacgtctaggtacagtacaggcctccatccatcgatcaacagtttattcagcgcatatgtttttgacccaaactcatctacgtgtgaaaattgaaaatcgaactactgattagctgatagttggagagcctatggggattcttggtgaaaatctatgcaagcttgtgtggtacgtcgcaggtgctcaacgtcgcctgaggcggccacccggggcgcgtcctaccgagcacaccgctgcacgagtggttctcgcggagtcgctcgacggcgaggataaccagctgatggtgaacagctaccactgcaccaccagggagggcgtgcaggcggcggctggcggagcggttcgtgccgatggcgttcgatctgcgctccggatgcgattctgccgccgcggcgccggcctcccgccacctccgcgcccatcgccgcggcggtcgagcggctgctgccgtagtcctcagcggtgcgctaggccgatgcgtggccaggagtgagttcgttgaagccaaccggctaaagctccactggcatgtgggttctatgtagttttaattttttttaatttttgtttttagtgccacatcagttaaaaccaggagcttaaccacttaaccactcggatgctatactaagatgaaataattggcctcactctcctttttttttttactatggtttagctaaagggccatgcattgcaatggatactataagagataaaagaaagtaaaattacaagtttatagtattggtatatttttagaggggttgtataggtagttaattagtcatataatgtcatatccaaaataaaattattcacgtgtgagaattttatgctgttagcttataatgtcagagacagatccgaacatcatcactaacattatttaagatagtatagctaccgagagtctgtgagtcttgactagcttgtgagtaatttttagagaaagtaaatcaatttactaggctgtgaaaaaaaaacgagcaagttaacagaaagtacacgcacgaggcgtcgacatacacggacgtatatacgtagacgtcgcggtcgtatggccgtacgtctctctgtattgcttctagaagcatcctcaagattggtcagctgctcgtctcaaccgctgctaaacgccgccaagctcttgactttcgaatagccgtactccctccgtccttaaaaaaagcaaaccctggttttcgtgtccaactttgactgtccgtcttatatgaaatttttttataattcgtattttcattgttgttagatgataaaacatgattaatattttatgcatgacttgtctttttaatttttttcataattttttcaaataagacggacggtcaaacgttggatacgaaaaccagggtttgtcttttttttgggacggaaggagtatagtatatgatcattggtcttttctatcaatcgattcagattttttttattgtacttaattattgtttttgtgattgtacgacgtcgtcctagccattattttaaacagttttttaatcctactgcctctacttaaaaacaaacttcattcgtggctataaatctaaataagcacttgtccaaattcctatccatattcacgtaagtacaagaatcgatctaagtattgaagagaagagcggaaaacctgagtaggtcttatatgtagacaaatgacattagtacattataagaagttctgagtatcatgacagagtcaaaattgtgaagataatttaaggctcctttgaaatgtgggattgaaaaaaaaacggagaaataaaaaaaacactgagttttgactgaaatgcatgcaagtataagatagagattgtaaacacacgtgaaaaatataaaagtagttgtccgattaagccacatgaaaatattaggaattggatgaaagagttaaaagaagttagagctcttcctaactctccttcaaaatcttgagatgattgtgcattccacaagaattttaaacaaaaggttagggttcaaatctttgtttttaatagggattttattttcgattatggttaaaatacaccaaatttcctttttcttttacaaatcaaaggtggcctaagtgccgggacaattgaatttggatagtggtatatacatatactgtaaactaggaaatcataatgttttagcacttcctgaagattgatcagattttttttatggtctctgttcatctctcgaccattaattattcgttggtcgtcccaatctaaaagagacgtcaatattgaagttctcgagccccttaaaatgtccctaaacaataaatagtgtttcttataaatgtagtatattattccttggaaaatatgactaacttagttagaaatttttttaaaaggagagatatcattataaacgaggtaaattgaacgttaccaatcattagaggtataaaataagccaaaatagtttggggttgcttcgagggaataaaatgaatttttcttacaaaaacaaatcaaaacagaaatcctttagaaaacttaattatttcaggtcggcagtgacaatgcaaagcatacaacaaacagctgtctgcagcgacagtcaaaattttggcttttttagaaaaaaaaaaacgtgttcctttaattttgagtggtaagagtcatgggccctgtttggttccatgggctaaacattagcccccaccttttagccatgaattggccctcaagtatccaaacatgtgggctaatttttggttaaagtgaattagcctccctccaaacattagcccctccaaggggtgctaatggggctaattttgcatggggaccataaaaaggcagccctctctctccttctctctcctctctttttactctctctccaccttttagtcttgaattagcccatggatccaaacataccactctgggctaatgtttagcctaccaattcatgactaaacattagctctcaaaattagccatgggctaatcttccaaacaagcccatggaatagaagcttctttgccggcaaattaaatggtcgttttcgcacacgtgcaaacgatgaatcacgtatagtttataagttaattactttcttggaggtatgaattaattattgcataggatcgatggcgtggtcgttgttcatgagaactgagaaagtatgtgggagcttaagatgtgtctagcgtgttacacaggcacaaaaggtatcgtttttggcattgtaaagtaagtaagtcataatttatattatgacacctaatgtttgtaccaacatccaaaaactattgcataaggacaagggttagcctctaccaaaatttaaattttaaaagtaatatattttatggtattttcaacgtagattatttttactttggatttttaagttgctaagtactcctacctatagaaaagtttaactcataaattattatttaagtcattaataagtcgtttatttataatcggctcatggacaaccaataggctctaagaaagaaaactccattttacttcctcaatctattcaattaaattatttaaccctttcaactaattaccccctaaacagttgaaaacacaattcactttactcttaataacatttctctttctcttacttttcctctttatactagtcatatataagctgaaattttgagagccgtagatgacaccatattatcaaagctcaaaagtatttcaatttttcatgactgattgctttttaaaaaatatcattgtttgaattagtctttggttctttcaacctatataaacagtgataataaatttataaaatgttgtgatgcgagttataatgcacctatgatcgtaccaaatttcagtgcaaactatgatttatatagaaagagaaaaaaatggaaaatacaactatggagtaaaatgaattgttttgaatggtttgggtgtaaaatgagccaaaaatagttttggggttaagaatattttgagagagtaaaatatactttttttccaaggacaatacctttttcatatgaatctttttgttataacaaacttggctactttctatattaaggatagactctgcaataaataggggcaaacaaggaaaaccatatataaattggtatgcatgctttatatttgaaacaagatgagaaaaactatatgccttatagaaagaaacagatggggtacatacatttgataatgttttttttatgacttggacgagtagtggctaagctattttgttatttagttgctaacctttcaataaagcatgcaaaaagggtagttgcttgagatagcgtaccatgattaatttatgtatatgttttttagcatatttaaaggcaaaaaattttcatgcatttgtgtacgtaaaaatcgcaatgttatccatgtcatttcacaatgtttatccctaggcaatgtcggaagtatagcaatattactaatactccctccgtttcatattataagactttctagcattgcccacatttatatagatgtcaatgaatctaaacacatatatatagctagattcattaacatctatatgaatataggtaatgctagaaagtcttataatatgaaacggatgaagtagttgtaatatgcatatgctgaggaaaactacaaattgtactgtgagatttatgttccttgatggcatatcaattaattaaacttagctatcctttgtttatttgcatatttgtggagtgattgatggctccatagtatatgttgtcaaattttccatgtttatttagatggcatgcatgcaagaaattaacaataatatatgatcaattttaaggtctaaaaagacttctccatagtgataatagagctgtaatgtgtgtgagtttttgtccaaatgcatatggaggcatgtagacattcatagaaaaagttgatgacacaaccaatttagcattttagccacaaaaccaaaattctcaagtcagaaccaaacagccgacctaggaaactaagcccacatctaatggcgccatgcatgaagataagatcagaaattaagccatatacatcaaacccacacacactgacacagacacatttgcaagaagacatgaattgcaacatacactttaacttgacacaaagctatccataatctctctcccccatctgtaattaatcaaaccaaaaacctctcattatatatccccgataagatatcatcatcacctctatccctatcaagggcttagcgtgggagcagatggctttgtggcaatcaaacaaaggctccaaaaaggcattgctttcatgagggagaaggttaaaaaaatgaattttacattttgtggagtgaaagtggtgtgtggacatgtggctggtgaggccactgttctcccattcatctagaatgttgaattcccagcatcctatttatgttgaaaaatagataggtcgcaatcgcttatacgtgtatgcataatattatgtgtttgcaaaacctatgctccatcaagatcaacctcaaaaagaaatggagacattgttatcctctttcttttgtacactctctctggatttattgattatccacttgaaaattttgtaactggtagcatatatccaccattgtaaacatactttctactttgatagatcaaagttgtggcaccatacaagtttgcactccattattgacccactgaaatgtgcaataatgcaaattcatttatgtattcatggatacactactctattattgacttatgtgttcatacctgaggtaattgttatttgtgcaaaattataagacaattaattaaatggaaataaaggacaaaagaaaggtgacaaaggctggaagaaagtagaagcattctttagagctaaggctagcagtatcatctgcctgctggtggagctcacaatctatacatgatgcattcaataagccctttcttgtcctgcatgctacactgcatgtgggcccaggacatgttatggtcatagtgaccccactattaagtgcaaatgaaagtgacctttcatgacttttgtagtactgctatttcatttgagaaaaggctcttggggcaaatcatgcatgcatccttcatgatttccctaccaaatcactacactgcatttatttgagaggaaaatcactctacatgtctagtgttgcctttgtatatgtgtatggttagtgtaataatttatctgccaatcatcacaatgcacttacttgtactgtagttttctagggcttgaccatatgaaaggcattcttcaaccactcaagtattcaatatatacatcctgaataataattacttgggttaccaactggtacatactggattcatattaaccaaagtttaccttaattttctttgtttttttttgaacgaactggtacaaggtggtgcaaatgtaatttaatagatatctaggaaaaaaactttctatgcaagtatgaaaaggaaaggtataaaaaggaaaaagttctatacttaatttttattaatgcaacattaccttctgaaactagatcatttatactactcactctgtcccaaaataagcgcaaccagtttatgtgtccaattttgatcatccgttttatttgatttttttataattagtagttttattgttattagattataaaacatgaatagtactttatacgtgacttatgtttttatttaaaaaaacaaataaaacggacgattaaagttggacacggaaacttatggctgcacttattttgggacggagggactatatatcaaattgaacaacaaaaaaaaatgttcattgttgtgatttttcatattaactaaactgatctaaatcttgcaaaatcttaatgagagcaacattgctgctgactgatgagagaggtagcagtatagcactgtcttctttttccttggaagtcagctgtagctgatgtgatcttcccttttcaagctgttcaatttgtagggcctgatcttccctttgattgctatgcacattgcaatgttctgaaaaacaaaattatggtttcagaatgtctatccatagatcctaatactgctaggccttagaacacttgaagaactacactcatgcttataaggctgtgtttagttcagctcaaagtttggattttggttgaaattggagatgatgtgactgaaaagttgtgtgtgtatgacaggttgatgtgatggaaaaggactgaagtcagcctaagttacaatgatctttacagtgatcgatctgcctttcttgctggtgcaacctatgatcctctacctactcactacaagtagttcctttcaatattttttggagtataataatctaagagcctcgatgtttgccaatcatccaccaccaaaaatttattttggagttaattttaagttatttttaacgtagttacttttttagcgttagttttaagttgctaaaaatctggtttttaaatcttcggctatagtagcggttatctccagctatagctatttgagaagggtctaactgtttggtctcatgcacaatttacctactatagtttcatttagtccgctataactgtttgagaaagccaatcaaaacactgctacaaacatatatatgcataaattttactcagaaattattttttattgctaataagctgttttggcatataatcagcttttggccgattgatggggctgtaactatgatgcattgatctaatgtatgaaacgcattatacttcacagtaagttaaacaaaccaatattgttgagtttattcatcgacattttttttaataatgtattttataaaacctagcctctacaccaatccaacatgagtgtatacagccacttgtgcatagacattactattaattagttagttcatatccagaaaccagtcaatcaagcagaagcagatcatttcagataagggcttattttaccagggcatgacgccaatgacggcaggatcacactaaaagttctgaatttcttaagacagattagcaaaccagttgtcgacaacgtctttactcagaacctgacaaggcaaaccatgtgtagagaactagagatgacacctctatcaaaccagagttaaattaattaccataaagttaaactatagttatggatgcgtcacgcatgctcaaactaaaatatcctatgtgaaattgccaaaaaaaagtatattaaattaattataaatattattgctacacgaatggatgtgataacatctctatataaataacaatcaattaattaccattatcaatggacgtacttgtgtaagacaaactccccaaatatatgatttggtgtaaattattaacaagatgagatcgtcatagaatatgccaaacttgtactacattaattaattaaactgtctacaaattaatggtgacacattggtccacaagaattgaactagatagtcaacttaatcgcgcgcaattcctttccatggacaggaaattggaataggtatagtactataattttaagttacaaattaagatgagtactgaataatatttgcaaggcacgaatggaaagcgacacatatacatgcaaaactgattttggaattatcttttcggaggatttggatacgctaattatattagggagttacctttcgtgttatcgggtaattaagttccatgaagtacctaacatatattttaacatgatgcggaggccagcttggcgcgtgaggcgcgtccggtggaggaggccggcttggcgcgagagacgcggccggcggtggaggaggcgacctaggtgtgaggaggagcagccggtgggtgtggtgcggtcttcggcgcacgaaggctggccggcgggggacgccggtgcaagggtcccacatgtcggcagagcttgcgtggtggtggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtcatgcttagcggcggccggtccggtgttagtcttctcctggacttgtgtgttggcaatgtcggtgtgtgggtggtggcatatttttttcctggttacgaccctccaaggttgtaatcttgtattttttttctgctctatcaatagaactttgcaccatctcgtgcaagtcgttcaaaaaaaagactagtttacagtgatgggggatatatactctctacatgcagacttcctcaaactattttttaagataataaaaatgttttacatctacatctccaacctctgtagttgcgcacacaactgatgagtttgaatacttcaaaaaaaatgaaaaatatataagaaacaaattggtgggacaaacactcaacttcctcaaaactgaatagaatatatagtgaatattttgataggactatagttgggatttagattcaagtaaaaaaatatgtatatttttctagctttttattgttactagagattccctgttttcctctttgttttatgggggcaaacttggacagtgtcaatgacttacacctaaccagcagttgatgggagactactacatttttttgcagttggtctgtcaaatcattttaggttgtgatcgcctaaccaatgcagcatatacccatcaaacaataattaagcacacatcatcaagggaaaagccagtagttacacaactaaatcattatcccttttgcttatccattaataatgatgagaaaaagaagtgtgagtggggtgttgtctctataatttgtgacttttagtgagtttagaatgcatactagtgtccttgctagtaaaaaagaaaaggacagattagtgtttaacatgtttgattatatatggttcaaattaaatcactcatactactgtggactgtggcgtgtgctttgtacgcttattttaaaaataaagtctatgaatctcaattaaagcaagccattgctgtgcatgttttgtgagtgcaaatctctgctttagctttaaaaataaatcaatatctatatataaccttcaatctaaaattttatcatatgcttcatccagatttgcgctcacctaatattaactaccttgacgcgaaagggcctgtagcctagtggttacaagagtctcagtagcacctgaggtcctgggttcgactccccatgggagcgaatttttcaggatttaacggcgttgtgctttcagtgataggcgacgtacccgtcgacagcgaggcgcctgtggtgacttcgtcaatctctccagaatttgccggccaagtcttcgaagatgctcataggggtaaggtttgcgtgcgtgtgttcataggggtgagtgcgcgtgcgttgtgagtgtctgcgttgtactgtgtaattctcaaaaaaaaaatattaactaccttgacatgaaattagtagacttttgaaaagaggtgtaccgaagcaacgccctacctgcacaaaataagcaatgtagtatatggagagatcatggcaggatgaacctagctaccagtcaagtatctttagggcatcaattaattcttgccttctattatgtactttactctttgagaaaatcataatatagttctgttttggactaaggatttttttaattagtttagttatgcaaaatttaacattgtgccaaaaacatcttctcaaccttataaacacaaaaagtccagatatgaaggccaaatggtgcaaaatatccagataaggaaaatatatgacttacgtgtgatccaagaattaggcccaattggaatatcgtgcagttccttcgagctgttcacaaattagaagacagagcagatcatttacgcataattaattacgtattaactataataaatttgaaaattattttttaaagaaacttccatatagctttcttgaaaaaacaaaatattgtttaccaatttagaaagtatgctaacgaaaaatgaaatattgtttcggttgttcaaaaaacttagtcttacttcggaaagggtacacaaaactagctaacttggttagttgggtatacaacgtaatactagcatatcaaaccaaaaccatgggtttcctaaagtctagctaccggttttcaaagggacaagaagttattagtgaatgatccatatcaaatcattgtatcagcagataggtgcaaattaccactcttagctaggcctcattctcccaattatcaactctgtggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaagatgtattgtgcatgcaccagcacctacctgaagcagacaccttacagacagaacaatcaagtggaaagggacaaacaatattcacaaggtgaccataatgatgcgatggtttctcttgtagttccattggaaaaaaaaacataaaaatcaaaaccggccatattgtcaaagtatatataagcatccatggttcatgaaaactagcaaggggcattaagaaaatgaatttggacaaataggtttaaaccatactctttgcgatttttttagttaaccaatgattctttaatttagattccatgtgtaatgtataaatcatcaaacaaagttatttacgtcgaacaaaataggaaataactagggtaacaagccattatttacatcgaacaaaatagaaaacaactagggtaacaagccattacttgtatcaagtaatcacgggaacaactgtaattggtattaaaaggttgttgctattgatatttcacaagttctacaaaacactaaaatatatcatgctatccattcactcattcatgtcctgaaaaatcaaaatgtggtgttgtagctgataaatccaagcctagaccaccttgcaaccaatccaaccgctgtccatcccagcaaggaaaatgagatagtgttgctatcaaaagacaaaaaaaaatgtaccaaatgaaatcataaactacacagagaaaaccatacgatgtatctggacatgtacaccacacgcgagagtagaagatcccggaaagcacgtcatcaccgctctttggtgcgcgctgtgcttgtaggacggttcaccaaaatgttcttgatccaaaatgggagataacggttttcctaatgttataaaaaatgtttaaaaacagttgaatcccaacacaatatgatcaaattttaaatattagcttgtattttttttgaaacttaatcagaaaggagccaacgtcaaacttcgaattttaaaacttaattttagagttgatttgatgtttttttcggcgtagtttttttcggctttaacttttaagttgctatggatggatatacaaaaattttactcacaatttttttctcagtaataaactgttactaccttataatcagtcataaactaccgatgagcacggtcattccggggggatttgtttttggccttttggaaaaagaaaaaacgccgatccctactgagcacggaaggcatcatcccggccgcgatgcgcttgtggccgtgtctgtggcttcctgaggccgcgccacgtgtacttggtcgaatcggcccggtccaaccgaaagcgaggtgggcagtgtggagcccaccagctgggccgggatgaactgtatctttttgggagggtttgtttgtgtagaactgtagatcaatcagtgggtttggcttgtgtacgtaagcatcaaattatcactgtcaaatatatacgtcattgtccagtatttaattagttagtaaaattttaactagtctctcagtcccaaaatagttgagaccagatgtgacacatcatagtataataaatctagatataagtgtgtctagattcatcataatatgtcaaatccgataggaagttgagtttattttagaacagattgagcagttcttaaaaaaaaagtacactttgacgtgtgacagtcacttatactgccagtttaatagctccaacccacacaatttttttaatatgttgtatagagtttgtaggctaaatcagtggttattttactgattttgctagaaagctgctaatattttttcctctcaaaactaattttcagtttgtggccatccagttgtcgaacccggaatccttggtgggaagccacgttagccaaccaaccatgagtaatttttagctgaatttacactagttacatatcgtatatctacaatataagtacactttaattatattatagtatatttgatttaaaaaaaactgacgaatttgtatagctaattttttaaaagacaaatcagtggcttcgaaccactatttatgttcttccataataatcagatgatggctcaccaataactttgtctaacctaactctatctcaaaaacctagctctatctcaaagaatatttagagctaagataccaataaacccaatgaatactttgaggctggttgtacgatactaccatctccattctaaaataagtttatttttcacttatcccacacataccaatacaaaaccacaaatactataatatccctacttattaaatatctcaatgcaaatatttctcactttatctactcccaacataattattttcttttttataaactctaatgcaatgattattaaaaataaacttattttgggataaataacaggagctaatagtaaacttattatgagatggaggaacaggaagactaaattaaactgaaatgattgtgctttttttcgaggaatgattgtgcgatttttaaccattattctaactgttaatgtgattttcaaaggtacatttgaaatgaagtagttattaacttatttatatatcaaaataggcagcgatagcgttttcagaacacgacagttattacaatatcatagtatcacgtgaacaaccgtgatggttgatatgaccactaacttctatatagcatcgatatatacattttttattattttgaataatttcatatggtttgtttttttttttcatgttggatgtttggttcttaccaattaggaactatcatcaaaattgaatatacttattttgattggtacaaaactgtcgatgttttatatataaaagtattgtactgtttttttctctgtgtagctaattttgatattcatattaagttatgctataaatgacataacagaggcttccagtttttatagcaacccctcagtggccacttttttttaccaggcctccaaagccatgattattaaggcgctatgaatctcgaaggaaattcataggaattttagagggtttcattcatatatgattttttactatatagccctttgaatcaaaggaatagatcctatggaatcctatggaattcctatggattgtcttttcccatgcaagttttgaaggaaatttaacatgaggtagaacctcatggaaagaatcctttgtgtctttatctctcctcgaattcctgtgtttttcctgcgacccaatcaaacagtcattcctatgtttttcctgtgttttgcaatcatctgttttacacttgcattcctgtcagaatcctatgtttttcatattcctctgttttttcattcctgttattcaaaggggccctaagggcttgcttgtttgtgttgtggcttataattttaaattttagaactttatttttaaaattaaattaaaggttttgttttataagtttattttcatttgggtttgactttttttaatgaaacacattacaaacgaaaacgctcataatatgtgcacactcacatctataaatgcacacacacatcctactcctatgagcaccttgagaagattgagtccaacatgatgaagtcaccacggatgtctcgctgttgatggatacgtcacttaccactgacagaataattagccgcaaatgtgagcacccatgtcaattttagaacttgaacccgactaggttggtttcagcaaaataaactaaccagttaaattatactcacttcaccttttgggtttgacttttgaccgcatatagcagaaaggcaaaagccttaatttaaaattacaattttcgttattatagaaaaatatattgaaaagtacaaccacagagtttataacttatttctatatatatagagagtaataataacatagttaaaatgtatacttgcatgtttaggcatggcggataataaaaataaaaaataaagcccaaaaccctatcgaaaagatcaaggcaaaatttactacagaatacttaaaaaacgtgtaattagttgtgggacaccgcaaatatgtgaattggctataggacatcccaaaagagtgataattagctactaaacaccggagacattattttatcatttctggtggaaacggagagaggaacaatggaaaaaggaccagatttccctatgtgagccaaggatgtcagcatctccactattttcatgtcctcttactcctgatgaggcacaccacacgcaatacggcgccgctgacaccgtccttctccatcacgccggcaggctcgtacgcaaacgtgggtagggcatcgatggcgtgataattagctactagacaccggagacattattttatcatttccggtggaaacggagagaggaacaatggaaaaaggaccagatttccctatgtgagccaaggatgtcagcatctccactattttcatgtcctcttactcctgatgaggcacaccacacgcaatgcggcgccgctgacaccgtccttctccatcacgctggcaggctcgtacgcaaacgtgggtagggcatcaatggcgtcgcggacactcacatcgtgcccactatgccacgtcacgctctccgcgcgcaccctcgccgccctcgccgccgcctgcgcacagcgatgcagccgcaaccggcgaggacggcgacgccaatgcaaggcggtaggtgctgcatcgacgagaagtggtgctattccatcggctccttgccgtggccgccagagccagtgcccgaggcagcggctgttgctcggcttgctcctctcgccttgcttgcgcctgggctagcatctgatgcacctgcaccgccacagccccagacggcggcttcttgatggcatgcgactctaacacaagcaaacgacacgggggtatgttggtacttccagcgctctttctctctctgtttccactagaataataaaataatgcatcaagtgtctagtagctaattaccactattttataatatcctacagccaattcacatctttattgagtcccacagctaattacacgttttctgagggtcccgtagcaaatattgccaaagatgaaaaccacatttccatcagcgcgcgaaatcccaatcctacccctgcacaatgacatccaccgaggggcaagcccgtcatttcagctgcgcccacggagtccacttccccctcctcccccacaacggcgacaataccgtgagccacccgccgggcccacctgtcaacgtcccctccacccactacgccacgtcacccccctcccgcctttataaaacctcgcgaacaaactcctcgtcgtcccccctcctcctcgtcgtcgtcgtctcacccaacgaacttttccggcgaactccccgacgagatcgatggccgccggcgaacggcaatcgaacaaggagtactaggacgcccttctttgttgtttcttctcggcaagatcagttggttggcaccacctgccattcttggtttggaagtgtgggagggaggggttcggttggtcgatgccgttgcggttgccgtgcgcgatggagacgaggccaccgcgggcggcggcgccggcgccggcgagggtgtcgaggttccggaggctgcttgtgcgggtgtccgcggagccggagcgggcggccgtcggcggcggcggggaggtgagggagaaggaggagaaggcagcggagatggaagtggggtcggtggggttggaccggatggtgctcagcttcatggaggattccgccgccgccgccgtggagcggcccccgcgtggccgctgcggcagctgcttcaacggcggcggggacggcagcgacgacgaggagttcgacttcctcccctccgactcctccgccaccgccgccgcttcggccgccgccgccgccggcgacgccctggacgcgttaaaggtatagggcctttttccccggctcgattgttgtttccaattgctcgccggagtgatcaacgctttgtgtcgtcgcagggcttggtgcagagcgcgagcatggcggagaggaacctcctcgccgacgcgtcgaggatcgccgagaggtgccgcaagggcggcaagaagaaggccgacgtccgctgcgccgtcgccgacggcctcgccgccctcggctacgacgccgccgtgtgcaagtcgcggtgggacaagaccccctcctaccccgcaggtaaactaaacctcgcccccaattcgatgctgctgaatcgccggcgctgaccggcggcgacggtgggcggcgcaaaccttgtgcaggcgagcacgagtacatcgacgcggtggtggcggcggagacgcggctggtggtggaggtggacttccggtcggagttcgaggtggcgaggtcgaccaaggcgtaccgcgcggcgctgcaagctctcccgccgctgttcgtcgggacgccggaccggctcgggcagatcgtcgccgtcgtggcggaggccgcgcggcagagcctgaggaagaagggcctccacgtcccgccatggcggaagccggagtacatgcgcgccaagtggctctccccgcaagtcctccgctgctccgacaagccgccgccgccgccgccgtcgcccccgcccacgccggtatcgctctccagcttctccggcgagttcgagctacgcttcgacgccaagaccccaccaaacctcagcgccaccgccgccggcgacgacaacgacaacgacaacgacgacgaggtcgaggcgaagaagattacgatggtggtgtccccatcgccgtggcgcccggtggagccggaggcggcgagcaagaaaaggtcaccgccgccgccgccgcggcgccccgaggggaaggtggtgaccgggctcgccgccgtgctctaaccgcggcgaagaactcactttactacactagctaattaaccagctctcctccctcgccaattttctctgttttttttttcatttttccatcgccgctttgatccgtccgaggcttagctcatggtgttttctcagttttttttccgattttttggaaaaagacatttacagaaaacacctccatttttcttttttcttttttttattctagaacaaattttggtttccacaaaagggaagtgcaaggagcagtagctgtgacagcttctaggccccctattgttgagaagaggatgaaaaatgaaagtatgaactagagatatgcaacattatctggttgcttaatcagatcttaatcactacttgtactagcgtgagtgtatcatatcacttggtatcatcagaggctcagagcaggcagtaggagcagtattaaaaaatatgcaagtatggagtactactagtagtgatgcatacttctaaaaaaacctgcagcgtaattatacttcactaaccactgctgcgaaaatatttggaattccaaattttcaaccactttgccacaaattagatagagcaagtaaaccaactataaacatacatatgtgaaaaagataacgagaagtgaaaaaaaaagagagctataaatttatagtcaaattatagacttctaataacaatagactttaacatgttgtttgtgtatgtgagagcttgtttgtgtatgtgagagcagactaaatattaatagtgtagtactacctctgttttttaatagataacgccgttgactttttctcatatcttttattcgtcttatttaaaaaatttaggaattataatttattttgttatgagttattttatcactcataatactttaagtgtgatttatatcttatacatttgcataaaatttttgaataagacgaatggccaaacatgtgagaaaaagttaacggcgtcatttattaaaaacggagggagtatatatttataggtaactaagggtattagcttactagattaattatagataatttgaagctaatagtagattgtattattaaacttgttcctagtccatatttgttctggagtactctattagtcctgaaaaaaacattctagaggatgaatctggataaaggtagtctaaattcatccttataaagggtcaggttggttttttttactagggagtaaagtttaatcttccactttgaccatgacagttacgcgcgggtgacggttacttttgcgagtggggcccaggtgtcatacaccgggggcagaggcagcggtggcccacgtgggccccaccggcgggcgtgcgggcagcagacgagccgtgcgggtgcactcgtgccgtctcgggagccgcgccggccgtcccatgacgatggcgtgcgtggctgcgcccccaccaactctttactctctctccctctctctgtggacttttctcacctcggttttttaccacccatcggtaaaaaaaaaaggaaaaaaaactgtgctccgaccgatgcttcataatttgcgatttcgcggttagagcaaaatatcccactactagctcttcaaatcacctataactaatataatagttaatttatataataattacttgctatactattatagctggtcctacctatcatacacacattacgtcttgaaatccgtactacagttggctatagatttatagctcactgctcttatcttttttttatctttttaaaatatgtttatactggctattgtatatgctcttaggttgagaaaattttacggtggccgaagaagaggcaggcagtttgatcggcgaatccaaggtgtgtggggggtggtaaaaagttaacgcgaggaacggtgaaataaaaaccaactgtagtgctgttttgcattgcgttgcgcctcgaccatggaagacgagctagcgtgtgcatcgtgcttggtaaatttatgttagctttggaagcaacgatcacgcctttacggtttgcgaaacacacgcccggggtcctcgatctacctcacccgctcctcaaactgtttctagcaacaatcatccaaatcaactgtttcttaacaagccggagtatgtcaattcgagtgcgggcataaaaaaggggtaaattaaatagtattagaaagttggcttagaaattctgatgatgttcgtttttaatcgcatcatttaattataggtttgaaaaacatgcctgtgataatccggtggtcattaccagggttcaccgaaccgttttgggtggggttatcgccaccccacggtttggtggttattgtagtaaaccgcacgaaaactatgagggattgtagtccagtttcatttaaaatttgtgacataaatatattaattttagaagttatacaaccaatcagactaaggtatatgtatttattggaccctacgatgtagaaatgacaatattaatgaggggcaccatattcatttcttttcactactaatttatttaagaattggtagaaataaagtgtttgttagatgaagtgagtaaaatagaagcaacttttatatttgaattttgtgccaaatacaagcatttcattttgtacctatcccatcaatcatcgttcattcaatttgtttctcatattatccctaaccatacttccaacttcaaacgtctcttatttatgtttttttttccggaacacaatatggacctaggtgttggataatgactcaaatatattattagtcctaggcactagtttaatatgtgcctatatataagggtcacccttatacatgtaatcctaaaccattatagttgattttgtcttccgtggtttttcctctttacattagaggggttttccgcgtaaaaattcgtctctttcgtatttttttcctaacactaatatttatatgtgtatacatactaccctctattagcatctccgaacatcatatgtgttccgttatcagtggatacgtctctattaaaaaataattaaccgctgatacgagcattcctgtccttatcttttgtaaccaaccttaattagaacttctacaggtgtttatgatttgccatgaagggagtagatacttggtcagtcagtacccgtgaaaccattaaactcgcttttctgctgcactatcggagtacccgtagtcctagtccagtaccagtaactgctcctgttttggacagatagctgttaatattctttaccccgcctgatgtgaatcagcttgtacttgctgtactggcagcaagtacgctgtcccattttcttaatgtgcatcaggggagtaaataaaaataattaaggacgagtctggtcatgactacagtgcatactctctcagtaaaaaaagaaaaaaaaagtaagtctagaactcgatgtgacacattataatagagtgaatttacgatgtgtcatatttaatagtgctagattggtttttagggacggagggagtatatattaccatgcaaaacttttgcattactaagtttcgatagctttcttttttcaacaaagcaaactcatcctaactctactttgtaacttgtaattgaaacaagccgagctcgaggcaactcgcaaacaactcatttggcttggtggcttgtgtggcctacgtgtatttgctcaacaattatggttttcgagattgctaggtgtgaattaatgataataggcaatatatgtactaatataccttttgaggcagaatataccttttgaagcagctgggcaagtgttctagtatttggaaatggtcggtttataccgttataaaaaaaattgcagatgtatgacatatatgcgtcaatcagtccttctgccataaagtttctgagacttattattgcttcatatttgactttttagcggctttatgttaaaaaaaatagtttataataagtggttatagtttctttaaaatactagtagatacgtcgagcccattttgtgaggcctatatgtcagtgggtggtaccaccacaagaaacattcaaatgagtaaagaaaatttatgtgttatttcattatcatttttttttaaaaaaatgcgtgagctgactcgagaaagagaattgagccaagacaacggccgagccggccagccagaacaacgcaacaaaggatctgtttatatctcatctcaaaattttacaccatatataaagtattaaatataggctaaaaaataactaattgcacagattgtgagtaatttgtgagacgaatcaatcttaaacctaattgctatatgatttaacaatatgatgctacagtaaacatttactaataacggattaattaggcttaataattcatctcgtggtttactgacggatttagtaattagtttttttaatagtgttcaaacaccctataaaatatccgatgtgacacgctaaaactttaccctagatctagacaccccccaagacagattctggtcctatactgggctttgaacatatccaaactatcaggcccacggcccatatatccttcaagcccacagcccattccacacacatgtctcgcccggctgacacgtggcatcaatcaggcttccacaatttgcactaatcgcagattagaacaggaaaaagcaaacaaaaataagtccattttaccctgaacccctaaactattttttaagttcaatttacctctaatactactaaaatggtttacttaacattatgtctcttctttgtttttctttatacgagtagtattttaaactaaaatttttgtagtgacatagatgtcaaccactatcaaagttctaaactattttttaaaattcatttattactatttacttgaaatttaaaactcggtatttaatttagtctcattgcttccgatctatgtaaacaataataataaaatttgagaggtaagttataacacatttatcaattctaccaaattttatggcaaaatataacttatacatggggaaaggaaaaggagaaataccatcagaggtgtaaaataagaaaaaaccaatacattactactttatccatttcatattataagttatttgactttattaattagtcaagattctttaggtttcgaccaagtttatagagaaaattagcaatatccatgacaccaaactagttttaataaatttagcattaaatatattttattacaatatttattttatattaaaaatattgctatattttactatcaactctgttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcctccgaccacctcgctcgcctcgcctcgacgtctccttccctcccgcctccaagcaacccctctcgccggaggaggaaaccctcctccgcttccaatccccaaatccccatccgctatatcaacccgatcccctccccgatcgttcgatcgttcgatcgatctcgccctcgactccaagccgacgagaggagttgaggagttgaggccatttcggtgcgtgcgcggcgggcggaggtgatcggtggcgtttcgttccgttggcggcgggcggaggtgattgctcgcgcggcgtggagcggtggggggaggatccgagcgggagggagagcgcgcgcggatggggtggcggagtcgcgcttcggcggtggcggtgctgtggatgctcgccgctgtggtggcggcggctgcgctggatcctgatcaggacgagctcgaacgcgcgtaagtgcgattcaccagaggcagcttctgattgtttgttttttttttcaatcgtatagcatcagactctgcttttggttgcattctgttgttgcctagcttaatggggttgagattacatggagattccggtgtgcatttttcgtgttcatctgtcgcacgcgatgctgtcatgctgcgaaattcaagttagtacggccgaattgcggctgttttttttcctatctcttaacgccacattggaaatgggcacttgagatgattgtgtgggaagtgggatattggaggggagcaggtagctgctgatgcatggttgaaatgagaaaccaagtggattattcatgtgagatgtggagtaggtagccggtgtgttgctacttgcatcaaccggactaattgagcgtggtgggtagatactttgttggttaatggatgtcaacttgctaagtttcacctacatatgtggataattaagaaagggaagacacatcttgaagatggaaaattttgaagtaattagagcaatagcaaacaaaatgatgacacattcccattattttcctaaaaaaaaaactgaagccgctttcgtgtcagcatagtgtgccccagttgaaccggctttggaactctcagatgatctaaccatatgaaaggcaccttcttaattgttttgatgaaagattgtagacttggttacttaacagaatcatcgtaggtctgcttcttcgacttaatgctgagtgaatgagagtacaacatgtatatggctggtactactagcatcatgcagtagttgtgtttcatttacttgttcatatggaaaacatcatttgctacaacgctcatatttatcaaatcagtggactgcaaagaaaaattattgtggttttggaagttcttttttttttaacaaagatagttgtgcaggtttccaatcgtcgaaccagatcatggtcacactaaactccgtcttgcaaaagaaggtttggaggcaattaaaagaatcgaaacaccaatagctgctgtcgctgtatgtttaaatgggctgtagctcacataaatacctgatagtttgcttttcccaactaatgccaaggcactatatttatttctttgtcgtggtgcatgctgagttatatgtctctgactctcaaatcaggttattgggccatatcgatctggaaaatcttttcttctcaatcagcttctctccctaacatgcaataaaggtacaatgagttcctgccttacatacataccatgctccaggaaagaggatacttggaatgatggattgataaattggctctgcaggttttggagttggacatatgcgagataccaaaacaaaaggtttggtggtgccaatgacaactttgtaatgttatcctaaatgattccatatcctaattgaaggattctaacactctgctccacatattgaaggtatatgggtctggggtactcccattgagttagatgtgaatggctccaaagtttctgtcctttacctggacactgagggatttgagagcatcggaaaatcaaatgtatatgatgataggtttgttgcttatagatgaaatgcatattaagtttgaattggaattttaaatggtgaaaaatggactgttagttcttttgtttttgttgcaggatatttgctctggccactgttttaagttctatccttatctacaatcttccagagacggtgtgtttctctggctcatgacatgctcacctccattctctcatttgatagctattaacttgacttatcttgatcatagattcgtgaagctgatatatctagactctcatttgctgttgaaattgctgaagaattctatggaaggtttgctttctgccattcctatttggagcttacaatttactaagtgcctccttaatgttctaacaaaatttccacttttctgtcggcatttgttgactccagagtgaaggtaatacttaaccttaagtgttagaattatttaaactagaaccactatgtcaaagttacagtgcttgtctctgtaggggcaagatgttgcttttgagccagcaaaactactgtggcttatccagagggatttcctccgtaagtttctgtttgcgttacatatgaacaattttattttgataatcaagtattcctttcagcatgttctgaatactagatgagaattagattttcataacaagaatagacaataaatcacaagtcggaccataaaaagttctaattgccttgtattaatgtttgtacattgtgaggtcggacttatgttgcggtacagactacagagggactagttaataacttgatatgtgctgtatattagcaatagtggaaatatacaggtctcgtgctttattttggtcaaatgtctattgttttgcatttcaccgtttgttgttgctgttttgtttttaggatattaaacttcttttaacattgttaactttcatgaggcagaaggaaaatctgtccagcaaatggttgatgaagctctccaacgggtgcctaacaacaatggttagttcaagttaccgtattaatggtttttatcatgatgatatttatttcctttctttcttcatgaaacaattgaagtggggatcttgaattaacctacttttgtgtattgctgcaggagacaaatatattgatgaggtacaattagttcgagctatatgctaataactggaagatatggcatactaatttgtttgaagaaacatggttttcatgttattttaggtcaaccgaatcagagactctttggcatttatgggcgataacagcactgcttttagcttaccccaggtttgtgaaaacatgatcatggtggggggaaaacatgagatatgttttttttagggaaaagtgatttgtgcatttaacatcattactatcacaattcataaaatttttggtattgagctaccttttaacatatatgctcattttgatgattatgtgctgtgatctttacatcactaagttattacattatgaacttttttgccagcctcatcttcaaagaacaaagctatgtgacatggacgatcaagaactggacccattatatatagaaaggagagatgagttgaagcaaattgttacttccatgataaaaccaaaacttttgcagggtagaactctaaatggaaaggagtttgtatctttcctaaggcaggtaatacctcttggcttgtttttttttatgcatcttaggcaggtaatcttgaaactcttgtgagctgttatctgaagttgcttacctttattttagatacttgaggcgttgaataaaggtgaaattccatcaacaggatcacttgtagaagtattcaataaggcaattcttgagcgctgcttaaagttgtataatgaaagaatggaaagagtgggtctaccagtatcagtggataaacttcagctgattcacaatttggcagaagatgaagctagaaagctctttgacaagcagcattttggtaaacatcatactacccgatccatcctcaagcttgatgaagagatgagaaaggtttgcctgacaataaatattcatgcgtgtttaatgttgtcttccattttcagataataaaacgacgtcattgatgcaatttttatgttgtaatgaatatgaatatggattgaagtatatgttataaacattatatcgaactgagatgctatggtcttcagttcttcacataagaaacacttgattcttcatattctgtcataaaattctattattaattactaatagccataaatcaagtttgatagttcattgtgtagtggtagtacatcttttgtgtagcaacaagttggatttctttccatgccttttgtgcttggatgctttgttttgaacacgaacgaattttttctttcagattttatagggtatctctggtgagattcttacatttgaagcattccatttaggaataaaactcgtttgttgcttacaacctatgcaaaatggataatatatcttcaatgtgtttaactgggtattctttttaggtcttcggaaactttggttttgccaatgagtaccagtcatcgaagctgtgcaaagcaaagttttcagagtgtgaagataaaatggaacaccttcaatccttgaagcttccttcgatggcaaaatttaatgctggatttcttcgctgtaaccagagttttgaaatggagtgtgtggggcctgccaaggaaagctatgaacgtaggatgtcaaaggtccgtctcttttaacttgagacatcttctatgatgggaaagaacaaatggattttgtacccacttaaaattcagatcaatttagggataatgcagtaatacatggagttgttaggtgtatccagttacaaaagtagcatatcacttttgactatcagattttgcatcaagtttttcaatactccctccgttcctatatactaattatcaccattgatcaattctgttgcaactttgaccagtagttcttatgacagagtaggtagtttttctctgctacttatgtgagcatttttagaagtcaaatcgagtcaaggtttcatgtagtaggtaccatttcacccattatgaatagcaaaagggaaaagcagagatgattgtccatatgtagaattcgaaagtaaaacatctttattcaccttccttcctcttttttttttcctggtaaatacaccagcacgttctgatatgttgtaagttttacctgaaactcattttttgtccaactatgttctttattacttgtgttgtgtattcctgcaccaatctttcttgaactgatatactccttgatgataaccttatctctgcatggtcacagatgctcgcaaggtctcgtgctcttttcatcaaggagtacaacaacaaactattcaattggctggtgacgttctccttggtcatgattgtgattgcgcgctttgtgatcaagttctttttactcgaagttgctgcatgggtgatattcatcttcttagagacatacacgagattattctggtcgtcagaattgttgtactacaatcccatctggcacatgatcgtctcttcatgggaaaccattgtgtataacccagttcttgatattgacaggcaagtttcttctctctgtgaagtgcacaacatgaatgtaatctctattttgccttccttactgttacgatgcttgtcttgtgcagatgggtgatcccaattgttgttgtgctatcatttttagctgtttactggcgttgcctcggtgtcaggaaacgaataggaagatcattgcttcctttgtacagaggttcttacggaagctccagtcgcccaagaacagattaatccaggtctagaaatggtgatgaatgatgcaaatcgctgggaaaatccatgaaaatatccttttgccgtgtgatggatagtggacggcaaaaggatgttggctctatgcacacgctgcaagaagcttctcttgcaatccaagaagggaatatttaggctcagctcacggctcttagtcttactgacccaccaagcaaagcaaacgctaacgtatgaatgataatcaatctttgttctatatcgaaatgcttatagtaacaaagaaatataaccatactttatttcaatgtaaagatcattctttgtatattatggcacactagataataacaaagaagatctggtagtgtacaggccagagcagctgaaatttcatgaaccatcagaagaaaccggtctctaaatttcatgaatcaccaggggaacagaacgaagttattgatgaagctactactgtgtttcttacagattttacataagttgggtttatttcaaatcttacagcaacaagatcatacagtcacatattgataaaaacagtcagctggtcttcacttttctgagcttcctcttggactcacggtttcgtcacaaatagcgggagtccgaagtgatcatggtccatgtatttattgttgttgttgcctctttcgagctatcttgcgagccctttcacgaagttcttcaggaggtggtggacgtggaccttcgggaggatataccacgtattcacgctgcagtggaagaatacagagcattagctcagacttctatatatcaccattgagaagcaaagtgatagaaacatataaaatgggtcacatgaaaatgattggcagatagatcttctcttttaattttgtgatgcaacaaacatgaagaaaatgtaagtattcatcaggaaaaaagaacatcataacacgataatctgtgaatgaaccacatataagcagatatatgcctacacaccctcacaacattagcattgctgcctacaaattgagcaaagtttcagtggcagataaatatggtcagtgagttgacatgcttgacaccacaaagcttagctctctaaatcgcttaatagcaacagcgcgaacaagctacaaacaaaacccgcaccagaaagggaatagccatccaacaaggcatatgcattgttcatcagcacgattctggaagaatcaggatccaatggcttcttcatcttacgaaacggcgtaggaatgaattcaagctcaaatgtagatatctccgcttccgtctgcagcgccatcggtcaccaccaatgccaaaattcagctcaaggtcgagtgccactctccactctctactaatgcaattctcatttcttccctcttcttaagatcgaaccccaaaatgcgcctaaaatcctagcatgaatttcaatcctcaaattggatagtgctactttacgcggtggtgggacgattgggatatatgctaccaaaacctaatcaaaagggggcaaaatcctcacccccatccagcgaccaatcctgatcttagagagccgaacagaagagaagggggaatcaagacgagagggagagagagagagagattacgaggcccatgagcttcttgagggtcttggagtcggtggcgacgaggtaggtgagcgcgacggggacggagacgtacaccccgaacttggcgatctccaggacccccttcgacgtcccaatcgacgacatggccggcgccggccgcgaggaagaagaagagatcccctctctctctctctctctctctctcctcctcactccgaacacctctctccgtcactcgatgaatcggcggcggcggtggcggcggcggcggcccgcgggtttgcggagaggcggattgattggtgagtgtgggttcgacgtcacctggtttagctgcgggcgaacgaggattagcggggccagacaagtggggcccacatggcagtgagaagcccggacatttgcatcgtggacatcaacgtaacttgagaaaacgtacaatatgccactccacaggagtgcaaaagataacattccacttattaaagtgcaaaggataaaatgtcactcaataggttatcttcagtatattttgccactttggggagttttgagaccaaaatgcccccactctggagagagagggagagaggagcaacgacggccgtgctcatcgccgtcaggcagggtccggccatttgcacaccatcaagatggcaacactcgctccggaatcgtcgcgttggttgctgcgtgtggctctgcttgccgctccacttgctgctctgcttcaaaatgcgtgtggctctgcttgctgctccatttgcacgccatcaagacgccgtgagcagcaagcgcttgcacgcgcgcaggaagtgctagaggcggcgagcgcgcgtgggtgccaccgccttgtcctcctcctctcatcagcaacgcgccagcgccgctccttccctccgtcggcgccctcccctggtcggccgcgccgtcctccttccccctgtcggcgccctcctccctcgattggcggcgctgtcctcc

SEQ ID NO: 64792 - DNA, 4941 bp, Oryza sativa
cgatctcgaacaggtgcacgccgaagctgtacacgtcgcacttctcggtcacgcccgcctgcatccacatctccggcgcggcgtagcccggggtgccgcgcatgccggacaccgagacgtgcgtgtcgccgcggctcgccagccgcgccagcccgaagtcggccaccttgggcgtcaggccgccgtcgagcaggacgttgccgggcttgatgtcgtagtgcacgatcttgtgctggcactcctcgtggaggtagcggagccccctcgcgacaccgacggcgatggcgcgccgcgtcgcgacggggacggcgcggctccggtcgaacaggtaggcgtcgagcgcgccgttgtccatgtactcgtacaccagcgcgcgcacgtcggcgtcgaagcagaagccgaacagcctgacgaggttgatgtggtgaatcctcccgacgctgcccacctccgccataaactgctcctgcgacgtcgaccacccgtcgccatggccgccgacgtggaggcgcttcacggcgaccgtgaggccgttcgggagcatgcccttgtacacggtgccgaagccgccggcgccgagccgggccgagtagttgttcgtgaatccggccagctgctgcgccgtgaaccggatgggcttctcgccggcgatctctttgagaaacctctcgacggtggcgtcgcgtatctgggagtccggcaccacggcgtacatcgccgccgccgccgtcgggttggtgttgatgttgacggccgggaggccattcttcttgacacatctgtacacgaggtaaacaatggcgactgatccagcaatgctcaccactgaaagcactgcatcaccagagatcaaaaccaagcatcatctcagtgaaaccagctcatcatctcgaaacaagaaactgaaaattgaaaagaacaaaagaaagaaaaaacatgtacaaattgccgagatttcacgcaccgacgacgatggctaggaaggagttgaaattgctggaggcttgcttgttgaaatcgtcgaacgactggttgggattagcagacatgttggtggatgaataatgaattactgctgcaaatgaagaacgaattgggaggattctgaacttcttggtgatccaaactctgaagctgatcgatcaagcttgcatgcaaactaacaatgcgtgtagcatatgcagctgtaatctggggctgaatttatagcactcaaggggctatcgtgttgggacagcaaccaaagaactgttcaacacgcgctgcagtaaccaggtcaagtcagaaaaaagaacgcgggagatatgataattaacctgacagcgacaggcatatcgtatctcattagattaaaaaatgcagaagaaaacctgaacaaaagaactaggactctgcttacttccctcaagaagaaaaaacagagagggtctcctgtctgaattattcattgccgccgttgatatgaagtattcatcgacgcaatcactcagtttcgacccttccattcatcaaattttgcagaaaactcccttactttctctttttcagaacgcggtcctatacttgaattttttttcaccttcacataagatatatcaggatctagagggcctttacataagaatacataagacagtgaacttacatttagagacttaagaaagattatcaagttaagcgaggactttttgtaaaattgccagctcgtgcaccaggtgatgtggccatcaccggaagcgaacatgccagtaagaaaagcctcggagcgctctggtgcgagcagatcgccttcatctttaattactccgattgactcctgaacaaaataaaaagaagaagagaaaagtcaaatcttctaatcttcatcacaaataaaatctcatgttctcccaaatcccaatgttaaggcgtaataaggctccaggttagggtgactgcggcctaagggagcaatttctactgggcaagaggatgttgggtatccaagcaagcgacggcggaggcgccattgccgccgtatgcggttctccctgagccatcgctgccgcccccaccgcctccgctcggtacttccaaacttcggtcgcggcggataaggcagagctcgccggagaaagttggaggcaccaccgtcgccgtgtcgccggagagccgagcgcgtcaccgtgccgattcgattttgagtttacctaagggtttttgtgaaaaatgacgtactaaattattacacctccgtcttaaaataaatgcaaccatgagtttccatgttcaattttgaccgtcgtcttatttaaatttttttatgattaatatttttattgttataagattataaaatatgaataatattttatgcgtgacttatgttttttagttttttttaaaaaaataaataagatgaacgatcaaaagttggacacgaaaatttatgattacgcttattttgggagtattaccttattccacaccgtctgatcaagtataggtggtggagattaaagaaaggcaatattgcaacacgcccccccttacaatgtttcctttcccaattcggactcgtaatccgaatccgaatgagatttaaaacattcggcgccggcggcggcctatattaagtagcacaaacccacatctctgatcctcacaaacgcagccatggcggcggtaactgtgctcgattgccaagtgttcggcattcacaagatggtgctactctccgagacagcggccgcgccaccgccgccgccgccgttggcggagcagcagacagcgccaccggcggtcacgctacggcttctcgtccagcgggcttgctgctaccacgacagcgacgacgacgccgacggtgtcgtcgaccacgacatggacacaatggaggacgtgatctgccgagcgccgctccgcgagctgatggcggatgatcgcgacgacgatggcgcctcggtggcggagcgggcgttccgggagatgttggccgggatcgagcaccagacgctgctcccggaggtcgagccggaggtgtcgaaggccgcggcgcgcgtccgggcggtgtgcgagggtcgcccggaggaggagatcgccgggctcgagctccgcctgcacgtcctgctcgtggtgcacgtgttcggaggcgccggcgacgacgacgagatcgggagcgacatggatctcagcgacgtgtgcggggaaacagaggacgacgacgacggcgtactcatcagcgacgaggacgacgacgagtacggcgtctacggcggcggagggtgcgccatggcgcgggagggcgggccgagcgacggcgcgctgctgctgtcgggcttcgcggcgcgctccgacggcgcggagctcgacgacgacgaccagctcgaggtgacgccgcgggacgtccgccggctggtgcgcatggcgctggacggcgaggacgtcgagcgcgacgaggcctaccagcgggcgcttgccggcggcacggccgtgtcgccggtgtcgctcgccgcgatggtcgaccaggcgctccagtccgttcgccggcagcagcagaacgcgccgcgagacggcgtggttcgccggatgcgcaccggattctgacgtgcagcagagcggatgacgtgtcgcgccaacgcaacaacgccaagttttgtctgttactactactgctcctatttttgatcttggtagagaagttggttgtcaatcgattattgaatagcaaaagctgatttcagaagatgtttgggggagtttttaagctaatgcagcttctaccagaatcagaaactcccctaaacagtccagcttttggttcagattgaagctgtagttgtggaatccagaaaataaatagaagacagaaactgggaaacccacctttttcatattctcataagctggctgctggttaccagccagctgcttctcagaatcttaagctcaccaaacagacccttaggtactgtttttcaaattgattgaaggcaaatgcaagccttgttcaggttcaaatattggaatcttgaaatcagcttatatgtttcaattggatgtaggcagattaaaaccttgttcaggttcaataattcaaatctatatcaagcatgcactgtccaattcaaaagctaaacatagcaaattagaaatctggacaagttcagtgcccatttgaagctggaatatgaaatggacaaatggtggtgtatgaaactatcaatttccaatttccgcccccaaattcagccaaacaaaacttcaggttaattaggaactgaaaacttcaatggccattcggttctgcttctcgctatcctatccttccgattggcatagctgtgcatcaagtatgaaaatgcactagattaaactaaataaagcagctcctacatatatatgagtgtcatgtcaagcatggattaaattaacatagatacaaaaatgaaacatgattaattactaggattacttaacacacggatcacagaaaatcaatccttgcatgcaggggaaatcgatggatcgacctctctccttaacttgttcttaattctcatgtacaatcaaagaaacacacacgcacacacacatgcgtgcactgcatctctctgagcaacgaactcgattgatttgattttgattcgctagggattaaagagaagctgagatagagatttcgacgatcatgcgacgctgaaggagctggctgcgctctcgacgaacttcctggcgcccttgaaccacctcttgtcgccggcctgcgccttgcagatgtacagcttgccgtcgttgacggtggccgtgatcagctggtgcttgccgccctcgtcgccgtccgccgtcctcgtcagcaccgttacgctgtagtactgcttccctcccaccaccggcgccgagctctccaggatgttcgccgtcgccaccgcgtccgactcaaacccaccctatatcgcatat

SEQ ID NO: 64793 - DNA, 625 bp, Oryza sativa
actagtgggatcccccagtactacagcggtacaaccggttggccatcggcgagagtacgtaccagtctgcgtgcctgtacgtgacgtgacacggtattcgtgcgtgcgtgagccaaaatcctcgttgcgccgccgcgccgctcggctgtgctgcgcgggcagccgacgggagcgggaagtgggtgggcgcgcgcgcgcacgcacgctggcaaatcttggcctttttttacgtcctcggctcacgcgcatccccacgcgacgccgggctgcagctttccaggagacgcggccggcggggtttccgccggctatgggggttaggtatgcggtacacgctcgcggactcgcctgtcactcgattatcacgggccggtttggctgaattatccgtggacggtggacaaatggatctcgcaccctgcagcgcagtggtccgtccgtccgtcctctttgctgcgctggcgaagtggcaagtcagtgaagtcgcaagtgagaagggaaagtaggtcaatagtaggtggtggcttcagatgttctctgggcctctcacctctggctggaaaagagcaacgttttaatgccaatgtcacgagctttttactgatgtgatatatcggttttagat

SEQ ID NO: 64794 - DNA, 709 bp, Oryza sativa
gctattccaagcggcaaacaacaatttctattggaaatagagcaaaaacaagcttttggcgcgacaactggctccaaaactcctgcccaaaggatgttgtgccactctgcttcaagctagcaaaacaaaaacaaagaaatgttcagaaagagctggaaggcaatctttggctccagtccttcaagcaattcaccacggtggaagaaatcaacgaattagtgcaactaggggagatgctacagcaaattcagcttaacccgcaagtgcaggatgacattgcttggaactggaatgagaaaggtgtttacacagcagaaagcgcttatttggctcagtttcaaggatcctttgtaacacatgacttcatttccatctggaaagcacctgcggaaccgaagactcgtttctttggatggttgatcattcaccaaaaaacgttgacagcgcaaagcctccttcgcaggcattagccttgcaactagatctgtaacctgtgcaaagaagcttttgaagacacaaaccatcttttccgttcgtgcatttttttcggaaatgtttgttccctggttagtgcttggggtggtcttccctccttgtcattgcgtgatgacatttgactgtggtggaatgatatcaactgcatcaaatccaaagaacaaaaaagagtgatctctggaagccttctcaccacctggtggaatatttggtt

SEQ ID NO: 64795 - DNA, 3300 bp, Oryza sativa
ttcctgcagccccgcggaaaactttgctaaactctccacgagacatccctgtgtctatatggtatcaaaacagttatgaaaattttaacttgcatgcatgccatctaagaaacgagggacttttccaggagagtttagaagaattcagtgtgtgcgagctcatccatgtcttggttggcatgcagcttatgtgtcagtgtgacagtgtgtgacttcattgttctgctgaaatcttcaaactgtggtttcggttgacaagcatgcatgtggtaaacaatgtgtcaagttgtaaacagatatagcttatggccaactgaacatgtcggcgtgagttggcaataagagcgtccatggagtgtacaccaaccagctagatgcgtgtttgcatgtttttgttgattgattaatctgtaaagggaaagaaggagatgaatgttgttgattaaagattgctcaatgatcatgggttgtgtattgacttccatatttttttagggattaattagttgttctgttgacaccgtgcatcacgtgtgcatgcaccaaacaacaaaccagtttacttggatgacagcatatgagttgcaccgtgcataataaaataacctgtttaaaatggataatctatcgaggcgtttgttagtggtgctactccgagaaagatgagaaaaataaaacagagcaaataaaatgttttagagcagcactttaattttgtatttttaatagcggtttgagaggaaagtctaaaacgtagctaggcagcgatggaataacgacattaaaactaaaaccaagtacaagttagcgagcagccaatggagctacttgtgccaatattttttaaaaaaattacacagtacaacgcaaacactcacaacgcacgcacactcatccctatgaacacacgcacgcaaatcctacccctatgaacatctttgaagactgggccagtaaatccatcctaaagattgacgaagtcattacatgtgtctcgctgtcgagatagtaaccaatatatagtgaaaagaaaaacatgccacggtcgttgcataaatcataaacatgcatggtacgctagatatatctttcactagggttttatgggttaataatcatttaatttcaagtagttttagtcaagatttacaataaaatgatttttttttaaaaaaagaaaactatgcgtacgatgcactggttagttgcaacatttcaacatttttgtcacgaatttgtggatgttgaaaatacccttgaaagtcaagggatttgcattgcggggtaatcttacaaaacacaatttggtaaaaagaaatagatattgtttttagcaataatgagaccgtatccggatccaacatttcttttgtctcccccttagttcatttaggttgatgatttgctttgtgcatcaaaggtgtagtggctggatatacttattcatttatttaaaatgggaaataaatataataatatactctccccatcttaaaatataatacttcttgttcaaatacctatccatggattactatattttagaacaaagatggtactaaaatagcaagtatgttttacaaccatgacctttccacaatgccatgcactttccaatcttcatcctgtatttatgttggtttttgcaatgtgttttttaaccctgaaacagcagaagagatttctactgtaatttatgcaatgtgtcattaatggtttttctttttttcaaaactgttgtgaaggagagaaagtgaagtgcttactgactcaagtcttcctacacctatagttgtgacttgtgagataactagaaaattaaggcctcttttgggacatggaaattctatgggattttcactagaaatcactttaacgcaagcaatagttaataaaaagctttagaaatttctatcatatgttatcggtgaatgcttgggtctgcaaaataccatcaatggacatgagttttacattactatactatcaaacttcttcctttttgccatcgtcgttagagacatgttaacctttctccgttttggagttataaaaagtccaagttacccctattgtaacaggggccataaaagaccgcaatggtgcccctagtggtaagatggatattttacagtgtaaaagagaagacatgttcttaacgacgatagcaaaaatgaaaaaaaaacggaacgatggcatattatagtgcctgatattatgtaagaaggaagttgtcgatggcgtttttagaacgaagtctttgttgacagtatattgtctaatttctctaaatttttttgtgtgtcaaagaagattttggtacatgtggaatcacaaacttttgagaattcctctagctagaaactgaactatatcagttaatgaaacacatgttcttgatatgggctctaaaccgaaggtggagtcttccggcattatcggtaaaaaagaagtaaaaaataatctcaatgtcaacgccctgccagttatttgaagcattctgcaatgtcttcttgcaattaaatggcgatatttagccactatgagttattcacataaccacttgctatggacagctaggctgttcagatgctgcaacccgtgcatctaagcttgcatccctaatgagattaagatatcttgaaagatcgttgtgtagataccacagaaatatactagtataatctaggctcaagtggctcagaaacagaggcttcctgcactcttcaacggatccaaacagaggatgcaaagcacccggctaagctatatatactgatatacagcatccacgcacagtactaccttgcaagttccaaccattgttataggcaatctgatcagagcaagagagcacacgtttagaaatggccggaggaggatttgccgccgccggcggtggcagtgctcgcgactacggcggcggcatcactttctccgtcgtggtgaccagcctcatggccgcctcctgcggcctcattttcggctacgattctggcgtcacaggtgcgtactctactacagctacaggccatggctacagcttcttgagctgttcccagccctgttctatgatcatttctactagcttacaagcatgtggtcttcaaaaaaattctttcatgtttaaagcagaattgtttcttattacatcccctcaagggattaaaacagttttctcttttcgttacttattttacctggttccattatagctggtgtgagaaattaagcagtttgtcagaatgatttatttgggatgatattctgattttttccaagactggtcactagagaact

SEQ ID NO: 64796 - DNA, 12365 bp, Oryza sativa
tcatctcaatcaggccagatttgttaggatgcaggaaggcatctatatatcccgcctgaaagttacgggctccatcggttgcctacgggtgattataagttgtaacggtttataaataataaaaaattatttatagatgaaacttttacatatatatccttagccacttagaagtcaatgttgatgttgaaaaagcatcgaaatcaactttaaaattaagttttaaaatttaaggggctgttcagatcgtagccaagataaatcttaccaaattttggcaataccaaaattttggcaatttgacaatattgctaaaattttagcaggatttcttatgtatttactaaagtttggcaagaaactaaatggatgtacatattgggcaactctacccaaaaaatggtatcgtttgaaatggcatcaatttgaacaagctctaaattttaacaacggtttaaagcatagagtaaacaacgaggtccttggacttgtggcaatgctcaaaatttttttctataggagaattatatatatgcatacccatacattggggtattgtgtgagtgtgtttagaaaatttctccttccggttataaatattttttaataatgtccggttataaatatttgatattttagaatataatttctcaaaatctgaaactatggccatcaataatctctactacttaaaaaataagaggtgcttccatcgtacgtcaaaaaaaccagacgaagaaaaccgagcgaaaaaaatcgggcgaaaaaaaagagtccgatcaaaaaaggagaaaaagcgggagaaaaaaaatgaccgatcaaaaaaacggagcgaaaaaaaaaaccaaaagaccgggcgaaaaaaccgaggaaaaaaaccgggcttaaaaaagagtccgatccaaaaaaaaagggagaaaaaaaagaaaaaaaaatgtccgatccaacaaaccggaccgaaaaaaaattgtccgatccaaaaaaatacggggcaaaaaaaagaactaaacgaatcgtttaaaaaaagagcaaaaaaaatttaaaaaagtgtccgatttcaaagaaaaagaaattatatgtgatacggtgaaataaacgaccggacgaaaaaaataaaaaaaagggcgaaaaaaacaaatatgtacaataaaaaaggaaaaaaaatcaaaacgaatccgactccgtcgactcggtaataaaagggtgaaaaaaaataaaaaaagtctgattccaaataaaaagaaattatatgtgacgcagtaaataaaatggaatcctatttatatctagaaaggtccgacactataagaaagtggcgaaaaaaaccgttcgtaaaaaaatgcactacaaaaaaaaataaaaagggcggaaaaatgtctaatttctattcgtcgttttagtagtccgtttatatctcttctttatctctaatctaatctaatctaactattttaaaagagaagtttctaccgtatattaaaaaagaaataaatgcctgagaaaataaatacggtttaaaaaacgcgtgaggaaaaaatgtcagaaaaaagcgcaaaagaaaacgcgctagaaaaaagttccgtagtccgtaaaaaagcacacgagaaaaaaatatttccatcgtctatagaaaagaaaaaaaaagcatacatggaaaaaactattagaaagaagcgctaaatagatagacacttggtcggataggatccattgactttttttctatctcggggtacacgacttttgtttcgtcatctattctcctgtattggagaccctgcatatcttcgtaggcaattatcatactatttttgtgaagtatagctactattcttgataatatattatatgaaataatattagaaaataaacatattttaattgttatacagataagagtggacagtgactctattttgtgtagacttgatcatacgaggcaatgcaggacttgattggttgcaagaatgagattaaaagaatattttagattatatgcatgttgtcatatgaataatccaattattttaagtaaagcaagcatcgtaaggttgccatcatcgaggttgggctattacatttaagatgttccaattttctgattgtcatcgacatggttatgcatgaaaaacgtatattatcattacgttttttcacccgttgcaacgcacgggcatgtttgctagtttctattacatagcaaacatgcacacatacacaaacatgatgtgtagaaaacacacaagatattttcatgggtaccaaaaattgagtcctggtaggtggagttcgtgcaccaataactccaccatcacaccatcggtgtttctattacgagacaatccattatgtgcctttaactttgtcccaattctacaatatgccactgagtttaccaagttatacaatataccattgtattttgtttaacttctataatatatcattgtcgtctagttagccccattagtattgtacattcctaatgactgaaatacccctgaagagaaaatttccaaaatttggccgaaattccgaaatgtcatattgtaaactaccacggaaattgcccatatcaaactttggaagttttacaatctaatatttcatgattttttaccaaaatttggaagtttttatcccaagggtatttcggtcattaggataaaattgtatagtactaacggaggctaactggatgacgatgatatattattattatggaagctaagccaaatgcaatggcatattataaaactagacaaactctgtgacatattatagaacgggaacaaagtcagtgacacaatgtattctctcttctattatcctaatataaaattaatggttaaagtttgatagaggtactacctgatgcctccgaaaggcatacagagaagtaaaagtgtgggaaggttcaagttttgatgtgtaaaatggtgtaccaattttccgggtaaaaacttaggcatatactccaccttatttagagccaaatttaaatgtggtactgctcagagctaggtttgttgttccttttttttgggcacagttaagcatggccaagaaaaaagacgtataccattcaatcataggatgtgtttagttcacgttaaaattggaggtttggttgaaattagaataatgtgatggaaaagttgaaagcttgtatgttagaaaagttttaatgtaatagaaaagttgaaagttcgaagaaaaaatttagaagtaaactcggccatattattactccgtactagatactgtattaccgtgctacttgtcggtccatgactcctcgttgattacaggtggcgtgacgcagatggagtcattcctgagcaagttcttccccgaagtgctccgtgggatgaagagcgcgaggcgcgacgcctactgcaagtacgacaaccaatggctcaccgccttctcgtcgtcgctcttcatcgccggcacgctgtcctccctggtggcgagccgcgtcgccagggcggtgggccgccaggccatcatgctcctcggcggcgccatgttcctcaccggctccatcatcaacgccgccgccgtcaacatcgccatgctcatcatcggccgcatgctgctcggcttcggcctcggcttcaccctccaggtacaacgtggaacacaatatgatcagggtttatcataccgtacggttatatcacatgcggtaatcttttcagttttttgaaaccacggtgtactccacaataaccgcatggttaccgtggtaaccgcaaaccgcagggtgacggtaacaccatcccaaacggtttggtaaacccgtttggtttggtaacgctggatacgatacgatacacaaggcccagcaatctaggcccagttcatcaaatccagctcagttccaactcttcttttttatatttttccggaaaaaaaaagggttacatttttgttgctggtacagtcagctccggtgtatctgtctgagacggcgccggcgaggtggcgcggcgcgttcacgtcggcgtacaacgccttcgtcgtgatcgggatactgtcggcgaccatcaccaactacttcaccaaccgcatcccggggtgggggtggcgcgtctcgctcggcctcgcggccgtcccgggcaccatcatcgtcgcggggtcgctcttcatcccggacacgcccagcagcctcgtcctgcgcggccaccacgaccgcgcccgcgcggcgctgcagcgcatccgcggcgccggcgccgacgttgacgccgagctcaaggacatcgtccgcgccgtggacgaggcgcgccagaacgaggccggcgcgttccggcggctgttcagcaggcggtacaggcactgcctggcggtggggctcggcataccggtgttctacgagttcaccggcatgatcgtcatctccatcttctcgcccgtgctgttccgcacggtggggttcaacagccagaaggccatcctcggctccgtgatcaacagcatgaccaacctcgcctccacgctgctgtccacctccgtcatggaccgcaccggccgccggccgctgttcatcgtcggcggcgtcggcatgatgctctgcgaggtggccatctcgtggatcatggcggaccatctcgggaagcaccagggggtgacgatgccgcggagctacgcgaccggggtgctggtcctgatctgcctctgcacgttcagcttcggcttgtcgtgggcgccgctgaggtgggtggtgccgagcgagatctacccggttgaggtcaggtcggcgggccaggcgctgagcatctccgtcgcgctctgcctctccttcgtcgagctgcaggtgttcatcgcgctgctctgcgccatgaagtacggcgtgttcctcttctacgccggctggctcctgaccatgacgatcttcgtcgccgccttcctgccggagacgaaaggcatgccgatcgaggccatgcggtccgtgtgggagcggcactggtactggaaaaggttcgtcaacgacggcgaccaccacgacggccgtgtcgtcgccgacgagggtaccgattaaacatttatccggtgatttggtggtgtgatgaaccgtgtgatgtatgtgcagctgcacggctgtggccgttgagcatgatctaacatttcagtggcatacattgcccattcttgattaatttacccaaagtcgtccatcttagccttatactacgatcgagaacgcacacgctaactaaatttctgagatcaaagccaaacattccgcatcggcatatgcggtgcaaattttaggtcgacacgtcgccgaacttgtggtccttgacgaacctgccccagtaccagtggcgcgcgaagacgtggcccatggactcgagcggcacgcccttggtctccggcacgaaggcgacggcgaaggcggtcatgacgacgagccacgacgcgtagaagaggaaggtgccgtacttgaagcagcagagcatggcgaggaagcactgcgcctgcacgaagttgaggcccaggttgagcgccaccgccacgccctgccccgccgacctgacctccaccgggtagatctcgccggggatggcccagtacagcgccccccacgaccagctgaagctcgccgagaaggcgcacgtcatcaccagcaccgtcaccgcgtaccccttcgccatcttgctcccgtgccccagctgcgaccccacgatgctcgccattgccacctacgatacgcgtcggctcgacgtcactttcttgttgctgaaatgttgatgtgcgctctaggtgagtgtttgtttgcattgtttttacctggcaggtgaacatgagcgcgccgccgatcatgaagagcagcctccggccgtagcggtccatggcgaagcccgagccgacgatgccgaagatgttcatgaggccgagaatgacggcgcccatcagcgcggcatcgctctcgaacccgactgtgcggaacagtatcggggagaagaaggccgtgacggccacgccggtgaggttgaggaacaccgggaacgcgatggccatgaccaggtacggccggtactcgcgccgcaggatccgccggaacgcgccctcgtcgttcctgcggtcgtgctccacggcggcgaggatgtcgttgaactcggcgtcgacgtcgacgcccttgccgcgcacccgctggagcgcggcgcgggcgaggtcgtgcttcccgcgcaggaccaggctgctcggcgtgtccgggatgaacgccgcgccggccaccatgacggcggccgggaacgccgcgaggccgagcgacaggcgccatccccacacggggatccgcgacgtgccgtagttgatcaggttggcgatgaggtacccgacgctgatgaacagcgggaagccggagatgaacccgccgcgccaccgcggcggcgacatctcggcgaggtacaccggcgtggcctggcccgagaacccgagccccaggccaagcagcatcctcccgatgatgagcatggcaatgttgaccgcggcggcgttcacgagcgcgccgaccaggaacatgctgcccccgatcagcatgacggcctgccgtccggtccgccgggtgacgcggctcgccaccagcgtcccgaccatgccgaacgcgtacagcgacgaggtgaacgccgtgagcgcctggctgttgtagatgcagtacacgtccttgctcgcgtgcgccgtccccttcagcaagcccgggaagaacttctccaggaatgactccatctccgacacaccacctgatgttcgtcgcagacatgaacaagatttgtatctcaaacgtaacgaaggaaaccgatgataaattgatcacttgcagaacacgagcaacccaggcatcagttcaagtttcatctttgcgaccaactaaaactagaacatatgagagtgaataacttgtgtcacgtaatattttgtgttttacatacactttttctgccatgcaccaataatcatacatgctggagatagtggtttcgagggatctagattgtcttctactcttctatactgtagacaaccattaagctatgggggtaacagtaaattactgtagtgagtgacacgctgtagcgattactgtggtactttgatctcagttgggcattttcaaattccaatcagatggcaaagagaagtcataatgcaaattattgtctctttcaatggtaagccacatgctactacaaaggatccaattcaggtgctgtgtataataatagtaaggaacggcagaaaaagaaaagctttttacaaaacactatggatgcaccatggtcatttcattagaatttatttcttttcacgttgatagggattcctagtatttctatttgacgcattttagtcttgatcaatcatcacatcaacaacttatctccttagaaaaaaaattccgatcctgtcaaagcccacacaccatcactcaagacatgataaaaacccgattccccgatccaaagcaagatttctaccatcgagtggcctacaaatactactatactcgcctatatagcacatactaataatctcgacaagcaagctagccatgccactgaagaaaaagaagcaatcataatctctcctttcttttgttgcaggaaagcaactgagaccaaggattccaggaagatgcccgtgaattacagctcggggtttagcgcagaaaagccgcaccaaaactcgcggcaacaaaaggaggggcaaataagatatacgacgagacgccaccatgacatctggtctgaccgaagcagcagattgcacacagaacgtccaaagttgcaagtaactgtcgatgcacacctagcgacaagttgatgtactacgttccgagcgtaagatgtgggagcagctcacgtccttttcccacattccacatgagcctcatttaaaattcatttggaagatgaggtaaattttgaggtatataaaatctgtactcatttaggtctcgtttggaagatgagaaagttttacactattaagtgtgtgcttcatataggctcccatcggatggcccaataagccaaattttgaattttcaaacttaattttgagatattttcaacgtagttttttttagcattggcttttaagttacaaagagcacatatataaaagttttacttacaaatttatttttattccctaataagccgttttggcttattagaaaaaaaaaagccaaccgatggagcctataaaccctaaccgaattttaaattttagaagttaattttaaattaatataagtgtttttagtgttttttattgtttttgtttggtattggatttaaaccactaacagagctatatcaaattttgtctctatttttttttgcttcgctgacatgttttaaccgaaaaataaataaaagaacagaactatataaaaaactaattctaaaattttgcgtttcaaacgggcttaaaactttgaaatacagaaagtggtaattcccaagaagattactgctgctatgtgggaatagaaaaaaaaatgtgctgctcaaaataaaatctcactatcttccctaaaaaaaaaatctcactcatctaaaaatatctcaggtacccctcaattctaaaaatgactttgatttttggctcagtaaagctctgattctaaaattatgtttggttgtcagccacattttaccacagtttatcatgtctaagattagataagtttgatcataattgtggcaaaattcacttttaataaatcaagtcccacacgttaatgaatcaagaaagtgtgacaagattatcttagacttgttaatgtgggactcagaatttaattatctcaacttaaacaagtactaacaatatttaaaaacgtggtaaaatatagttaggaaccaatcacacttaacagcctcacgatggaaagagagtcaacggacatacttatgggctctaaaggtttaactgtaaccaacctgacgtgtctaatggcgctccacgagaagatgggtaggccgtacaccggccgctcgctggccccgccgccgcagtgtggccatccaattcgaccggattgtgtcgcctcacctggtcccgcccaagcaggtgaacgggcccacgtgtaaggatctgccaggtggggccccacctccgcctctatcccctcctggccgtccgatggctaacgcgcggctcggatcacgcttcctcgaaagatatctacttcctggattttcttctgtgatgtgcccggttaatcagcagctgctgtacgttcggtttgacgagagaacaagagctgcgtcctcttcggcctctctgggctttgatttgaatgaacgcggaaatatcacacgagaactaattgttctcccgtgaatcttctcaagaatagaaaaaaaatatcctcttcctctgttgtaaaattcaccagtttgattggattagatttgttcgctcgcgtgatgcttacacctgcgcgctgatttttttttagattattaaaaactgaggccagatttggactactccatgtgttgggaatctgccgtggaagaagcagaaacggaataaagaaaccaaggggggcacagggcagcagttgagatgcggctcggccatggccgcttcagatcaaagaaaatggtcttggcttgtagcgagtgacttgagagacccaggaatcaagtcctcaaagtgggctagccacaagccacaggagaatcgtatcgttgtcgtcgaggtcgtgatgaggggagatatgatggattgggagaatcaccgactaaaatgagtggtaaatcaaatcgaatcctacgcgatacgtgtgcagagatttcagaagaagaagaaaaaaagaaaaccacggaattaaacattcagaaaaattttcagaaaagagcacccccaaaccgcatgcaattgcaaagtaagcgatcgatcgaatccgatccatctccagcgcacctgagatgccaatgtcgtagccgaagatgaggccaccggaggccgccatgaggcaggtaaccacgaccgggaacgtgaggccgccgccgctgccgccaccgccgccgtagtccgccatgccgccgctattgaggagggagccgccgggcattctccgtcaccaatcttcagagcggccaaatgttgttgctgctgctgctgctgatgcctgatgatagtgttgggagtccaaagccctccaggggggagagtctttatagccactggcctgcctgcctgcctctgtcgctagctaccactcctactattcctactgccaggaccgtttaattctggcccctttcacatgaaggcgctgctctgctgtgccgttgcgttgcgcgacctgccttatctgcccccgccagcgccgcacagatcaggcggccgggccattatcccaggagggaagaatggacaaattcttcgtttcgtttcaccggcgcgcgcccgcgtgaagcggctgcctctctcgagtctcgactcgacacgtcgtgacaacagggggagtaacagtgtcccaaatgcggccgatatgatgtgttggtgcggttacaagattggcgccgagcgcgtaaaccggatcggtccgttttggtggcctacctactatgctgccccgattggatgctcgcgtcgcatataatggatggcacccgagcatatatgtatcgctattcgctacaagttcctgcagcttttgtgcatgcctctgtggcatatatgtgacatgtatagtcccgtcctgcacattatgaccggccggttgcacgctacttcagttccattggtctaacagatgtgtaatccaattgttccggtagctgatgaagaaaggtatacatggttcacactagcttgtagattaattcaccgtagcacatcctagtcgattcttcctcaatcccaaaacaaactttttttagtgtgaatctggacataccctaagcatattttatttttatatatgaaactgaaactgaaactgaaactgaaactagagggagaaaaggtgtgatggaaaaactgaacttgtactctctttttttaaaatgggaaagctttgctctcctagtatatatatatatatatgtatatatatgtatatatatatatatatatatatatgtatatgtatatatatatgtatatatgtatatatatgtatatatatatgtatatgtatatatatgtatatatatatgtatatgtatgtatatgtatatgtatgtatatgtatatgtatgtatatgtatatatgtatatgtatgtatatatatatatatatatatatatatatatatatatatatatatatatattaacacaacaagttcatctgtgcacgtataccacatgcgcgcaggtgtgttgttgttcttctgcgttgcgcctctctctctctgtatatatatatatatgtgtgtgtgaatctagacatacttaaaaatatatatgtccagattcatataaaaaagatgatttattttggatggatagagtatatcggtgtacggatgaacgtaaaccaacggtgatcggttcatccaagagctggcttaccaaatttaggttggaaactttgggatcatacgcacccagatgtggaggaagaaatcagcacccgttccaatcccctagcgcgctattctagctatgtacggatgcacctttgttgcacgtcagtcggaaggcaagaaaatagtacgacatcgacatatatacccagaagctagttcacgtatgcgccgatcaggcatcccgcggttgaaagcttaataaaaagtaggcaaaagcacttgccggaaggaggcgtactctgttgatatccatttccatttttctttcccagaatatatgaagaacttgtgcatcacggtatagaatttaagttgcggcagactaaaatttaaaactttaaactttaagctcgatgctttttcatcgtatttattttctaccgtaactcttaggtcaccaagaacatatataaatatatataaaaaaaactatatctataattttttatcactaataagtatttaaggtttataatcacttgtaaatgaatcaggctcatagttttgtatggtgttcgtctctaccgaagatgaagtttggacatggaaaataagaaaagtattagcgcatgactaattaagttttgattattattagcttaaaaatgtatttatttaatattttaaattaacttttatatagaatgtgttcgcacaaaacacaccatttaatcatttaaaaactagctaacaaaaaccaaaccaaggtagaatctatatcttaatcaattgtgaactgggctcaccagtatagccgccagtgcgaaggagcatataaggaacatgaggggctgcagg

SEQ ID NO: 64797 - DNA, 4420 bp, Oryza sativa
cacaaaaattattgagcatatctgattaagtgatgtcaaatgtctgtgctatttgttgatttatgaaatataatataaaatagtaagttggttatgcatgagaacatctcaaacaagcattaggtgcgatactgcgaaattttgatgattgaatagggcatgaacaatgtaagcaacggcgccctcaacctcaaggtgaaagagtgtgctacatacaattcaatatacttgatttatttttatttacactttcatccaaaattgcgtgcaactaccactctccatagaaaaaaaataaaaaggttgtatataaaataaactagtttaaaaaagatgggcaaaacctttgatgtcaatcagattcatgtcgaggtcatgctgaagttgaagttatcatcgagaatccatggcatgcttcctatacattaatatgatctgccattttactgcagtctcagatgaaccatgatatggtttcctgtttctgtcatgtcatttttcttgttgtaaatggcctcatgtgtgggttcataccataccacaaagtgctcaccttgattcttttcctagctgtttaccttttgtagtagatttcctgatgatacttcaacggagcaaaaccacttttcttaattgttgcaaaatcacttctcttaattgtttagacccatttccaatctatgcaattgattataattctcatgtttgaacctgctcttggatgcaaataatacttagtacacagctgtactcatttggaacgtcaagattttaattgtgtggcatgttttgtatccctatctcagagagttgccgtagctgtacattgtgggattcgatctgcatgtgttcggttgcattgccataccatgtttcatccatgcatgattccatgtcaaatgacattcatgcgcttagccgcaaaaattagctagacagcttatcttattaggcgatgccaaatgtcagtgctatttgttgatttatgaaagaaaaatagttaagtttgttatgcatgagaacctctgaaacaagctttacgtaggaaactttgatgaaacggcactgcacggaatatgtcgtatccgcgcatgtgagttcaatggaactcaaagtctacaattgtgtgtgttggacgcatacgcgggtgtgtgcgtgtggtgttgtgtgaacttagaataagttcgtgtgcgtacttagttgtaccttcataaaaaagtaaaatgtaaaatactgttgttttgatacatggtatatgcgattagagcaagtttaatgaaagcgccggctactgtctccaaaacaaccaaattggcctagttagtatagctagtgccaaaagcggaccactatataatcggctctctacgcatttttcactgatagcttttcttttttctaacctcagctttcacggtataacctgttggagcatgcgtgcatgcatttttatctctcatcttcttttcctgcctttttttttttgccctttggggagacaaatctttccgtttcacttcccccttgggccatttgataaagtcatccttccatccaatatccatatatgatttgattcccatggtcatggtgggctgctggctgctgctatgctagtgatcgatgggtgagttgcaggtgagctcagcgcacagcgccgtggactcgctcctggggcggctgatccggatcctggaggacgaggcgaggctgctcggcggcgtccgcggcgacgtgcagttcatcaaggacgagatggagagcatcaacggcttcctcctccacgtcctccacctcgaccgccccgaccaccagctccaggggtggaccaggcaggtcaaggacctcgcccgcgactgcgacaactgcgtcgacgtctacatgcagcgcctcgccggcgccggctccggcggcagcgcgcggcggctcctcaggtaggggtgcaagtgggtttgtccgtgaactcgcttataggaaaaaaaaagtgcgtaacccacggattcgatttacgggttaaatattaatttaacttataaatgggtttatggatggatccacctctatatttagatacggcaagccgggttacaacgagaaacgaaatcactagttagcgtgtgcgcgctgccggcgcgcgttttatgcctagaaggcccagcgccggcgcgcgcgcctctccacgcttttttttttcgtttttttcgtttttttttcctcgctttttttctgacttttttttatcttttaacatgttttgagtttaaaagtttttaaattttgagtagaaagttttcaaatctcgagttgaaagttttcgaatctcaatttgaaaattttcaattttttcaaatctggatttgaaagttttcgaatctcgagttgaaagttttcaaatctcaaattgaaagttttcaaaattttcaaatctggacttaaaagtttttgaatctcgattctttagttgaaagttttcaaatctgagttgaaagtttttaaatttcaagttgaaagtttttaaaatttgactataaaatttaaaacttaaatcgaaagttttcaaatctaacttaaaaatttttcaatctgtcagtaaaaaaatctcgagaatattttcttaattattatcattagtgtcagtatattaataaataatataggtagttaaactaaaagggagaaagtgctcgccaactctttttcttgcgcgcgctagcaatcccccgcgagaaaacccataaattattttttatttgaccttagcacccctatcgtcaggctcctcacgctgccggcacgccgccgcatcgccacgcggatccgggagctcaaatcgcgcgcctgcgacggtcggggagcggcggcgcaggtacggcgtcgtcgtccccagaaccagaaacaatgccgccgccgccgccgccgcccgtcgcggcggccaacgtgggctggcgaagaggcagctgtcggaggctggcggcggcgaccaccatgccgacgcctcctccgccggcaacaccaccaagcaagatcaccggaggcgcgcgctgctggaggaggagacacccgcgaaccttttcgcaggtgaaaccgacacgctggtcggctggctgctggctgccgccgacgagcaccgacggccaaaagtgatatcaatcatacgacctgatgacgaggagctcgtcgcagctgccattgatcctgtaaagcgagcgttggatgatccgcgcatacttgaattgttccaaatcaggcagtggcacagcggccaatctcatcccggctgggtttaccaagacatgatgacacaaatactccctatgattcagcacatgcatcgggcgctgggagggatggtatccgattacgacaagaggaacaagaggagatatacgcggctgaagaagaaaaagaagagaattgtggtctcaaatttttcgagaaaaaatctgggctcaaaggggaacaaatttcctgtaggaacgacgtttgacgaggtgaaggaatttatcggtggaacagcatccgacaaggatgaggaggaggaggaggaagagggatttctacaagcagcggcaatggaagttcatgaaagatttgcaatggacgttgccaagattatttcagaaacgatggcatccgagatgggatttcatcaaggaatgacatttcaggagatgatggagactttcatgaaagataagagctacctaattgttcttgatgatgttcctgatgaatcgctatggcgtggcatcgaatcagctttccccggcaacacggctcacagtgccatcctgctgacaacccggtcacctgccgtagcctactcctgttcaccacatgacagagtcttccctcctctggatcatctcatcgacttcttccatgccaaggctgtctccctggttgaaaactatcccagcaacggtaacctggatgaagtgattagatccatactgtcaaaatgtgcctccaactccactgacatgtgcatcagagcattcctccatgtcctttatgccaatcctaacaggaacagggaagaacttcagggcttgtgtgatagcctgcatgattcacatggtttaatgctggatgaaaacatgcagcaaatcctgatgttctggtacaacgacctgcctgtccattacaagagctgcttgacgtatctctctctatttatccaagatgatggaagcagtagcaacagtactatgatgatcaggagaacaagcttagtcagaagatgggctgctgagagcataaacacagaacgaaacgggcagacagcgctggatgaagccgagcgatgctttggtgtgctcttagcaaaaagatttgttcttgagagagacatcggcgcttctgggaagatcaagagctgtgcagtgaatggcttgatctcaaagttcatcaccaaggt

SEQ ID NO: 64798 - DNA, 1881 bp, Oryza sativa
gattgtctccatacatattttgccaccgattcttttaaaacctcgcacatgggttcgagtgggtgtatattatcctcgtgagtttaattcgaatagcagtggcttgaaaacaccacaaataaataaaatgacacattggcacgttttccctacctaacctttttacctttttccaaccatcgtgtgtatcacaaatttcaacatgtccttgttgcggggagtacagacatgtaggaattgctctgttagctgagccatcctttttggtgatccacttctgttatctaatgcttgcttaccttgctggcaatgaccttttttatgctttgtagttagtgctttttaattagagggagcatcagcaggtagagttatgaaatcttctgcatagtttaatggccaagttgggcatcacggttcaatggccttgtcatctctagatcacatccgctagcatttctctttcattgtgtgtggtagcaacaaacacatctttggcccatttaattctgctaatagagactgtttctgtctcaactggtgaagaaaaaggattcagatgcattattgttgattaaaaattgaaaacatctaacgttcttgccttttcaattcaggattttacaagcagctacctagggcatgctgcggggctcctgggtccgttgcgaaggccgcttacaacttcaatgtcacagccaaatgtggtgaggttggtgcaaccgcgtgtgatgatccatcaacccattggagctgggatggcattcacctgacagaggcggcttacggtcacattgccagaggttgggtatatggtcctttcgctgaccaaccgatcttccaatcttcatgagaaagtcacttcttccgttgtaattgtagaggtgtatcacgatagtgcactgaaatggagcagggaaagtagttcttccatatggttccaaggttgcatacatgtatattttcattctattacattcattgcagtcaggtacaaaggtggaatagggctgtcaaaagcttgattttgtttatttgtcaggcgacataactatgaaaatgtaacagacacatgattgtgtaaattgcctccggaaatatgatacaaattgtctttttgagtatctccggtttccctggttcaaatctgccctgttattagcagcagcttttgtctgaacatgttgctgcgttcttgtacagaaaatgagctctgcctgaaagtttatttttggtgcattttagctgcaaacaattagcagaaggtgagggttactagtgctaattgaactgaacatggcgaggtaacgggagaagaatcctgaatatacaattggcagtgatggatgcagaattcagaacagtgcatgcaggtgggagttgaaactaatgaactgatctgaagaatctatttttattattgcgttgtacgttgcttgccatgtgattcgcacttatttttagcagcccacgaactgacgaaccctggtttgttttctcctttttgttgtcagtgtatccctataagttttgaagtatgagctgtcaatggagatatcaaaagatatcgaaaagcaaagaaatttcctttggtactagtaggagtgattactgaagcaagtacatccaagttaactgaagaaaattccagattgcattagtacttcttaagggaaaaaagattcgtttaaacattgagcattaggacaaacgagagacaaaggacatacttcacattccagaagagttactttgcaagtgacacatctcgtgtttcagaatcccacatggtcgtactagtgcactagttacttacgatctgtccaaaagaacgcaattgttatactacatgtactagtacagtatattgtcctactgccc

SEQ ID NO: 64799 - DNA, 560 bp, Oryza sativa
aattgttatgtaagatttattttatcataagttgcaaatactagttcaatccacagttgatgtcacttcagaggtactttgcattcagattactcaccatctttcggggtgtttgttgtgcaggtattctcatgtcagttctactaggattcttggtacttcagtcgtatattttggttaccactcatgaacatggagttggggtgcaatagattatggatcaaatatcgtcactgaggaatatctttggacaacaatgaatttgcagtgttttgatactgacattaaggtgtgcaacttttttctctccactgtcacatttgctacccatacaaaggtgttctagcattgtttagttttgaaacacgcaaaagacttacagtcatcccattagatagaaaaataaagggctacaagtcggccaaaaacaagaataaccatcatttcatatcccgatatccgtgtgtcatggagtcctgtcaatctcaggctaatattatgctcaacgtattcttatcgaagctgcttattcttcttgctatcactcaaattatctatga

SEQ ID NO: 64800 - DNA, 544 bp, Oryza sativa
agtagttgttcgctttgttcggcggccgtttccgtgtgtagctgtgtatgccagccagccaagggggatagagggaggaatctgtatgggccggatgggctcggcccacttgaagcagcccatcattgatcagggaactgggggaaatttgcatcctcaagttccaatcgcatcccttaaccgcaaaaccgcgtacgaggcatccctagtcctaagggcatcagcaatgtttgctatccacatcggtattagcgtgggcccagatgacaggcggtaatagagggagacgtgctccacattgcttatatctgtgagttggcagtaaggtggggtccatggggtaataaaaatcgtagcaaggacagagcatgcatgcaacggttgggagaagcaatgcttttgctgtcagaaaacactgtgtacatgcatattctatttccttgcttccggcagtaggggtatgacccggttgtagttatgtactagccccacaatgcttaataccaggtagtaagagtgtatttattgcttactacccggtttg

SEQ ID NO: 64801 - DNA, 52864 bp, Oryza sativa
cccatataggcccacgacttaggacttaacccggcctgctaatcctacgctatagccagtgcagcgagtgatctcatctcaaactcaccatggcctcgccgccgccggagcgggcgccggcggcggaggctcgccggcgcaggacgacggtgtaccacggccaccgccgaccgtctccgcaccgccccaccgtccgaggcggcgtattctccgacctccgcgccaccaccgccgcctcctcccaaccgaggcctccctcctcctcctcctcctccgccccattccgcctcgccgactgggacccctcctcctcctcctcctccacgccttctccttccgccaccgcggccgcccgccgcctctccccgctcgcgcggttcctcctcgacgcgctccaccgccaccagcgctggggcccgcccgtcgtcgcggaactcaccaagctccgccgcgtggcccccgagctcgtcgccgaggtcctcagcgctcgcccgccgccgcccccgccgctcgcgctcccgttcttcctgtgggcgggacggcagaagggcttccgccactgcttcccggcgttccacgcgctcgcctcgctcctctccgccgctgggctccccgccgcggccgaccagcttcccgacctcatgcgagcccatggcaagccggtctcgcattcccagctcaacctcctcgtcaggctccacaccggcgcgcgtcgcccgctccgcgcgctccacgccctccgccgcttccgccacgagttctccgtgcagcctgaggtccacgcctgcaaccgcgtgctgggagcgctggctgcggctgggcatgttgatgataccctcaagctgttcgacgaaatgtcgcactgcagtgtgcggcctatgccggtgacattcgcgatcatggtgcgtgcgctggcgcgggcggggatgacggataaactcctggagatgattgggaggatgcgggctgaggtgtgcagaccggatgtgtttgtgtacaccgcactggtgaagacgatggttcgctgggggcatatggagggttgcatcagggtttgggaggagataagaagggatcatgtggatccagatacaatggcttacaccacaatgatagctgggctatgcaatgcgggaatggtggagaaggcagaagaattgtttggggagatgaggaggaagggtttgctggtggacaggatggtgtatgcgtctctcattgatgggtatgtctccacaggaagggtcagcgatggttgtagagtgttgaaagagatggtggatgctggttaccgtgcagacctggggatctataacacactgattggcgggctatgtgagatagagcgggaggataaagcacacaagatgtttcagattgtcgttcaggaggatctaataccaagctccgagactgtttcaccattgctggctcgttatgccgataagggcgagatggttaagttttttggattggttgataaactagtggagctaagcttgcctatagttgaaattttagtggacttcctgaagctctttgcatgcaagagtggcaatgaattgaaggctgtggaagtttttaatgctttcagaagaagggggcattatagtgttggcatttataacattctcattgagaatctgctgaagatcaaggagaggaagaaagcacttgtgttgttcgaggaaatgcaaagttcagatgactgcaagccggactcatgtacatatagccatatgatcccatgttttgtggacgaaggaaatattgaagaggcttgctcgtgctacaacttgatgatgaaggcagtttggataccaagcatttcagcctattgtgctcttgtgaaagggttgtgcaaaaaaggagagataaatgcagctatttcacttgttaaggattgtcttgggaatgtggaaaatgggccaatggaattcaagtacaccttgactattcttgaagcttgccaatcaaaaagcccagagaaggtcatcaaagtggtggacgaaatgattgagttaggttattccatagaagaaattatatattctgctattatttatggtttctgcaagtatgcaagttcaactgaggcaagaaaagtactatctaccatgagagatcgcaatattatttcagaagccaattatattgtttatgaggatatgttgaatgagcatttgaagaatgtcactgcagatttggtgatatctggattgaaatttttggatcttgaatctaaattaaaatggagaagcagagatgattgagaaatctttgtacagttgctacatactaggtacaacctgcttcacttcacttgtgatttgtgctatttagatattgtattatgtgttacctcttgtgagttgaacattgcattatgtaataaatagtcctaaacacttctagggatctcataacctggttattccatggtatgtttagctagagttgatatccatgggcctctggtttgtaccaaattatggataattcatacttcatactgatcctgatcatttttctcaagtattttttttaagaaaacacaaatctggtattccaccaaaaaagtcaacatgtgggagtggacgtggatgagtttgggaacccttgttgtgcttatccctccatagatttatcatgagaaaatttaatgatactgtagtatgtagaacataagtatgtatgttacttgacagacagttatttggaaaattcatgcctgcataatgttgtgtaaattcatgcctgcataatgttgtgggcatataggagatattgagtaaccaatgatggttctcacagactcacacagtcacactaacgaatgggcctgatcactttacattattggtgacattatgcagagaaagtaggtaaaggtagaagtatacaagttctctaatgagcaacgacggcactacagatgaatgagccttacagcataggtgttttttgtttacacaatttggaggaacaagcagtgtatacaaccagttccttctgagtttgtagtttgagcaggccaacttggtctgaggcatgttagaacttagaaagatgtgagttgcaagctgagaaaatatgatttgagtactgattagctaacctcaagcagcttggttcttgccctcccatatcaagtcccgatgcttaataaaaacagagtgcatggtttcctgccgtttaacattcattgtttatttatcttcaatttacgagctggtgttgagagcctgaactaatggactaattttgtgagtcaactcttccatgatatgtcctccgttttagtatttaggattcgactggaccatttatgcaaacacacaacactgacacctatgtccccagttggccagtcacttggttaatggttacataaatccatgcacacccttgcttgtagctaagtattatttcattttacttttaaattcaagattgccaatcttttgtgtaattgctaatagcagtactgtattttgacatagcagagataattaaagcaattttcatcgttttgttttatcatgtctcaatattttatgcatgtatggtaaatggtaatgtgccttcatccctgtatcctactacatatgttgtaccattagcaagttaaagaaacacgcacaccaaaaaaaaaaaactgactcggtccctatatatgggcaagtggtactcaaatgaagtagtatatcagtcccaacttctttcaggacggtaatgatagcgtttcattttactggggagctgattcttatcagtgacatgacactgttgaatctttaaagggtgtggaatctggatcgcttcctctctacattcctttaaggtacacactaccaatcgtgcaataggatctgcaagtattgttataattaggtatctgctccttattaccatgttaaacctcagtaacttgatcaggtttcttcttcacaaccacccctggagaactagcttccttagatgaggtgaaaaagccaatccagccaactggtcgtacaagtgagatccatctggtgcagcctggaaggttgatggcttgatacagaggtaaactagcattaattcttatagttaatcttttcagcagtactccgttattctgtcatctaccctatagttcaccaacacagtgttacattcatcattcctcattgatcggtcaggatcgtctcccacagatccgatgccccaggtcgctcccacctccctcacggcctcaccccatcaatcatgcgtcacaaaatgtgctctagcgagagatcattagactagaatagttcatttcggtcatggaactgtacttcaccttctatgttacagtggtactttgattatcaattccatttggtactcatgccgatccagatttggtgcttatcattttcatttggtactcatgcttcaataattcttgctttgatgaattgttgctgatccacatctttcatgattaatgtaacatagtctgtagtagcagtttaaaactgaatcagtagcagtttaaaattggaaccaagcgcattctccatgggatgccttaaatgactgattagtgcatgaagtaggcttaaattgcagtcaaaatcagtataatgcgttagaagcagatgatttctagatactttatttaaggccactattacagtttaaaccatataaactaataggaaaccatttgctctgagttgccatgtcttataagaatgcgttgctgtgagatgctccggaaaaaaaatctttaacctttcggcataatatatttttaactgaaatactttacacatgcattagttatgtcctctaagatcatgaaattcagtttattactgtccatttatgaatattccaactattttgccagatgatgaaaagcagcttgaggttttgaatctatgcaagtttgttcttactgttctgatggtacaccttatttcaggtacctaaaattgtccttttattcagtagtcctttcattaggtcaataagctccttttttgtgttgccactgagtgtccttcatttgttgttagagactacagtccgaaatttctgattatttaggcagttagaagtcccgagcagcggcaaccgggtctcgcccagcctccgctcccaagctttgagatttgagaatcccgggtaggggcagtggaagccgagggtgccaccatccataaatttctgtctgtaaattatcacactttttaggactaaaacttcggtattgtgaaggaaaacaagaaatgatatttattttatgccattctttaaattttggtatctaatatgaagcttaaaaaacacgtgcgtgatgtattttaaattgtataatctatattatcatatattgttgtcatagcgttagcacgagcatattactagtcttaataaattcatgacatgatcttccctcttctgaatatgtagtttttctttctttctttccttttcttttttcttacttcaagagataaattgtaggagtcagcattacattgcgtctcgtcatcaatgatatgtattcaacccgtagatgcgcatgtcttgtgtttttgcaatcctattccaagtcgatcaataactgcctaataagaaaccaatagataggccaatcatagtgctatttagccatcgctgtgatataattataaattatgctttcttgttgcttgtctgctttgcactgcaattaagatgtcattgttggaacagaaacttgtttgccggggcacacaataatttagatatgaaaaaaaaaacatgtgtcttgtcttgttctttgcagtgtgatttcatttcaattcgccgactatatatttcctgaagccaagaggggcaatcaggcgcatgccagacatgggcataactgttggcatatggcgttaggtataaccgttaatgcatcctgacgccgacgggttgctgtggatgtctgtgtacattcctcttgattgtcaccaattattttccagcatggggcgtcctgatgtgtaagtggctgcattgatcgttgatgcatgcatggactttgttttgtagtgttggataaatttaggggctatctatgcatttgttttcttctgcattttttttcttctttttatgtttgtgtaggcctttatggttggaactttgaaatgttgtgatttatgttgatgtgttttggagcacctttcagaattataggagcggtgactgacaggtgacgaagaaagtactttaggttcaggtggatgagatgaactgaccttaaatagatatgtagaccccagtgcattttctctcctcgtagtttcatttttctcatcgaggctatatttggaacacaggaactccatggaaattttggggggaattgcatatatcagctcatttcctataggaaaatgggatcaaaacctcacaaacacatcattctagtgggtgatccatagtaagctgaagttttatgcttctgaaaattggtagaaatgcgacatcgatgcattctcaataagaatttctcgattttattagtttccttagtatattgagtgtatgttaaaaaggagccacttttgcttgtgtgcgtggtagagtgtgtgcatatgtatttgtctttcatgcaatgaagaaatgaggggaaatggccaatattgtccttgaagttccattccaaggttagtctagtccttagcgtttttatattatccatacaagtgtttaatatttatcatatgacctaatatcgtccttaggcccacataaatgaccacttgcgcgtaccatatatcctcccatgcgaaaaatgatgatgaaatgaagtaaattggacccatcatatatagattttgtatgggagatgataatgtgatataaccgtggtgatttcgatggcgcaaagggttatattatgtgtcatgataaatttatcggttcatttggataatataaaaggctagcgactaaattaacctgagctgggacatgctattctcccaagaaaaaaaaaagagtcgatgacaatacactattttactgcagattgacaagatatcaacgttaactacaaatgcagctaagggttcctttggaacgtaggaatacaaaaacacatgaatagaaaaaaaatgtgggaatcgaggtgacatgttaattgaatcctttggaattgtaatctatagggattgttaaaatttgctgtttgggtccataggaaaagtataggattttaggagagaggttgacataacaaagttcccgatgaggtccaaccttattttagaaatccttcaaaattccaatgaatcaagccactccatatgaattttgtaggattctcaaatacccttccaaaggagcacaaaggaaaattttccaggggtttctaatcctacaaaaatcctctatttttcctttgttccaaaggagccctaaacaaacggcatggctggtgagctgtatacactttaatcgtccatggatgtacgtacgtttcaccgtatttctacttatttttctgacaggacacatgtacgcattcagtagagttataaatatgtacttgtacaataactccatgagtgctatactagctcacgagaaagctcgaaatggttagcttgaccagctagctagcctttttgtcagttttttctagtatgtagtccctccgtcctttaaaaagaaaaacccaacttaaaacttggatgagataaaatctagcataacgaatctagacaggcttttaggttgagttttttttttggacggagtatatagctagctagctttaaattgtgccagcccatgctgctgtacatactgtttgtatattcaacactccttgtgcataaattaaaaatgcaaaaaaaaaaagcaatcttgattcctgtgagaaataaactgaaatttgtagatagaacacatgaatttcaaggatgagttctatttataaggttggggaaaaaatcatacggccttaaccctaaaccacattatccgtcgacccatgttcagcgatgtaaataggtcaacccatgtatccgtaaaccacattagtattttttttccttagttatatactaagaatacatgattttataaatattccttttgtaaggtatttttggggccatgggttataaaagccaaagacacataaccaaagcaataaaaataattgtcaggtaagacttctatacttctactcataatggtctcaaaagccagagaattggatcacaaaagtgataaaaaaaataaaattaattctacaattagccgtgatttataagctgaatttggaaccagcatgactacattattcatgacataataatacaacaattagtttaaaattggaacatgtacttcttccccaacatgtttccatcctaacaccatatgacggttaggaactcaacttttcgcttatgattatgcttatcaaccagaatttaaattcttaaccttaaatttgaatttgattttgaggttttttaatcgtagtttatttttcagcttttacttttagatcgtttagaacatttatataaaaattttattcacaaattattttttatttgcaaatatgtcgtttggcttatttcaccaaacatccaaacgatgggactgttagtctttttccagcttaattattgtgtgaaccaacaataattacacgtttttacggcaccacaattttttcgattaagatgtatataaacaactggatgtagtcaatagccgtacctgtacgtgagctacccctaccgcaattaaattattctcttctagccttttcttttactatatcttttctcctctcgttagttatggctcttattgttttgcttacgtttttacttataagttaaattttgaattttaaaattgattttttttcatcgtagtttattttacaacatttgctaatatacgattcggataataatgtttactcataaataaatttctgtcttttaatatacgatttggataaatatatgaataagcgaaagctctatttattatatatagtatatatgcgacgagtagtggcacatctcacacagatcttcacatgcaattgagtaggactggcataatgggaaaaaaattaagaatgtacacccaactttcggctgtaatagacagggacatagaatctaatgtattgtacactcaaatcaaatggttaatcgatattcaatcaatcatcggttaatcaattaattaattaattatcccctctagctagttactccaaaaaatctgctgatgtgtatcgtcaaatctggtcatacattagtgtaatctggtctcaaaaaatatatctaaagagagataaagtaatataattacacaatcataatttgcccaactaatacatccgtagtgacgacgatagtgtggactggtcccacatgtcattcaggcggtactcgtaataatttcagtaagataaaatatctgcggttcacttcgccatgcatatcacaaaccttgcaagttgcaatcttgtatactatagtatgagataaaaacaagagagaaatttgcaagattagtatttatttatgactttgttacttctcattatcctggctagcatcaaaagcttgcagagatcagacccaagatttgtctagctggctgctccagactgatgataattaattggctccatatagctagctagcttctcctgaacatgctaagctagcaagaacaccctacaacacctggacaactggatatcagattttattgattgaattaaagacaaattaagaagttggaagaaactaaccattcattatatatatatttttagataataaccattcattatatatgttgatgatgcaaagaaagaactccttattagtctctcacacctgttcatcttcagatcttggcttgctagctcatgtgatcttcacacctgtttcatcctcagttcttgactcttgctcatttgatctccaattaattcatggatgctcagctcccaaacaaaacatctaagatttgatcgatcctgcaagattaaaatctgcacacagaagaatatataaatttgcatgtaagcctcacaccaacatatatatatgaatacaatctggccctttaattttgtgcagccacaagcagatgaaactgcacagcatgatctgatctttgttttggcagtcaattctgccctcacctaataagcactcatcagatcatgctggcagcttcagctcctaatggttgcacctcaacaatcaaggctgtgtttagatctaaagtttggatccaaacttcagtccttttccattacatcaacctgtcatacacacacaacttttcagtcacatcatctctaatttcaaccaaaatccaaactttgtactgaactaaacacagccaaaattcacacacacacacacacacacgagagagagagagagagagagagagagagagagagagagagagatatgagaggaagaagaaggctctgagaggctttatatagcagtggctccaaattactctgaccgaccagtacacactttgatataggtggttatatatatgtgtatatatgtttgaaggatatatatataatacggcttagttatctctagctagattgatgtaacaactaactaatgtggtggtcccattgcaaatttgcaatacactgtgtcactgtcaaacacacactaaccaccacctttcagttagggtttctaaaatatattttctgtatacatggatataaatgcatatatataaacaatattggccacatgagctctatgattttagtctatgcatttagggccatatttaaatttttggaagtttttttcgggtccctagtgccagccaaccaccacttgagatcttaatcatacatagtactttctagtcttttgctaagctattctcattttgtaataatttgttgatgagctagcttttgtaccattttgataattttgataattaagccagggccatgtgtaaatggatgctgctcccaaagtatcaacaggtcaagcatttggatcttgcatggaaaggtcttggtgatttgatataatgaaaatgtatttagttttttatttgtctgattcctaagaaattgcttttgaattattattagcattgtcttgaccatatatataattaagcaaacaattttagcaacaagctaggaaagcgagatgcatatgcctgtgaaatgaattctatcacctgtctggtagctggcgtattgtgtatcgtgtgatcatgcattgcacacatacattagaaaatttaatgaatacagattaattaatttgtaatatatagctggcatgtagtacactagtaccttgcagaaacaaaaatatgtatattagtatataacatgtgtgtgcaggagatctacacgtagtacatggcgtgcaaggcttgcactacagtttttatcttaactaaaaggtataaattattggagatgcatgcatgatttaataattgattaattagtggagtagttgattggatcactctttaaaattatactgtatgtaggatgtactatacgtatattaacagttgttatgttgtactaatgtactatataatggcaccaaatttggcacctcaattctcatagcatgtgcttgtgtgaatgagttgtctctcgatctagctagctaggagtacgaaaaatactcccattaattaacatcgacaaaatactcccgttaattcaccatctacaggttatactccatccattctaaatatagggtgtagctatatttcttcaatagtaatataagatatgcatccatgcatacaattaattagtatttctcctctaaattcatttctttaaaaattctctatgctcttgatctctaatcccagtggggacatgcattataggacatgcattatatttagagaacttttacggtacaacatactaccagtatatactggcagtatatagaagggcatgttaagaatttgatagaaaataaaataacactttagtaatttttggttcagattgaatttaattgggagtagccggtcctggatcttatcgtgcactaggggaggagcatcttgagcgccatttgatgatgaagcacgtgacgatagcacgatttgatgatagaataacgaagaaaagataaaattaccctttcaaactttatactgctatctaattaactaaaaaatccaatcaatctacactgttagatcatatatactagcagtatattgtaccgtaaaagtcctctatatttattggggtgataataattatttcttggtcttttaactctttatgttagtagtaacgtcatatattttggagtggagtgagtattaattaagtatgtatgtatgtacactagcatatattcaacaaatataatcaatcttaatgcaaatgataaactaatccgaagctgttcaagctattcttaactttgatcaaactactatatcttttacatgcatatatacatgcagacaaatatgtatatggctcaaattctactacacaacaaataattaagcataagtctatgctgactgagaacaaagaggacaagtaatcccttggctgcatgtgtggatcaagagtacacactacaacaaagtgaggtaaaaagaataaatatactgcagctttgcaagtattgaaatatatacagtgcaacaaagtgaggtaacatgtacttcatctattccaaaatataatcatttctagattcaaatgtgtacacttgtggggtgttgattaatttcaatgcatgaaaacatatacattttcagtcagtaagatgcttgggaagggaagaattaatctaagtaatccaaaacttaataattgtccaaagtgactgaaagaaaatattttccctctgtttatattttggaagtatatgcacataccccaccattggaagaagaatgcatgcagctagcaagcacaatctgtgcctgtctttcatgtgtatttacacacgaattaaataggttagctgcagccagcatgacctagcaacaaggcatgcaatgcatatgatccccaaaagaggccacatgaccataaaattcttttttcttggtgatcatttcatagctagctagtactccctccgtcccataatataagggattttgagtttttgcttgtaacgtttaaccactcatcttattcatttttttaaaaattattatttattttatttgtgacttactttattatttacagtactttaagcacaactttttgttttttatatttgcaaaagaatttgaataagacgagtggttaaacgttgcaaacaaaagctcaaaatcccttatattataggacggatggtgtagatcatatcaatgctggcggcagggcagcttcacccattcctttgggcagttccaagattgtatcacaagattaatagattaattatacagtatatacacaagtactagggaatcacatgttctcttctcactgctaaccagctagcatctgggaccattcatgcatgggatctctaagaaagacactggtgactagctagctagctcctatgaattaatgccaaattatttctaaggtgatatatagtttaattaatttagcactgaaaggttaacctgggcgacttcgatctggttaaaagaaaaggtcgataattaagcaaaactgaaagaaatgagggcaggagagagattacatagaacaaaagtacaaggaagaaagattccaagaacaatgttaagaaaggaaaaggaacaaaataaagaaggatctacctgcactcagtatgatgaggggtcattttggtttgatgccaaaattaccctaccagattgttgtcattttgaatagtagtttagttagtgtttagtttgttacccaaatataccaataagatacataagttgctaaaaaaattaacactaccaaaatttacttatgttttggtattgctaatattttagtatggtagcaacaaactaaacaagtctgatataaacatagtgctcctacatgagagtactcactccggtttcattttaattgacgttttagacaatgacatggtttacaagatatatctgtgactttgtttttctattataatatatataataaataaatacatgtttatttttattatagtgctttaaaagacaaatctatatatgttattttagttcctttaaactaaatatttttaaagttattgatagtcaaagttataaaagtttgaccttaactttgttcaaaataattaatatggaagagagagtatgcagcatcttcaattcattaacctgaggtaggtctatctagatagggagaaactgccaatgaagaagactagcaatagaagggatccgtagtatagctagctaaccctagatgcctagctagctatagctatgtctagacagcaagcataggctgctgcaccacaagagtgaaaggctgtggatatgtgttgagctgttgaagatactactacatctcaaaatataagtgtttagagttttaaagaagcttaaattgatcgataatataataattatgattagttaatatgagaaaactattatgtgaacatttaacaatagatggttgtttagttgagatgacaaaagcatgcactactacagaaccacatatcggtgccggttgggacattgaaagcggcaatgattagtccgccgacaccaatgtcaatcttaaaaaccggcaccaatataaaatcaatgagccaaaaaaaaacggctcctcgagccgacgcaggagccgatacttcgatccgatgaactccacatgaatccacatgatgaataagaacaacacatcaattctcattaataaatctcagatgaactcacatcggcacatcaatttcaagaacatcatctcacatgagcaacaaatgaactctaataagaacaaatcacaaatcacaaagagagagggagggggagagatggatccaccgacgccgtcgcacctcctgccgccgccaccgtccgaccacctcccgcagctgaggggcgcgggccgcctgcctcccaccgctgaggggcgcaggctacctccatccaaccgtctcatgccgcctcccgcagctgagggggcatgggccacttgcctcccaccgtcacctagaataggtgctggtttttgacatattaaaggtgtcagttttttataaaaaccggcacctaataggtgccggtttttatttagaaccgacacttataattgtttaaagatgtcaatttttttttgtgatttcaatccgcggaggtggaaaaaagcctatagtggcgacacctatttgatattttgtagtagtgatgtcgaaaagtttggtagtagtacattttaggatacatttggaatgttacattattgttatactttagattacaataatttcttttaactttaacacaaaacatggaaatattttccattgtgattttatgatagctattgccaccatatatgcttgcctacgcgatggagctggccgcgtacgtatagtaatagtttgcatgttgggaaccaaattccatccggttgtaatctcatgaatggatgaaaaatatggggggtatgtttgttaaaattctaaacggtacaagtttcgtaaaaactattttttaaatagctattaattaactttataatagttcattcatacatttctattctcggatatctatattcctttaaaaaggaacagtgatcgtgtatgcttaatttgactctcataccatcatatcaccaactctccagtatttttttttctatggaaatgatattatacgaccaaatgaaccacatgttaccgtcccccatcgtcaacttcctacttttgtgatgagaaagaaaaggataatataggttcaaacctgaggactcatattttagtaacaaatatatatgtagaaattaagagatgatatataaaaaatgatgataattattaattaatgatttttttcctcttttaactaaatcttattgcaacgcatgggcaatgctagtcatcacaaaatcagataaactatcatctattcgtccatttcagcactttaatttgaacgtggttacgacaaaaatatatatgtcgactacacatatcttttatggtgccaaattattcttctagttggtggaaagtgagatgatgctaatttggctttggttgaacctggcaatgatgaattaaaatatgacctaattaccaaatgtaaattcaattttgagtttgtatactagtagcttgtggtagcctttatttgtgcatattggcctattggccacaaattaagcaggacttttcttcactgatgaactggatggtggctgtaatttcatactcgtatcttcatgtgaggtttaattggttgttaattactgcatcaaggaacgatgatttggcacggatcggtagatcgatgcatggtcaaattgaccctggccgacaagaggttcagatgaaatcctgacagaacatactgtactcctagaaatgacaagatcttgagactcgaaacaaaggcctctcaagtcagatcaacagctatcgatcctcccaagtcagatcaacagctactccgtactccgtatcgatcatcgatgagatacttggattgcattgggagcacagctagctgaaacatttgacagctagctaaaaggatcagtactcttttactgttaatttcgctagatatgcaggagtagcattaggtaggtacaacagtctagtatcacttgtctcgtcgactatctgctgccgtagcttcttccttttgtccggtcaatggtgtgcattccctgcatcgcattggtgtgcatcgcaatagtgttcattggagtatgattgcgcttcctccttccctccccaactataaatatgtttatgttgtttacttcctcaatactaaaatggagtaaggtcgagtttagttctaaactttttttaaaaattttttaacttttttatcatatcaaagcttttctacacacaaacttccaacttttccgtcacatcgttctaaatttcaaccaaaattctaagtttaacgtgaactaaacacaccctaagttcatttttcactcttctcatacatatcaatgcaaaaacaaaaaataatagaataccctaatataactattcatcactttatctactccaaatataactattcactactttatctattcccaatataattgtttcatacttttacaaactctgatacaattattacttaaaagaacttattttggaataaatagatggagctaaaaataaatttattatgggacggaggtagtaacaataaagggttaggagaaaacattttgatgctccttaataaacttaataaagaagggataagtatagtgtgagtgtgatcggggataagatgcaaaatatttacaattaagtgcaaggtgattaataagataagcattcactccatcccagaataaagctcctaggagtattttgaggtaattaaggattgtggtgaaattattctcattactagatggtggggtgatggaaattataaatattatgggtggagggcaggtctcaacggttgctgggatgatgagcgcgccaggtagcatgtgaagtaatggggtaaaaatcacattttatatattctataattagctatatatggggtaaaatttgaacttagttatattttaagatggatgcggtagtatttcggagtgtttatatttttgtcaataaattttaaactcttgatatgcttgtggtacaaattatttggctcaatcggtggaagcacaggctagagggctatgcatgtacaccctccgtccaaaaaaaaaaaaagcttaatctaggaagggatatgaccccttataggacaacgaaccttttgttgttctaggggtcacatcttattgtcttaggagggagtcacgttcctttttaggttaagttttttttttatggatggagtaggctagatggctatgcatgtacgagtagtatcctagctacactatcactactgtgcatggaagtattgtcacatcgacggccaattaaaggttgcatggctaaactttagtactcattccaaaatataagtcataatcacccataatacaaagactaagaaaatatttaatcactttcttggttggaacaccttgatacatgtaagcaatatgattggaaggtttgatgatataagatttaaaacaaaataattttataggactaaaggatgatagttaatgtatgcatgcatgcacaccttatattatgagaaatgagagaaaagtggttgtgtcttatattttgggttggagggagtgaatttaagagcaaaataacagcacaaaacataacactacaagtatttgtggccatatgcatgtgtgtttattagtacttggcaagcaaatttttaagggctccttcgacacgcatggttatcaaatacggaaataagaaaaacatgtgattaataattaagatgtcatgccactctatccgtactaaaatgtacgtagctgtttctgttttgcattttgtagctatttcatgttaaatacaattttgagaccgagggagcataaaactatatgaatttctcaaaaagagtactactccattaatttaattggtttataactcgaacatagcgttagtgataaggttttaaaccccctaaatatgtacttttgtggtaatcttattgccagccatgtagttttgcgatacttagcattaaacatgtagttttaatttattgttaaatccgtagttttataatacaccatcttaaatatataatccttccatattttaatgtatgacgccgttgactttttaatcaacgtttgaccactcgtcttattcaaaatttttatgtaaatataaaaatacttatgtcatgcttaaagaacatttgatgataaatcaagtcacaataaaataaattataattacataaattttttgaataaaacaaaaggtcaaacgtttgtcaaaaagtcaacggcgtcgtacattaaaatattaaaatatggaggtggtatattttgcgataattcattaatttgactgaaatttcgtgaaatttactcaaacaaaattatcacatcctacctaggcccatcccatctggcccggcccactccacctccctcacggcctcacctcgatacatgcgcgaataccaccactccccgaccttagccctagccgccgccgccgcgcgctcccctccccatcccctcgccgcgccgcgccgccggcgaacccccctagcgctaggccagccgtcgccgcgcgccccgcaccctctcctccgccgccgggcctgccgccaccaccgccgcgaggcctcggttggtatccatctatctatactatctatatcttcttggatggcagtttttttttatcgagatgtgttgctaatggtgctgcgttagcacgcccactcgcgcgcccgcaggtggtggtcgaggacgccatgcccaaggcgaagaagaaccctcatgtcttctttgacatagcgatcggcggacgcgccgctgagaggatcacatttgaggttggttggttggttgaggagctagtttgttccagcatggctagttgcctacctggtgttattgtttgagtaatcgttgctgcctgggctaactttctttgccttcgatttgcagctgtttgcggatgtcgttccgaagaccacggagaatttccgggctctctgcacgggtaaatttttactcgtttgatgggatataagttgcgtgtagcggatcagttgtcgctaggaaatttatttgcgctatgcgacttgtaataaaccttaggtgatgaacaatgttttatgataaggatgcgcgtgagcttttctgctccgcagctctgttgggtgaatttacatgagtgatgaggcacatgccagttctgaatgtagtatattacaatgctaacaagtcatactcagttttattatctgcatgctcgtgtatggtaattaatattgttatctaaagtagaatagtgggaaaaaagtctcactatgttcctttcaatggttctggcatgatttgttctgttataaagatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatatgtaggtgagagaggccttggagtatctacacaaaagccactttattttaagggaacaaacatgcatcgcattctgaaaggttttatggctcaggtactgaaaattaaaccaaatgatccaagtcctctggccactgcatatttctttgtatcaactcacagtatgtttttgttcttttatgggatttcaaatgctgaactctacataattctagaatgtagatatgaatggcttgctagttatacagcataatcccagatttttttttgttccatttgcaggatatatctactctagattgcattctagcatccattttttccctaactatactcatcttatcaaaattttcaactgcagggtggtgatttttcaagaggagatggtattgattcattatcccaggcatcttctttcaactgacttcttgctgttgtacactttataagctcaacgttacatgctgtttccaggacgtggtggagagagcatatatggtgcaaaatttaaaggttaatgactaatgaaatttgtggctgccatagaatttttttaatccaattagtgtcaaatgcattagtatgctttcgctaaagtttttgtatgtactttctggtgttctacagatgaaaacttcaagttaaagcatgaccaacctggtgttctttccatggcaaatgctggaccagacagtaatggatcccagttttttataacattcatgccaacaccacatcttgatgggtattgcttctttctgttagtcagttggcaattttctctgttaatctctcttctagttccttgtgcatattaagttatgcctttctttctttccttactgcacaaagatatagtacttgatatctaccaataccaaaatttaacattctagagagatttagtctattaaaaaaccttgaatctaaaaattctgtacaaccatgaaagatcaattagcctcatgcatacacacataaaagttgccatttgttaaataatatcttataaacagcacatttatgtctatgtatatacaaccatagaaaactctctggagtgggtgtgtgtgtagaacacatcattaagccctactcctttcttaaatgtgtctacaagttgtgtcaggtaatggttgagagtatgtggtggctccaacacagtgtatgttgcccacagaagtaatcaatttcctaatttctatggtgttttcctgtggataagaagtcatataacttccttttaccaatggctccaaaatctatcaacttcaaatgacttaaaattataatcgtgtagcaaacatgtggtctttgggaaggtggtcactggaatgcccttgctgaagaagcttgaagcggtaggttctgataccggaaagcctacttgtgaagtgaaaatcgtggactgtggtgaagtctctgattcccagaatcagctaaagggagagaaaggtaaaaagcaacataaacagataataccaaacagtccatgtgttgtctggttagctttctcactacttgttcttttgcagaaaagaagctcagaagaacagaagacaattctgctgctgaaaaaagggtcaaaacccaaaaaccacctactcatgataaacaaaagaaaaagagaaagcattattcttctgattcctatagctcagattattctgacacacagtcctcagatagtggctcggaatcagaatcatactcttcgtcatcattggatactagctcatccagcgaccacagacacaagagaagaaaaagttcgaagaaggataaacacaggtctgcaaaggggaaaagcaaacacaagaagactaagagaaagagtagaggaacaaaaaggaaatccaaacggtacgttgatgacctgtatgatcttggtagtgttattagcttataatgatgtatttgctgaaagatcccctgtctggagctttttacagaagctacaggagctcaagtgatgattcagatagctcaaagacaggcggcagcagttctgacagtgaaagtgaaggccgtcgtacgactcgtaccaagcattcctcgaagaaaggtaggacaatagaagagtcaattcacattcatttgctatgaaaatcctgagtagtctaaaatatgctgctttgattgaactgcacagatttctgttctgcttgttaatactttggactcgctgtgattgtccgtgttactttaaattttctctgcctgttaaattttctgttttgtggttcaaaaggctgactttgtccactgcacttgctaatccctgcttgcgacctgtccatatctactttttttctgcaactaaactatctattctattctgatacacagaacaacttatgtctgcaactatttttttgattctgtttaccactcaaattctttaagcatccacataattgacgatactcttggccaaccttttgtttattatcatttcttgccgaccttaattacaaaatcattctagaatactttgaactgattctgaatatggtaaatgtagagtttcatcatttatattttttaaattgctaacaaggtaacatctttctaatttatgacagaagttaccatctttgaccttgaagttttgcctgctgtgtttggttatgacgtatgtttcatggaatgtgttgcatttaattgtttgaatgtactgagattgtctacacaattttgaactaataagcagctttgttcatagcagatccagataacaccaaaactataagtttggagaaagatagtactttggaagatgcagataaaggcaaacaaacagctacccttgacaacatatcaaatgaaggaagcaaaccctcaaacacagatggaaatggggctggtatcaggtacgaaaatcagaactcagaagataaagctagtaaattaaggtttgattacttaaaacaaattacttactgtcaggttcctttcagtactactccctccagtcacaaatatgtgacttttggaatgcgtgcaccgtgcagtcaacatgtttaaactttgaccatcaatattgctttgaatattttgaattcaacttttaaaaatgttatgattatatttgtcttaaaaatagtatcaaaatattataccagtaattcctaataaaataattgtcttgatgactgtgtcattgtgcaaaacgtcacttttttgtgactggagggtatttagcagggataaaaatgtcctgttcaacattgagataaccttatcctttgagtacccaattgagatgtttgtttgtatttgcagggatgatcctggtgcgagagctaggagcagtcctattagggctgatgcaagtttaacaaaagtggatggcaacaatggtgctgatactgcagaggctggtatatctagagctgaacctgtgccaaccaatggtaaagatttagcaatgggctctacagacaacggacagcctcaacgtgtcaggaaggggcgtggttttactcaacaatatgcatttgcacgtcgatacaggacaccatctccagagcgttcccctgttcggtctcgctacaatgatggaagaaatgataggtggaatcattttaataggtactgcagttagattatttaccacatttttttaaaaaaaaatgatgattaatttaatgtttggatgccatcatgtgcaggtatggaagaaatggtccctacggtgcacgctcaccagtaagaagatatcgtggttccccaagagccagtagtccgtccaggttggtattcttctgattatccttggaatctcctagtggtcagtaccaattgattgggtagagtggatgaactattttgaatatagttgtgtactcttcatgagttcatgccttctttggggttaacagtgtagtttgttattatttagtaccataatacccggggttatgtgcaacgtgccgaaacatctgattttgttcaacttggaccataatagtggggttttataaaaactttataaaatttactcataactatattatgatgccttcaagagtttagttaatctgaatattacccaagttcataacttgctttcattgccttatatttcatgccaattcttctcttaggtagatagcagaggctatgcatggacaaacctcaaactgggttacatgttaacatagatacagtatattttgcttagatcaatcagctttcttgcgtgattcaaattcaccaaacatttcctttttatccgcttcccttttttaccattgcaaggccatgttactttagcaatgagctatacatttttttaagaaactctgaaccattgcccagatacccaaggagagaccgtagcaggagcaggtcacgcagtccattgaggtaccgtgagcgtggaggatatcgccgccccagtccaaggcacagccgcagccgcagcccagcggagcaccagaggcgagatgtaagaaacaggcttcgatcaggtcgggatggtggtggccctgatcaccgtaatagcagccctcctgtcaatagaggaaggtcaagatccaggtcgaagagccgtgatccctcgaagtccagatcaccagatgctcctgccaaaaaggggagctcaaaatataaccgcaggcgcagcagcagttcaagatccagtagccctgctggaagtaaaggcttggtttcatactgagatgtgatatcagaagttgaggtgatatcaggagttgaaaaccctatgttccatggtagcttggtattgagtactaccctttaagaatgatgatgtagttaatggcttaatgtactcttcttttgtaacgtttctcattcagagattgttgtttttatgcatcttctatttggatatgatatttagacttctaagttctaaaatgcttcgcatcataacctaagcataatttataggtaaatctaccctttgtcgtctttttatgattggaagtttgtagtctcttgtcctattaaagcctgtcggtaactttgtttagatagtctcttgtcctattaaagtctgttggtaactttgtttagatatttgtattggcacgtttcttgttttcaacacgagtttttcctctgttgacaagaaaaaaatgagctgtgaatctgttaactgttatattcatattcctgcattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacacgaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccacatggagacaggtaccagcacaagtaagaagcacagatcatttcgttttgttggcattgcttggcatcaggaaacagttaaattggttggtccttggggacaatctgatctttcatccacatgtagataggtaccagcacataataagaagcgcaaatcgtccccatgacgaagcggaagatgaaggtgaaaggattcactggtttctcaacatcttcagcctttggaccaagctgcaacaagaacaaaaggtgaaaaaccagataacaaagcacatcagtgtgagctagcatgacacagaactcaggtgtgttagactcactgttaacaaatttaggtgctcttaacatttgatgtttgtaacaagaaagcaattctgagttaatatgaagctagaacacattgagatgcaaagaatacctgcaaaggggaatcgccagacgatcgcttcacgcctgtcacagagcaccccatgatcaggccatggcgtcgaacaccgcggtaccatttgggcccaattctcttgatcttgacatcctggaaccctgccttctggaaccattctatgtactcttcttccttggggaagagcatccacatgtcggcgaagaagcgtgacagccaaaaggttgggtgaaccgggccaatcaaacaggcaactccacctagcttcaggaccctgtaggcttccctgattcctcgttgtggatcaggccagtactcaatgctgacaaaacaacaccattggtaagtatggcatcaaaactgatcaatgaccacatatgactaagcttaaaagtaaatgaaacacaggtcactgatgaccacatgcatattgctttcacatttcaggtaatagattcattggataggagtgatacttaacatcttcacatggacaatataagtcaaaacaatcataagagccagtattatcatattaacagaaatctgatccaacaaatatataaacatctcatcatggacacttgaatcactgataacattaaccatttactagaaaccacactactgcaaatatatccaaacagatggttttgtcatggtgtcaacgctagatcacatagaatttaacaggtattttctttcattgatacagaaatctatacatcaatatcaattcaaggatatgcaatgacaaaataatggcattagttgatgatagatgaaaaaaaatgttattgtacagttcacatgtgaagtgtaacacattcacattagcaaagagaaaattcttgaccaaacttaagttgtgcccacacataccgtatattggtttatcctagtaaacacaaccaagaatgaattaacttcacaatcctgaacacatatctatacaagacagcacataaaatgttttatatttattttaataaatcctgcatcttcttatagccaaattataagaatgattctgtgttgctatatgtcctattaaacacgacagaataaaccttcatgggttgctcatgggaaacacaattgagaaaataccgtaaactgcaatgcaaagaggacattagagaatcacctcccagcagagacatagcgatcaaatgtgtcagtcgggtaggggaggtcctcagcgtcaccctcaatgatgttcaccccattcagtgccaccttctgcctggccttctcaagctggtgtggagactggtctagcagtgtgacattctcattgtccacatgcttgacaatccccaatgtggtgaacccagtgccaccaccaacatcgacaaccttgagcccatggtggtagagttcagcaggctccaatgcatcatccctcatgtcctcggtccaatgccccgggtttatgacatggtcatacacaatggaaaggaacctatagaaccagaatgcttccttcttgtgttgtatgaacctaggttgtgatgctggcctagcagaggagaccgcgcactttggtgcgatatactttacccttgatctcacaccacttctatttctcaaaggaatcaaacctattttggaaggccccaagaatcctaatccaccgggagctctaaatgtagaggaagaaaccatttccttcattgttgtttgaaaacttggatcaaatcacgtatggcttagtgtatcgttgggcaagagaatactggttttatgtacgaaagaatcaacaaacaggaatggactaggtagctcctatgcttcatttgtgaggtttcttggtagatttacaatgcaaataaatagaagatcagtagatcacatatgagtgcctgtacgatgcaggagagagggagctagttcttggccatggtaacctcagctgccaagccacaggaacttgagaacatgcaacagccatgtatgtaagcatgtgtgtgtgtgtagtcgtgtacagtatagaccttttttgtgatgcaacaaaaggcttaagcttctattccatcaggaattcaggatgctgatggctttatttgtcttcatctcctctagttgctccattgatggggacatgtgggttggggattgtaaacctatggatgacaattctggacaggaatgtatgggggacttgctacttggcatcttgcagtccttttagttctcatccaaacattacacctaatttgtttggtttatgctacataaacagctttttttttggaataacacaaattcaaaatgaaagttacaagagctgcccataacagtctaaaatacaagtatcatttaaagtacccataattttcagttctaaggaagattaacagcatatgtgtgattacacaattacttctgcaagtgaaaatattttattgtgtaaacttatggatttctttaagttcacaaactaaaatgggtgcaaatgttaccaacttaccatagacaaaacccatattttggtaatcctaatccacataatccaaattgataggtatacacctctcaactctaatgtggacaaataaaacatgtttatagatcttgctagttaagtaaaaagaaaaggctaacagtgacacctttctgcttttaatgatctgtaaatgactatatatctttagtgccataaaaaattctctatgagataaatatataggtctacgaccaaggagaactcatgatcaaccaaagtaaattgagcatacctggtcaatgtgaagaggaccatgaacaacactggagcagaaatcaagcaaagaattatatcgcatgagctctgatgaagatatacatcacatgggtacatcacagaaggggcagcaaattcatttataattgatttaccattactccaaagaacgtcaaggtgacttccttttttacattcacatggcaaaggtaggaaataaaaaaatgtgtaaaattggttagtgcggaagttcccaggagctaagattgaatttgtacaactatatcattcagagtgaagtaatacttttacagggccctggaagctgggacaagtttcaaacataattcctcaaaaaggtaactaaaataccactttcagattacttgttgagactatggaggatcattcaggatttagtagagtgaattgcagcttggactgtctcttgttaccatagtttcactttgaatccgctttaccttttgcttcactttgaaccccctttttcttcttctccagctctggaaatagcattatctcctaggtcacaccacttccgcggttctgcagccgctgccataatactggcagtggatatgtgcctgagtttgaggagaagggcaaaaaaaaaggggggggggtgcaaaatgaagcaaaaggaaataataggggtccaaagtgaaattatagtaagaaaaggggtccaaaatgcaattcactcgattttagtatacagccaaccagaatcactttactccctaaacagctaaacacctttagatgctgctccttcttgctgattagctttctctgcttcaagcttccttaaagcagatgaactcaatttctcaccctctgctcctccggatagaagatcaacaacctcaacctgcaattgagctcatcaatatttggatcactatgaagcatatcttgtacttgtaccaggttttttttaaaaaaaaataattctagggagtatgaacaccacaccttcagcaaaggtagtcctttctcttctcttttcctatttacggcaaatccaccatttaatgtctccttactgaacataagcagcatcactaggttaaatgaggaaaaacaaaaaggagaaaatttaaagtaagcacgaacaactctacattatttaagcatggcatatttcatacatttttaatatagttccgtagctgtttgatgaatgaatttcaattttggtcagaacacatgcatgaagtaataaagggaaaaaaattacagagacttaatatcagataagagatgatcaaattgtccatacctgacaataatggcatccaacttatcatcaataatggatgggccataaggatcctcaataggctccacttgtactaccagttctggtttaacagactgcattttatacaaaaccaatcatgagctttcaacaaacatcataattgagcatcccagaagcagcagtttcacttttggcagctcctcctaagtatgaacatgcttaattgggtatgtacttatgtgaaactgataacccttacaagtttttttttcttttttttgcggggaataacccttacaagttaagaagcatgcaattccaaaattctatatttttctaaaatgtagacgactaggaacaggtcttcagtacaaggaagttatggaacaaatttcgcagcaagttggtcctaaattgccacataactcttcaccaaaccaattcactgtataacttcttattactcacctaaagtaatgtgccacatgagagaagctaattctcatgcgcgaaatctaaggtttactgaattgtctttgtaccagaataaattatacaccgcctcccaaatcaactgaaaattacacctttgatttccttcatttttggaagagaaaagattcatcttgtcacaacgtctcacaaacagcaataaaaagcagctcagtaacttaattcatgcaaactgcttccactagtcatcacccaatgttccaatcctttgtaggagtatttactaacagaaactatatactacataataaagtaggcaagattatcccccaccttgatgtaatcctccacagccttcatgcgcttttcgacgggctcgatcaactcagcgtactgcaggcacacacacagagggtggaaatcaagaacacaaccagcagctagcatcacagctccaataaccggtgaaaaatggtgtgtcatttctacctctttcttggcgagcatggggcctgtgcagacgcccaccacgatccgatccctcgccaaatccgccgaggcctacacacccaacaaatcgaaaaattcgttattcctcaaagaggattaatactaagctcggttctttaggaggaaaataaaaatagaaatcctcttcttttttttttctcaagctcgcagcaccgcaccttgaggaggcgacggtggccgtcgtggaggcggtcgaaggtgccgccgaggacaaccgagccgtacggcggagcatcctcctcctgactcggcggcggcggcgctccggcgaaggtgtcaccggcgacgggaggagtgatcattttcttttcctacttcaatctgtccacctctgcatgctctgtccggtggagtaaaggtggtcaccggtgaatacgggatcagagagaggcccggggaggaggcggcggcggcggatccggcagcgggaggcgccggagacgagggagaagggcggttttgcgggggaactgacctcgctggaggaagaaatggatgcggggcggtgggaaggaggaggccggcaaggggagcggcgacggcgagccgacggggtctctccggtgatgtgggctgaggttgccggcgattggccggcggcgcgagaggaggaagaggcgaagagcactttctacttttgacttttaccctttatttcgtttgtttatttgtttctgttttttttctcttgcgaggaaaagaggagaaaacgtacacgtggacggtccagattgactgattgacttctttagaaagagaacgtatacgcacggcttccaacttcttctgccgtggacggtccagattgactgattgactttgtttcctagaactccatccgtcccattttaaacgcaaccataaattttcgcgtccaactttgatcgtccgtcttatttgaaatttttatagtatttttattgttattatatgataaaacataaatagtacttaatatgtaacttatgttttttaatttttttaaataagacggcgattaaaattaagcacgaaaacttggacggagggagtaccacgtagtccaagaatttctttattccacatgaaatgaaattctttatctcacgcttggtgttaaattttttgaagaggaatcatatttttccatcttttttctcggtgtagctctattttttttctaattctttcagtagtaggtgataaatccttccacagcgaagcacctgtaataacttcatcaatctcaagacatattggtcaatctttaaaagtgctaatagggataggttgtaagtgtgtgcatggatagcggtggccggtgggtctgcgcgcatatggacacctatatctatattatgtttagaaaagaaaaaagaagaatctcccacctaaactccgcttgattctcatctctataaccaaacaaggggtgtgttcgctaccaggggatgggaacggtgtacagtgcacacgaaaaacggggcggtacattagcacgcgattaattaagtatttattttttttaaaaaaaatagattaatttgattttttaagcaacttttatataaaaactatttaaaaaaacacaccgtttagcagtttgaaaaacgtgtgcgcggaaaacgagtgagagaggttaggaaaagtagcatccgaacacacccaaggtcatcaacttttctcttaatctcccaatcccctttcccaaacacgattctcaatctctatagcaagcacatcaacttcctctaataaactcctaatcccccttcctcgaagttgaaaaatcgaacatgaatttttcatcagaaaaataatttgaaaatttattttgaacgcattactattgacgtgaaattcgtcgcacacgaagacatgggagatccgcttagctctagtgcaggtcatatcaatcgggtttagggcgtgccagtaagtttgataccacaactgacagaatagataaacaaaattgtaccaataaaccaatcgaccgatgttgatatagagtagtaaatacaagattacggcatacatcgggctagtggtccgatgtaaatcagatgaagccaatatctgtcaaagcacttatatatcggctagaaaaccgatgctagtaaggtacatgcagataaacataaataatgatatcagctctatccagctttccgaagggacgaaacctacgagctatcaactttcgttcggttacttgatagatcggtctgaaccgagttgaagttaacaaactaaaccgatagaaaatagatcagtcgtactacggtcgtagatcgactagatgtaatataaagataacttatcggttagccctccaataaaacgtagcacaaaacctatcaacttagcaagacttgattatcagcaacaatctagaggatcagacctaaccgagacagtacgagatcacatctaataaataaactatataaaccgatagatctacacaaacgtgatgtatataacaaatcaatttaaaacaacgtacgcttagagaaatatcaacttatccagaatatcagacctatccgagaaagtcataattaagctgatacgactgtaaatagcgatgcagttaaagatagaattaatatatctaatatgcaacgcttgcatcaacttggatagactatcagacttaatcaagaaagttctagccacaccgatacaggcgaagttgatagaacttacttcctcactggagatcgaacttaaccgatgtagccctactcgaaactaagaactcgttggaataagggtggcaatgcattgaaagtatttgtattgatatgtggagatagactaaaaaaacccgggtgtacatatttatactctcaggttgatactagtcctgatcgaatacgatcatgcttaattaattgatagaattaaactgccatgccatggtttcacgattccttcatgaactcggtctcttctagataggcttctctcagctgatcgacttttttggtgttaacaattacacataggccctctaaacttcgccgaagctcacatgcaaaatttgaacttcaggatatgtggatacgtctactctctctctcaaaggaagccctcaatctttttgtcatgaatagtgacaataacaatgacaatggaccaccacttgatagttgaacacaaaatccaaacattttttttctcattgagagggagagaaaaggacacaagcatatatgttttcagccttcagtgcactgtcacttgcagttcctttttttaattctgtcactcttttaaattctgtcacttgcagcccacaactctcttataaagacaaaactgatgtttatccattgttcagataagagtatctgtgtactgattattgcctttgtggagtcattttatacctgtggctgaaaagaccatacatatggcaatgaaattctgtacattctctatcatccaagaaattttcatcttccaggtaggttctagatcagattttaatctgtcaagatttttcatcaggtacatatatgaaacataactatcactagaatcaccaagtacagccatggacagagtaataaacaagtgaagagtgtatgcacctcttgtaccaaatattcagatctggacaaataacacaatggaccagtattcaagtaggataatttcgcggtagcttttcattgtcctgaaagtaaaaccataattttgctgtagcttttcatgctcctggaagtaaaaaccatcaaattctcatttacttctaacaacaaaagtttggtgaaatacaataaactaccagtaaaatttccacaactgtttttatatttacaacaccatcaaaggtggaaaaaggaggaagtaagctccagagatatctacaagatggagacgaagagatacaccgagctcagaacagcacactgttcttgcgaaaaccgttagatgtatagccttcagttctcaacttatctgatattggagaagattcaatggttcaagaagataataggtgtctcaactgaagcaagtgttcctcatttgtgatgttaagcgaaaggcgcagatttgtcagaagtgactcttgctcccatgtcagtggtcccaatgcatagaaagctctcactgttgattgatatgcttgtagctccagctcatggacatccattttgaaatcacagccatggacattgtcactctcctgcctaagcatggatggacatgaagacatggcatcatcagggaagctgttcctgactccgacagattgtgtgtcagtgttcatagagtgttctgagaaattcacactacaactagccacagaacactcgttttcttctctaacttgaagaggcatttgggatggaggacgaactatgctgtctggttttctctttgttaagttgttcttggcaagatcattgtatctttcactagaaggtctacaaaagagatctctgtggatgtcattctttgcagacactttcagaggctgtggtttcctggtttgccgatgaacttcatgtgcatctactctccttttcttgcttgctcctggaattgaatcatctggtggcatcctagtcagttctaattttttcttcacatttcttgcactagaggaaggacagagattgatcgctttgtgcctcttagtgatgtgatcattagcttcattggagtgatgatcatcttccatcaccatttttgagtgatgaaatgtttgatcaacatgttgggtctgtttttcactctgctttctgacctgaaaagggggcaatgactttttaattaccatgtcaatgaaatgcttgctgaaaaacctgagtgaaactagagaggtgaacaaaatttcagtcatttcacaaaatttgcaataattacacccaactagtaatgaaatatagtacttgagcatgccatgtcatactactgatgtcaaataaattcgtctgctgtcgtatcaatcttgtagccaaatgcttattggaaacaaatcacactagcggaagcaataacaagctttacagattttcaataaagaatctaaatcatcagttgaagttcaaatacactcaatggagtcttttgcaaattcgacaaacatactaacataatctcttcctaagaagtccaaagaatccactaataatcatatatgcactactacaaagcacaaacatggaagaacatgagctaaccacacaacgaattgaagtactgaaacgactagctactgtaataaagagtaacgcgtgggaatcagtactcactttgtctattacagctgactgcttgccatgataggcatgtggaaacctcaagcaagatatgtggaattctctcatttgcatgcaacctgttaccctgatgacgaaatagtcatccttcagcacctttgcgatcttcccaagcctccacgaattacgatccaaaacctcagttatgtcaccaagaacccatctgccttttctcataccaactggccgatgcgtcctaacatcatccttcttcactgcaggcatcccttcagcagcaaagtttagattgctatccctaaagttatgtagcgttgtaccttttagtttcatcatctctcactaagaacctgaccctgcttacaaaaggcagaccattaggaaagtaaaagtaagcacttgcactactgaaagaataacaaaacatgaatggataagaaaacaaagatgtcattttgtcaaagtatatataactgtatttctaggtaaagcatacaagtgggataaagacactgtcattgattaaatcactccaaagatctgctaaattttatttaaagaagaaatctaggagaccttacagtcaccgaataaaagaactaccctggaggtatagtgctgagtccaatcagattagtttgcaaggtaccccactaacttgtaacatcatttgttgaggccatagaacaacgacggaagcaacgcagcgctcattgaatcaggcaacacaatatagaacaaaaggtatgggtgcacagttctagcatcttgatgtgaaagtacgcaagtaaattgaccaaactccaacaaaatgcaccagattctcagttggggttgtgttaaacattcaagagttgacatgaactacaaaagtatttcattaagtatggttcgtggacaactggtacactatcagaagcaagatattgtcccttattcggagatgcgttcacaaaactacttaatgaacagagcaaatccagaatgaacaatatcagaatctggaccgacttctttttcccttccatttttagcaatcaaacggaatcggaccaacttctacagctcaaagttggaagctgaacaaagggggagcagatgactaaactgcaggactgtcacttatgcatcatttaagcttcacaagtccaggactccaggtacaatctatactataagagcttccagtttccatgctctgagcagccatggcttgtttccttagtacaaaaggaggcctaagaaaagcccctaaatcaactagacattctacctaagccgttaattaaccgtgtgaaaggattcactccctatgaccctatctactgcattttaaccaaaattacctagaccatgattcagacaaatcggctatccttctgaattctgattttgagccaagaactaggaacatcttatgatatccggaagtacattcatggaagaatccccagaaaatggtagtaacttttttcctaggaaaagtcaaacctcttctaatctttttttttctgaaactgaaaacctcttcttatctgtcagatggggtagaccaatcaaccaatctggatcagatggcacacaacttcacctaaaaagcatcccttgattccataacattgaaaagcccaatcaagatttcaaggagcaataatagtacagtacagcagctcagatcggaaccatgtactcaaagatctaatttggaccacactaaatatgcaaaaacaggagctttaacgtaagaatcaattaaaaaactagttggattgattgaatctgtgatcccaaaatttgtagcagcgaagtacaaatttcatctcagcccaatttcccttgtaaaatactaagcttcagagtggaaagaaatcagggcagattttgatccttttttgaaactaagggcagagttctagactatgaataacaaaacattaggatcttagtacacccaaaaactccttttttacctcagtttggtgaaaaaccaaatcagaaggcatcatcgagttggaatcacgaacaacagcagctcaagtcggaatcaccaacacaagaaactccaagatgggatttttaacgcgcaatctaggccaaaatgtaagagttggagtacaagaaatccaaagaaaccagcatcaaaccactcctcacctgcaacaagaagccaaccaacggataaactcgcctcgccgatccaagattctcaaaatgaaaacagttttcccctctccagattaaacaagcaactcctaaatcgggattaacccccaactcgtctgttcctccaatccaattcacgcaagaaacagaaagaaataaagaagctagcaaaaaatttcgccacctccaaacgccctaaaatagaaacccaacccaaaaattatgcgaaaaagaaaaaagaagatcagaaatttggtgcatcgaaggtgaccaacctcgagaggagatgggaggattaatccggcggccaggaagaaatcggagcgcctaattccgtgcctaaccgtaggagaaaacggtgtgctggctttgccctgtggattggctgtttctttcagttcttgctttcctgttccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgtagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagcaacctgtacacctgtgggtagacgtacgtttcttggcgaaagtagcgccgccgtcgttgcagccgccatcgccgcggagcagatcgatctactggcagcgttcggactgatggttgcagactcatttccattgacatcgtcgactaatgctgctgatccgtcgcatgtcacgccgccaccaagacccaccgctgctactgagcagattgatttgtttctgaatctaggaaagatggctcctactacgctgccgcacctctatccacgatgaagttcatcgcctctccgacgtataccacgtcgccgccaccgcctccgtagtcggatagacccacgatttcctagtcatcggatatcaaccatcatcagggccaagagaaccgaggtgactccagcgagcaccttcgtctcggcgagggaggccaccatggtggccgccctgggccgggacacggctatatatggaagtggacaccgtggtgtctatggcttccataggcattatcgtgacggttggagaggtgatcaccatggtgggcatggacaggaacacatcatctctcacattggtttcctcccgccgctgccgccaccacattatcctttgtcggagtttctgccgccgccgtacttcggcgcataccatgaaccaactatcggatacgcaccccacagcgaatactatggatcaatggtcagccatgcacacccaggtatgtgagataaggaacacatcctctaccttaaaagataggtgactgagtcgcttacatgtgagaccactctactataggatcacatgtcagtgactcaaagtcatgtgacctaatagcagaggatccaatttggttagatatactaaaagttaagtttggtgaattgttatttaaaaaaatatatattgatattcagttatacataccctatatgggacacaccataagtttggtgcattctttcttttatttatttatactgattttctttgttatatgtaggagaagtttggtgtatttttttttaaaaaaaattatactgactttctttgtgatatgcaggatttgcctctccagattaaacaagcaacttctagattgggattaagccccaactcatctgttcgtccaatccaattcacgcaagaaatctatacctacttaaaaaatacttaaggcttccgatcgtccgcttcgtccgtcgtcgtcgtttgagtctgagcccgtctttaaaaaaaatccccttgcagatcagccgattgctcccaacccctttgcccccaattcccaaaatacatgaatgacaaaatcactcaattgcaatcccaaatccaaaccaagaatccccacaaaatcaacatcccaaatcaaaaataaaatccaaaccctaaccctagccgtctcccggagcagccctcctcgtggtcgccatcgtcgccgtcgtcgtcaccgccttccaccgtgaattatcactggtaattgtaatttctgaaaaagattgatctgatggtatcatggtaatgctcatgcttctgctaaattgatttgtttgtttatcttttgttttgttttattttttaatttttttttgtcttttgtttgagagacaagaggaagtgaatacagtctgtgtgtcactccttggtctctctccccctgccttattcggtcgttcatatctccttatttttattttttggcagaaaaaaagagaaataagttaagttccatgaagatataattataccttttgggtgaggaaacccgggcaaatattcatggatttgttctcaaaagattatgagtaaccatttggctactttttttatagttatgaaaattgatatgaagacttgtggttgacctatcttagttcttgcaaggctcatatgttcaaggtattctatattaagatttgtaataaaatacataaaaaaatacacattacttgtgctagtctgctaatttcttacttcctccatcccaaatatagcaacgaaggactagatgtgatatattatagtacaacgaatctggatatatctgtccaaattcgaatatggatatatatatatatatatatatatatatatatatatatatatatatatgtatgtatgtccaaattcattgtattaggatgagtcacacccagtcataggttgctatattttgaaccgagagtacaaattagtactttctccatcctaaaaattttagtactaattagtactaaatatatcctaattactacttccttcatattcttataagttatatcaaatatgatattatttgatactatgttgctatatttcaggacggatagagtatttgatttattggaaaagccaaaaacaaaattataccaaatggccatagattttatccctttgcaagccaaagcgagctgagtttatccatgtcatgataactttgctgagttggagatgatgtgttctatacggtcttctacggttgcacgtgcatacacacttatttgtcgtattttaggacatacactagagcaaagcatatctttcgaatgttcgtgtgttttatcagatttagcatcaacagttatctacaagattttttttatataaaattacgtcttttacaatattaatttaaagaaaaatacttacagtgcatgcgtaagactaatcgatccaatggggtcatgcgctcatttatattgatattattttattgtacctgttttggtattagagtttacttattccaaatctagccaaatgtggggcctccgttctgataaagtaaatgtaatgcacctgggtgtttcctaacatcctgatcattggtagtataaattttacaatattattttttttttcaaaagaagattcaactccaataataaaattttagggttaatatgttagtataaatttcatgattttgaaatatatcattactattcaactatttgaaaccatgtcattataccccttcacttttttttttaattttcagtaccaaattgcagctgtcttcttattttatccccttcttccttcctagtctattttctataaatgtactgtaataaataaataaataaataatatatatatatatatatatatatatatatatatatatatatatatatatatatcttcattaatgttcattgaattaaagatttggttttgttttctcattgaatttgaagatttcgttcagatttcggatttaataagttgaagatctttctgactcatctatataaagcggatgaaacaggctagcaaaagacacacaaaacacgatacctcttcccttccccacttctaacatggagaacgtttttactcaatctgcactactctgtgtgttgtttcttagtagttcaatagttggaggttgctctcctacaatggaagaagaggtacttctcttgagctatatatattgttataattcaaattcgattttattcaactgaaacatagaagtaatagctagtctatattgatttgttccccttttcccaaacaattaaccaggtccaaaagaattggcgaacattgatggcccctctacttcatgtgaatttctcttcatcggatcatatatcaactcaagctgacccagtatattatgtgagtgtcatatactccttccgtccaaatataaaacatagttagaaatttgttccaaaataatgcaactcatatcttcttacctatcatcgatgaataaatcgataaatttctttcaatatcccatcaccgtacctactaatataactttcctattaatttggggcattttggttctttgtctcctttcttaactccaccataggaagctaaaatttgagtttttttggggagtatgttttttttccctagatctaaaagatgcacttgtactcatgatcatgattttcatgaccaaatacgtactttggcagtttgcagcatatggatcgattccttcagacgacgctatcaagtattacggattagaggccaccatggacatttatggctttaatctagagcatggacaacaaaccggaggtttcatttggatttacaatacggatgaagcatctgccgtgaataaagttatagctggatggaatgtaagttaaacttatctgcttgatttggaattgtaatttcaagcctacattagcttagctggttgatgctcaacaggttcatgagcttctcactgtcaatcgaagatgtgtcactaaacaagttactttgattaatcatttgctccatgtcttttagttttaacatttagttgtattgtacctcatacaggttgagcctgaatcgtacaatgattcacagacgcacttcagtacttggtttgtaagtttcttcataaacactgcagtttcctatccatcaatttttatttttattttttttgccataataaagattttgtatttattatgtcataactcattctccaattaatgccagattgaaggttctaatgtttgtcctgatatgcgttgtcctggattcgaaagtgtatttagctcagaaatcgttcctggaatggtgattagccctgtttccaccacctctggcaagaaacaatacattacagtcagagtatccaaggtttaattattgtctaattaataacagaacaatcttacattccttttttttatcccttcatatataaaatggaaatagtataatgaatctggacatacccatgtctagcacaacgaatctagatatacctatgtccggattcgttatactaggatatgtcacattccatgctggttgagatattttagcacggagggagtatgcgtcatgacactatattttgatgatttcaggatcaaaattccggtgattggcaaatctactatggctttaatggggatgccaagcttgcaggttactatccaagatctctgtttacaagcttgtcagataaaccagtgacaatattgtttggtggctatgccttgagaaaggatcaaaagccaagtcctccaatgggcagcgggaatgccccgtttaaaaacgccgcatcatttcgtagtatcaagttttttgatgccggtggcaacgcccatccaatcgattttcgtctcggatttatatcaaattgttacactatttctgttattgaaaatgatgggttcttttatgggggacctggcaatatttgctagtagtttgtaatcgagcttcaacttagtgtaatgaatatcctggggactgcacccacagagaaattgagcttcaatagagttcatcacaactgttgtgccactcttagttgataagtatttagcctcatcgtttgacgtattggaggaaaaaacgaaatggcatatttgcaaatgaaaaataatttgtgaataaaacttttatatacatgttcttaacgatctaagagtaaagactgaaaaataaactatggaatgaaaaaaaaaactcaaaatcagctccaaattccaaatttaagattaaaaaattaaattttggctgataagcataagtggaaagatcaagatacaagattctaatatactccctccatttcgaaaatataagcagataaggagaggaaagggaaaaagaaaaagaagccgaagaggaattacatatgcgtcatggttccttgcttttagtttcactttcacttttacccagggtatttacatactcactccgatttgataattcatgtcatatagacagcgacacattctccaaaacctatctttgaatataattttctattataatataaaaaccttaataagtactccctctattttatattataagttgtttaacttttttcttagtcaaacttcttagagtttgaccaagtttgtagaaaaatatactaatatttttaatataaaacaaatatattattaaaatatattcaatgttcaatttaatgaaactaatttggtgttatagatgttgctaatttttttataaatgtggtcaaacctaaagaactttaactaagaaaaattaaacgacttataatataaaacggagggagtatctaatttaatttgattttttaagtctcatctacacatgttgtcccagtgccttaaaattaatatttcaaaagttgctaattgtcaaagttataaaagtttgacatcacccttataaaagaatgataggaattataaaaacaaaaggagtatgtgacattatctttcggatactttcatcgtaagtgatccctcggagtggatactttcatcagaagtgatctctcaaaaagagagaagaggaggtgtacacttggcatggttgcataaggtaaaattcatatcttgccttttgcttggtcgagctagctagcccatgtcaagccagctcgtatcacaccgtagaaaattaaaccctactgtcacatagattatgagaaaatatatatagagagctatagaaatatagaatctagaaaataaataaaaaccatatttttttttatagattctcacaagctatttctcataatccatagtttcctaaacaataccaaaacatctaggtacttcaacgcgcaatatatatgcaaaggaaactactccttcgtgatgattaaaaaaaaatagggtcatcgaggccaatgtcatgggctcacggcgacattaggatggagtgccgccgcaaccttcttccggccctacgcaaggaggcaggtgccactgtcgccgtcgtccgccttaacctcgagaagcaatttcctccttctgcctctaccccgggaggctgccgtcatcatcgacttggatgccgggaggccaccatcaccatccacctcaacttcgtgaggccgtagccgtcgtctgcccccaggaggcacccaccactgcccccatctactaactccaaagagaacaccgccgtcggctgcttctagcatttcaggtgcctactactcctatgtatctttttagttcatatattggttacttaaggacagtggcggatccaagaagatataattagataaagctatagcttcccttcaaatgcatatatgataaaaaaaatttagtcgaggcttcgtagggctcccatggtcctattgcaagtactctatctggaatggtcggagccattgtattttttttgaacctggaacggtagcatgcatgacatgtgacttgtataagaacactagctatcaggtgctaatgaaatattttactctaaactttatgtcattcctatgcttgtgaatagcgacagacaatcaggtatgagatatgtgccattcacttggaaaaaaaatatatatgacattttacattcaaacatcaaacattatattgatcaaacaattaatatactagctgagctcgtttggccccttttcgaattactataatgtaaccatacattgctgatgagcatacctgtttttcatcgtaccgccaacaattacctgaattttgttcgatcggatagtaccagtaaattacttttactccatccatcaaatcagaaagatgacaaggaatctcatataggaagcgtacatgaacatatataagaccatgatcccaaataaaaataagccagggaaagaaatatttttatttgggatatttttacttatctttaaataaaaataagttggacatataaaaggttcaacgaaagaaatattgatttaaagataggtaaacatattcaatgtgcaacttatgtagaatctgaacattccaactaaatctagaagtacgacacagtcaaacgaacgaaagcttcacacaatacttagggtgtggtgtgtttgagagcagtggaaaggagaagattgagaagacaagtaaaacgagataagtcattagcatatgattagttgaatgttaattattttaaaccaaaaaatagattaatatgattttctaaagtaactttgctatagaatgttttttcaaataacacactattaaagttcaggaaatgtgcgcatgaaaaactacacaattttcttctttgttttggctaaagcagccatgcgtcaagcacggcgtggatgtggatcacaggatcgtgggaataattaactatttaccactcttacaaatggtcatagaggatttgtcactatacccacatatcatagatacatgaggacccatatgttatagacaacaagtggcaaatccttaattaccatatttagaagtagcaaatagttaaatggcccattctcttttttttttcatctccttcgatacatggaatgtgcttgctattgagagaatctgtttaatgagaagacgaaccacatcgccactgagccgtaccagagtatggacgctgtttgcgaggcacatccacacatcggcgctaatctccacagcgtccatcctagtttcgtgaatctaatctatgatttacaatttatttaactaaacaattattaattaccgtatataaaaaaatcaggagaatatcacagttccaaaatggagcttaaacattggcatccttaatatccatgcttccttctgaatcattctctaaattcgtaaatgccaccaaacaagatatagggcctttcggctagcactacaagatgccagcacggttcgagcctcacttctgggtctgttcggtggcactggctgcagcagctgcgcagcagcatcagctacagtggctgcagcagccagccaacagctgttgtaccctgtagggcttgtaggggagtagttttttctgtaggggctacagcagtttctacagtcgaacagctgggctgtgcagcacagcccaaacagctgtgaaaatgggctaccgaacaagccctctctcactacgagagatcagaaggagcgtgtttaacgttcaaaaacacacaagatctttcccatgtgtgataatgtcttaacaaattctgatcgagagcccctcctcacatatcaagtgttttttttgcacactctatcagcacttaagtattagtttcctatgatcacctacttgtatttcatacttttaaatagactagaaaaaatgtctatgcgttgcaacgggtaaagactattttaatcttattattgttatatgttttagttaagataaaatctcctgtgggaacttatttggttatatatattttttaagaaaatcgtgagctgcaattaggagtccgatcgtctcaacttagcatgcaagttttttaaagagaattattgtacgattccttttatatttactaaagcaaacgaacttaaaacctacatatttctaaaagcgaacaaacttaaaaaccgactcatgcccggatgagtaccaaaataccagcaaaaacatcttcaatttttataataacagagattagacctatgcattagtttccagatcacctatatgcatttcacatctttaaatatatcagacggccaactaaagagactagctttctcaaatgcacggttctttatgaagatatacaaggaaaccctacatgtaatgtgatttgaggctagctttctccaatgaacggttctttatgaaggtatacaaggacttaaccctatatgtaatgtgatttgatttcaaattatttttgtttaatagatattcatcaacaaataggaagaacatcatacttcatgggcataccagtgattgacttactgaaatcactatcatgtcataaactcatccagatggcacacacactgaaaatgtgacccaaacttctccaagggttgaatattaccatcagcattaatattatagtgatataaattgttttccgcggtccgatttgtaccatgatgaaagacataccacacaaatttaataaatgattctaaaatacgatgatagctaacacacattagttgtgtttcaatctggccccgtcgtgctaatttttttgtcgtgtttcaatctggccctgtcgtgctaactttttttgtcgtagcttctcctcttcctcctctaataataatttactaaacttttaaaaccgtaacgtatttaacatactaggacttaattaaagtaagtagagagataaagtaagaaactaacaaagtataagtagagggatcaaagtaggacattgagaaacaagttagaactcgagtatttgtagacttaactacttgaggttaaaatataatgttttcattttgttatcagcttgttatactgtatatattaatctaacattgattgtgcagtgcacaaataaaatctccctcaactgttaaatgggggctaatttatcttccttgatggttgtttagattaaattttcgatacattgatttggttatcattttatatggtggccacatagcgtttacatattattaccgtaagttaaaagatatccatgtagttattttaattaatctaaaagtagaccataccgctttcaaaagtgtttcttctcattaaaaaacttaaaaaaaacaaaagaatcaacagtgcattaatcctcttcccccttaaaaaaattattcatgcctcttaaaaactatgtcctaaaatatatctctaaaaaatataaaaacctaatacatcataaaaaatcattttagaaataaactaaatcatatttttatatctagatcccattgtaatgcatagccatttaactattaaattgtgaaccgcaacacacttgaatagtatacatagtgcactatgatcattggattcataacaattgttaatctctaatttatccataaaaaatatcattttatatcgttcaacattattaatctttatagcattctaaattatgtttagcaaaaatatgtttccagttgttaaaaaactagtcaaataccttatataaataaaatatcattaacaaagataatattgattatttattgatgtagaaacatagataatatatattacagagcgcacacacacatgagcagctgctagaaactcccccaaacagaccctttcgtatgagccctcaccggcggatcctgatccccttcatgcttccttaatggccccacctcctatacttccccctccccttctttggctcgcctccatctgcaacatcgggctcctccgcctcggtctctgcctagcggcgcagggggctcgccctcaaccagtcgctcgaccacaccgctgtggcaagcctggaagcagcagagggaggcgggtcttcgttgataacatggtaaggaggaggtggaggtggatgtggatggaaggagtaggggggaggaagcttgacatgcaaaccctacattttttttacttgcaattggcatgttaactctacaacttttcttttattttttagagaattgctacgtaagccccatgtgtggaccaattactcacgataaaggcatgcaagcaccatataggacaaagcaccatcaaaactattgaaggaaacaaaatgaaccggttttattacttgaggaagtcacactatctataattggggatgcaaacttcggccaatagttttgggaggtaaaatatatttctttcattgatttttttcagccaattcggttaaaggcacccttattttatttattttctttttgttgtttttgcaaatctccttgtttttattttaattatggaaacatatatattacacctcaactatcttgtttatctataactagggatgaaaacggatcggatacggacggaaactagctttatcatattcgttttcatattttttttcggaatcggaatcggaatcgaaaactcggatacggaaatgaaatcgaatattatcgaatacagatacagagcgaatacgagacggaacgaatacggtagcggatatttaccggtatataaaaaacccctcaaattgagtttcttgatcaaggaagagatatcgcttattattttagttcaacatctccaacatttgtatcgtcaattttatagacggtcccacaaccctatgtgagaatcgattttcatggctattcctcttagagatccatatgcaaatatgattatcattttctattcccaagaccttttactagatgtataacttacttaccattgtataaattggagatgttatttattttactttacatcttcaaaacttgtaatgtttgttttatactttaaatgctttcaaatacaaatgttataaactacaaagtggtagatcccgttgagctctataactttgatatggaacacatctccatcagatgtcgtttgaattgtagatatgagattttataaaaattaatatggtatattataatgaatatttagactcattaaatgacctcaaataataaaatagtcaataagaaaattgtaggtctcatcaagctctacaatgttgatataaagtttgtctccatctgattccgtatgaaaaagttatgtatatatacatgttttttctaaactttgctcaatgtctgcggatatccgaaaaaaaatccggatagtttccgaccgttttccgattccgacggatagtacccttactgtattcgttttcgtttccgagaaaaaaaaatccgaattcgtttccgaatccgagaatttccggatagttccgaccgaaactatccgaatccgaaaaatggtccggacggatggaaactatccgaaccactttcacccctatctataacaactttcaactcccatactatatattatttaacttgctatcactactttaaaaataatttttcatggcggccaaaataggttttcataagtagccagtggaaccgccagagaccaaaggccaatgataatacaatattttcattggtgttcgccaaccgccaacgccgatccattttcattggtggttttcgtaaggtagccacctacgaaaataaatttgcacaggcggctatattatatcgtccgcctgcgataatctagccagcactaaaaaaatgacggagcgacgtcgctccgtctgcctccattagcgccaagaatcccaaaatccgcagaaattattcccaaatcctcattccctaatttc

SEQ ID NO: 64802 - DNA, 2639 bp, Oryza sativa
  unsure (1)..(2639): unsure at all n locations
cataaaaaattattgatctgacaatgttgtacaatctagaaataggcatgacaaattgcatataaaatattgcgtacctttgtagatacatgccggatgtatctacgaaattagtagattaatttaaaaaatcaatctcctaattatcttgttgcgtactcgttcgatatcatgtgatctgacnatcttttggtacgcccgcggagcttgaggggcttgaatgatctcgatagggccaagttgttgacgacgatggttccgatcttgtcgaggcacgtactctggtcaagttagatcctccatagccgaagttatcgagtagtatgctgtcagagaatccatctcttaaacccatctcgtcgaaaccttgaagcaccaaaagatcccttacctggcgcgccactgtcgacgtttgatgttgcgattccggtatttgcatagtatggggatcgttggtgctaggatatatgcaatattgtagtaaaagagatgnggacgagggattttatataggttccggcccctgaatggtcaggcaataactctactcctgttggccgaagccggtattgctcttattcaccataatcacaccagtacaatattgggggtggcctatctaactgtggtcgatttggcgatatgtagtattgactcgtattcgacaacagggtagccttcctcctcgaatccgcatccggcgagatcaaagacagtgctatatctatcctgatggtagccataggcaccgtaggggactagccatgcctatatctgaagtcgatatctgacgtcttgtcttacgtatgttggcttgtctgtggattttttgacttgatctattgttcagggtcccctctcctcctagggggtcttgagtttatacccataggtgttcccttgtccaagtagaattaggaaaaccatatggatacaatccgagtagtccttgtcgtttccatgtagaactctattcatccttccttatacggaatttctcctgtatccgaaggttgtttctgtataagacatggtatgtggtgggtcctgccgagatttagtcaattactattaggtatgtggtatccataacctgacagtttagatctagtctagtcactgtaacacactaaaaagaaatgtgtttatatcagggctaacttaggatgccatcgtttggccaattatggataataaaccaaacgtcgtattagtgataaaaaataatttatgaataaaaactaatgatttaaacgtcaatgttaaaagagaaactattataaaaaaacttaaaataactttaaaaaatttaaaatttttggtatcagcatatacgttacaggaaaaaaagatgtggcccttaaattcaacacgttgataccaattgttggaacatttattaatgcgtcggtcttacaaacagcagtgcatatacacacagaatccccatgctgcacgctctttcctctatgaaccagcttttagggtattgaaaagcaaaagctagcacaaaatacatatagtactatactagttatcattatttttttgaaagatcaaaacatttactgtaattaactgagcagatggaactcacttcagggagactnaaacaagtagccgacagatataaattaagaaagaggctattnatcactctataaacctcgatgcttttgatattgtttcccgaatctgatatgcagatgctgctaggtggccctcatcgtcgacgacgaactgatcatagctcagtgatgctgagggttgggccccccggggctgagcctcttggacccctcgtaaaccgtctcgtcaatctcttctccatcatctcgctgccgcggcaatactgtttcgaccgccgtgccgctagtcctcgccgcggccggcgcagctggcggcggcggccgcggcgggggttgactgacgacggggcggcgaccatgtcgtgaagccggcgatggtgatggagcactgggcagcggtcgccggagacggagacggagacgggagaggacgagccggtgacgaggaggaggaggaggcagaggcagagacacgagagggttattagtttcatctgtccggcgctggtaattagtgatggtgttgatacatgtttatgtagaggtttaagctggcctggaaacgtctatttatagtccaaacggcagtgctgcttgacttgtcaattacgtactggtttcatttttttgattcacaagtatatattttttttaaaaaatgtgttcatcctgtagtatatactacaaaaagagcccaaattatactgtttttattcacaagcagaagtattacgtgcaggcaccatacggagcatatacaatgttctttcttcttttcccctttggcagatttacaagctgacctaactctcaacattttacagcggagcatttagagtttggtgtgttgatgtactgatcgatgtatgtgtatgtgtgtcttttagttttaggagtataattgaaaagagaaaacgtttgaagtttattttgttgttgtttcagaagttaaaattgctttcctaaaaaaaaagagagttaaaattgcttgcatgtatatatgatctcttcatggttctaactcaatcaggtaagacatgggagtgtatg

SEQ ID NO: 64803 - DNA, 1621 bp, Oryza sativa
tttaagttagtttatcttaagacttcataatatctctccttttctgaaccagcaatattataacatttcaattttcaagtaccattgtattgttcttatctccatattgaatcatgtggttagttaattgtcctctcatttctttccatgaacagatggttcaatctttgtctgtgcactaattcaggatgctactagtaaaatcttgcctaactagtgacggaaatgtaagtgccttactgttgttaatccccttcctcacaggctcatagatttcgcaagaactccattactaaacagtcaagaacttcacatgtatgcaaataaactctaacatgcaagctcaagcactaaccatggttggctgcagccgaggcggtccaggaacatatcatgctgttcctcccgcggtggtcggcgtcgagggacagcatgacgcagcgtagccggtcatcaccgtcgtccctcggcggctgctgctctcttgtaaaactcctgcacggcgcatgaagggagctgaggcaactgcggcctgtggagggtggcggctgcacaagcacagaaatcatactaatgctcaagaaaaccaacccaaaaatcatattaatgctcccggctaatcaaggtaatagatgcttctctcttcctactaacacctaaatcccacaattacacttctttttctctaatgccatccatcacattgtttgcagggggttgatgaattagttagtgcaatgcagggactattatggagtgcaccttcttctagacagcttgtgggggacatgctacccgggtgtcctataggaggccttcggctacagcgcagggggtaggccgagttgcctaggcccatgcggttatttgtaatacatggaaagggatagcagccagggaaacctatcctgtatctgtacatgaatggtatgcaccaagattataagggataccatatcacacatgccggcaaatcccccagcattatataaggggcgctggcatgaaccctaaggggttacgcaatctttcatactcatcgggcacaaatccaatccacatacaactggactagggtattacctcgcattgagggcctgaaccagtataaatgtctgtgtcaccatctctccttgatatagaacaccctataaattatattgccgatcataaaaatcgacacatctgtgtacaacttggcaataatccatccacgcaccattcctcatatggcaataatccatccatgcaccattcctcagatgaggatcttgtatgggtggtatccttatattcctgtacataaatcatgtaagtataagcatgtaaaatggagctttactcaagtgtgcatatcaatgcctagatctagatggctagatgtgagcaccgtaaaggaactaatgcttaggtagcataagttttgcataccagctgtatgtgtgttcagagaatagctataatcattgtagaatcatgtaaattcacttatgctgtcaggtattccaaattttttgaattctaactttcaagtgaacttgcatagtctcctgcttctagctatatcagacggcagatgcactagacgaccagttcttataccttttactcttaaataatg

SEQ ID NO: 64804 - DNA, 552 bp, Oryza sativa
tcaacgagttggttagcttaccttcttttgcagctgaaagccattctctgcatgatgcaaaatattgaacctatgtttgacaatatatataacttggttggccaggttttctccatatatattttttttctaaaaaaaagtcatgtccagttcgtcttataactaatttcttttaacaaatttcgaccccatgtcaaatctctatcttttcaaaaaatgacttcatgtacttttatatttttcaaacagtttaccttctgaagcattattgtcctttttttttcaaataaacactcgatctatagggactatagctacttagatattcttgaaggatttgaactaagaaccatcaaaatgacttcattttttttttcaaataaacacttgatcacaaaatttgataagatagactataataatatatatcagacactataaaaacatgcaagtctaaattagatctatatatgaagaaacaaaaatgataattttagagtaattctatggtccttgaggaggtaccatgagggaccaaaatcttagtgtaaa

SEQ ID NO: 64805 - DNA, 796 bp, Oryza sativa
aaaggtgcttcttgcatgttaaatgtgcccatgttcaatatttcatattagtatttcctgtgcaaacagagtctgttcaattctacagtgtaactacagatatctattgcattccattccttaaaatattagtatttcatgggcctttttcatttatgctcatactttccacgggattcatgtagactattaatgtatatatgtagaagcatatcgtttgacttgagaggtgatgtcatggcatttgtcttgcataatactttcataacagacagtttccatgtactatattgtaatgaaaaacatgggcaatattgcattggagactgaaaagtgaaaaattgacctgtgtttgtgaagtttgagagggcaaagattaaccttattaccaacatgtggctccgctacattgaaaatatatattttaattcttccatttggtttaatattattgatctttttgatgtagatgtcatttcagatgtgtttgcctactcattatgaattttttctttatctgttgaatggttaataaattacaactcattttcctttcttgtttatacaaaggacttgtaaggaaaacgaagataagacatttgccaattgctctataccacaagagaagacagatgatgagatcaatgcaaagcttgggctttcagatgcttctgctgatgaagctaatggcgatggatcaaactctaaaggtttgaatttttgactctatacattctggtcagaaaatgcaaaattttcttttggtgctctctatcatatctgatttgtgacaaac

SEQ ID NO: 64806 - DNA, 1344 bp, Oryza sativa
ttggcagtatgcagaattaatttatttaatcacctctattgacttgaaaagtaaaatctgcggggctaaagagtaaacagaaagcagcaggatgtccaaaaatacacacgtcatcgattatcacaacactagaaacaagatcccgcccgagaatgcaagagtccccatacgctctaggcacgcataagagggatacggatacctccctcagcgaggagcggagcggcgacagagatctctacacacctggatgcgcctcgatcagaagccctaacaggtggacgtgccggaggcatggggaggctgctgcggcgccaattgtggccacggccatgggtgagagaaggagaggagagggtttagggcttggatgcggcggcgatggcgagacggagaagtggggaattctcgacgagacgaggaggggaagagatgagatcggacagggtaaatgggcttcatgggccgcctgagtaagtaagtagttgggccgtcgagctctctctctgctcggcgcgtcggcatcggttcgtcggcaaatggcggcgccagcctacgtgtcctctcgccggcgaatcccacatcctcgctgaccaacgtgtcatcccctcgtgcacacgtgtcaaacccgaaccgcttaagctccaatattttaagcctcccgccgcaacgctgtcccgatcatgtacagcgacccgatcactctctcactgtctcgttcacgtagctcacctgctcgacacaatggcgtcgcagcagcagcagaagcagccgaggaaggcgaagcagaaggaaggggaagggcactcggcggaagaagcggcggggctggaggagatcggcaggtatcgcgcccaggcgcagcagaactcgatggacgccatccgcgacgccgaggagcggtacgccaaggctaaccgggagcacggcggcgcgacgcgggcgcccggcgccaccgtggtgtcgtgcgtggagcgcaagaaggagcagccgccgccgccgccgcagcacgggaagaagcacgaggcggcggaggagggacacggaggcggcaaggcggagaccggcggccaggagggggtgaccgccaagaaccgcggcgaggggcggcagcagcatggcgagccggacgccgccggcgctgctgcccgggagaagagtgctggcgccacgcacggcgccaagcaggccggctcgaccgcggccacgcgcgccgcggactacgccgcggccaagcgcaccgaggccaaagacgccggcgcgcacaccgcgcaggccgcgacggagaaggcgaaggtggccgcggggacgcgccaccgactacgccagacaggccgcagcgaa

SEQ ID NO: 64807 - DNA, 574 bp, Oryza sativa
tcccaaaatcaaaagatcaaaccccaaagtttcccgaaacaaatccaagtgaaaaaggcatgtgcatatgaaaaggggttcagagggctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttaaagcagtaaaaca

SEQ ID NO: 64808 - DNA, 6515 bp, Oryza sativa
acttgatgcaatgtacttatacggttttggagtttccgtattgatattagtgtactccacaaagatggtgatttttttccttttcccgcagacatccaaatccgtcctcgttttcatatgaacggcatcttttcttccctttctagtatgccttccagccacctgcttggtataaacttgaacatgtagcattggtgaaacccgagtttctgagctcaggaaatatcatggacgacagtgtcttattgttcttggaaaccatgataagtgttactcattgctaattttgtgcagtcccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaaggtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatactagtgagttttgcaggttgaacaacaagaagtgaagaggtttgtcactacgatggtgctgttctgcccttttggcaagaagttggaagagtggtgtcttcaggacatcctttgttgcttttttggtgttccttctgcagtcctggaactgatatttatatgtgcccacaattggtgataaatgacactacttatctagataaagagtcctgttgttagctccacaatctctttagctaaagagacaagaatgctatagtagtatgaaactgtcaagtttctcgctttactgttgttttgtggctgtaccacgaagactcttgtgtacaagcagaaactccaaaagtttcttgcactagaacatctgggagaacaagaacacccaaagggagaaggctttaaactgagaagtagccaaacctctactcgcactccggaaggctacatccagtcaccattttgcagcctcagaaatggcatccatcaaagtcgaaaccgcagaagaagctatggtacgggacaacggacttgatgtcgttcaaggcattggtgctgaaaccacgggccctgaacaactcttgcatctttctcgaacctggctgaaggcagaacatccgaccaaccctggccatatggagaaaaatggcgccgccatggtgagcgaagccgacgaggcgaggtggactgaaaagctgaatcgacgcgcgtagcgtccatgccatggcaccggcaccggcacctgccgtctccctcacccacacgttcagcacgaggtcatcagtagatgcgaatcctagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaaggagaatctcggtcaccatatcttcattgagcacatcgacgagtccgcagcggctgcttgaggccgtggtgttgatgatggcgtcgccggcggagctcaagttgaggccgtcacttgggagctcatcatgagcattgccgaccggagagaggtcgacgatgtccttgtcgccaccgccggccacggcgtctgacccgaacctccacccgccgaacaagctggggctctcaatccacggaatccacgacggcggcggctcgtatggcgtcgccttgccggtgaggccatcgtgatcgaggacgccgtggccgttggggaaggggacgatgtagctgccgcctaaaacactagatcaccggcatacctagcgtttaagatttgtaaacaaagataataggagccgaagtcaatcccttaaaacactcctccccgaacctcctcctgtatctactattggttgactgaaaataaaccaaaagcaagggtggttgcacatcttctgaaaagaaaagggctcggtatcgagtcatctactaaaaaggaccctccccgctgtgcgcccctccttgaattattcggtcatgcaatactttttttaatacaaagaacaaaatgcatttcgacctggagccggcctcctcctgatcctggacgaggcggccaccgatcccgctgctctcggcgagggaggtggaggtcgtcgtcgtccccgccgccgccagcaccagcgccgcgccgggaccggtggtcatcatgttgccgacaatggcggtgcccccgctgtcggagtcggcggtgtcgccgccgattaggccatcgatgggccgtggctcgaacggggtggggaggtggcgggggccgttgggatcagccatcgtcgcgaggcgtgatttgaaaggggcgaggcgtggtttggtggtgggggagagaaggtctcagagagagcaaggggcccgtcttaaatagacgggaggtaacttgctcggtaagccagcctccaccgccgttgctggctgccgtgctcggcctcggcgatgagaagcttgaagctttttctcgccgatgccaacggccatgtggcgattaaacaggaaggtgactcgccgagtgctcttctcggtttattgggccagaggcttttcggcccaacagaagtgtggaccttttgtacttgtgaaaaagtttaccctttgatccttatcccttaaccgtaaaaccatgcaggttttaaggacgattttcgctgacatggcatccatgcagcaatctaattatcagataattaagaaaatagagtggacctgtttgtaagtgactcccctcttctctcatctatcctctccaatccgcattcttctcgacgtcctgtaggtcctacgctggcgtcagccatcttgcgatgcgccacccacgtgtccttgtcgaagtttaagataatcgagcacactatcacagaagaggaattgaacacacagtagaaatctactctagcaattaaacgtgtaatcaaaatctgctcctgcaaccgaacgtgcagtcgaaacctgctcctgcaatcgaacacggcaagagggcgatcatggacttcattgctgtcaagaataggagggagagaggccccatgggaggatggatagagggaggaagaaagagtgagagtgtggatgacacacatgtttcaggccactgacatgtgggcaccacataatattccttgatgacatagcatttttaaccatgtcaacgtaccacgtcaccaataccactatcaatactatcttatgaatcattttgtaccggttttaatagttgaggtattcgttatatccggttttatggttgagggatatgaattagattgacctataatttaagggagccaaattggaatttttagttttactctcaacaaaatgagacccacaattagattaccggaaataaaagggccagctatcaaaaacttcaaagcaattacaaatcgggcgcccgatttgtttctcaaaaattgggcgttgtttcatttaggggtgaaaacggagcggattcggacgataatggtcataccatatcctaaaccatatattttaagcgggtgcggatagtgtacggatgcggatacggagcagattgtttcggatgtcgaaaatggtgcggaatcagttcggtaacggattaaatttatcggatgttacgtgtgtacgcaatcgatacaacatcgagttagcaatgcaaggaacaataatacaataatcaataaacgacccatcgtaataattatgtgcttaagtgttaatcaacatgaatatatgatgcccataatataaaagtacagctacgacagtgtgacatgagacagtgaaagcctcagactaagaaatctaggttaactgatgaattaggcaattggatgaaccaacttatgtaagatgcaatagatagagtggttacatgtgttgataatttcggattatctggcaaacagcctatcggataatctgatagaaatgtcggataatccgtattcgctggattttagagataccatatcctcatccgtatccgcattgtactatccgcatccgcatccatatccgccatatttctaaagcacataccatatcctcatttcggacggattcggagcggaacgaatcgatccgttttcacccctagttccactagtcgaataaaaatgtttcacctattagatcgaaaatgtttcaatcccttaaaatgttgaaacacatttgaaataagactgaatcattttggtgcaacatatgaacatcgaatatccccctactgaaacaccaacaaataaatatcaaccaaggacaaagatatgaaacaccatcaaaatcccatcgcaacatttcaatccaatacaaaagaacatcaaattacaatatataaacaacagtttcaaatatattgaaacatgaaacacatctgagtatatcaaaaaaataatgaaacaccatcgaaaaacccattgcatcatttcaatctggctaatgaaacataatggtgcatgggctgaaacatcaaaaaattcaagagaaaaacctagatctatctcttcctccgctctagtggttagctaccacatgaactgggatgctgtcacgcccagaaatttagctcaaatttccagactattttatgtattaaatccctgtccaggatcaggcagggtacataaaacgacaagtaatatacagttccaaatgcaaataaaagcgtaaatacttacagaagagacacttaatcctcacaccgaaacgaaagcaacagcagcggaaaaaggcgatcctagcggggcttcagctccactccataggcaaaactcaattggggtctgagccttggtcttctaacttcgtcttcagctcagaagcactacacttctgaaaagggggaataatagcaaggctgagtacaaccaccgtactcagcaagccacaccaacgatgcagacgtgcaagaggaacacaaggacggtttgtggctattgcataaaggcggttgtaaaacattttattgagcaaaacagtaaaattgttgagtaattaaagtaacattaaatctcaactgatcaacgctacaccacgttgaacaggcccaatgtggacccccgtttttataacaggaatcaatcgtgtaacagtaccatttccctggatcaagtagtctggtacatacgagttcatagctgaaataccaaatacacatacacgagagtctagtgcgaattattacatcataagcccgcaggcatagtcttagatcatcggactgagcggtccggaatacattccaaaagcagaagtagataaggcagcggagttaaggcagcggcacgccattgccacaggcaacgaccgtaactaagacctactgagcgccatcgtcttcatcaccctcctggtaatagtcatagggatcctccgaagcttcatctccggcctctgattaagtttatatattgcaagggtgagtaccaaccgtactcatcaagccaccacagcaacaatgcacatgataggggtattcaaaggatggctatggttcttttgcgcaaagtaagtttt

SEQ ID NO: 64809 - DNA, 3195 bp, Oryza sativa
  unsure (1)..(3195): unsure at all n locations
atagccttcagtagcgacgagtgtgcgacatcttttgcagcggtaagtagtgcctggatcagtggtttctaggtcaccataagttaccccatctgtgtactggtttgtttctgcagggtttggattagccactggacttgtctccagctcagtttgtactgctggtttaatatcagtttccgcgactttgtcctggcttatttccgcaggcttttgatcctccatggatcctggcatctcatcaacctctggttctgactttttctgttcaactcccaattctagcgcctggatggtttccatctcctggttgatttgctcacccctgcattagtaacagttaagacacaagtggtgtttctacagtgcttggtaatgtgcaaacataaataaagtccaagctttgcaatgttgctgttgagatattcatttatgtgcaaacataaatagtgacttttcaattcaaaaagaaaataccgtttctataggttgcagtgaatagtaattactcataaatgaagaacacaactgtattcagtattggaaaggcaaacatgatcacaatgtgctcacttgttatggaccagcgctatgggagtagatacgggtggcgcacacgcgaagaaatgcagcacccagagtagcatagcccggttacaattagatataagatatataattagtaccaattccctaattttggtgagtatcctagtttatctactttgtgctaaactatcaagaatgcaccgtgataanggattactattccattaagaaattcaggaaaggacaatctgccatcctatccagcagcaagatttcggcctgatattaaactcaatagctacaaggattataaactcaatgattggcgaaaaagtaaaacaaaatacgattaacgaagcagcacgaaaccaaatattagcagcagcagcagcagcaaaagattgacgtatataataataccttcacatcaggactaatagtagtaatccaaccaaattctggcccccagctaattaacacagaaacgattgcgggctgactattattatatacatatatacagaaaacaagggttcgtcccagagatgaagacgccaagaagatgaaatcggagcagggaaatccaggattcaaggtacataccctagatgttagatccgaccacccaagcggccgcaagcggagggctccttcgtcgacaccgcggcgcggcagcggcggcgacggctacggcgacggcggcggcggaatcgggagcgctgcgcctacgtctccacggcggtggttcttcttcttcagttccgcttcagcaggggacgaaatattagtgaaaacccaagtatatggacacgcagcaacgcaccttaactcctaatcggaagcagaaacggcccaagcccgtgcgatagttggccggcccattaacgtcggtgcaccttttactcagagtaagtctgtttttcctccctcatctctaactcaagggtataacgcttttcccatctttgaaaacccttctgaccatgttaacttaatcccaccaacaaggggattgagaggatgggaggggaataattccacacctattcaggtatggaattaatcccttttaatctcctccaatccctccttcacgctcggtggttttagaaagtggttttagaagcggtttctaccgatataacagtttgaccatgattgacccattgagtcagcagatgaaacccacgtggtaaagactttcttcgcttctcatcttcttccccgtctctcttccaggagcaaagagaaaagcgaggcatgatagagttattccttaattcgtttcatcgtcggttggtcatgactcatgacgtggatccatagcaggataacattaccacatatgggcttgttggcctccatctcaatcagactaacatgatcatgggactcaacatatactggagctgaataaattatggacaagggcacatcagatgaattttaagaaaaaaacattggaacttcattgtgcagtctccactggaaagaaattccatggatttgacaagtgatatgcactagcatagtagcatacaagtacaagaacaatgtatcaggcaattatcaagaacatatactagcaacgttctataggctattttcactcagaatgttgccaactaaaagacggcactaacacatcggctcactcagccatatttcacaaggcctcatacatgccacaccccatattctcatgcgccctaccatttagtctacaacaccacgatcaaaactccagggaggctgctgcatcagtgaagcatcaattttgctcctgcaaggtacactgttactccaaattgaaagtccgaatgcaaacagcagcggttctgagttctgatccttgtgtttttccaccgtttactgtgaaccccttggaatatgaaaaggagtttctgatacactgaaaacaaaaagagagtttcagtgtggattgtagagtattttatcagtgaacgtaatagcaagagctggtatagtgtaaatatcagggaactaaattgtcgatacataattaaacaatggcgacagttagatgagactttcttttcttgctaacaaagaattataataaaccacattatagtttttaactcaatcttaaaatttgcacggagaggatggtcaagtaagcaattacctaacaaggatgaccatgattttcatgggctgaacttgtgaggtaaacaacagggaattctcagtttctcacatgttgcggacattgcgatggctggctatgcagtcttatctcacctacaaccagaagaaaatacacaatttgtcatagagcattctttgagacatcagttaaattttagagataatagtatatcacgttataattagaacaaataatctatattgtcaagtaccacccttgagttgtatataaaataaaatatccatccattttgagttgtatataaaataaactatccatccatttttaaagtttctactacatagggcatgcccacaatattttgtgggcatgtgttctctaataaggctgtaccatgtccattattatttcaacctaggattaaatccaaagtttaattcatagcattaggtttgactactcattgcattccacgtatgatcaaatcactcccttcattagtgcaatcaatt

SEQ ID NO: 64810 - DNA, 3543 bp, Oryza sativa
cacatgagcctcgtcccaacacatgagacgtgtcacggcaaagctttttgataacctcgcattggcagtacccgctccatgaactttacatcctcatgcactctaggcgtacacggtttctagcagtgagaggagttctggcgcacccgggaaggaaagactcacacatgcattaagttataagtatgtttagattctcacatggcagtcctgccgatggcgacaccactgtagacacccgcctcgcggtcctaccaatggctgctccaccgtagagcccctgcctcacacatcaagaaaccattatgcatggatactgcctccgctcagctatctactccgctaggtctatacccatacgagaagtgcggttgtacggggatcgtttcatgcttaacttcatggctcggtccttaattaaccggggacggcactagccttttccggacaccacccaaatcctccgtccgctccagtcgaaaacagttgtttaatttttatttctcctttcataaatcatgtcatcaacatcatggcaatgtggcgctcatgtctccacatgccgcatctcaattaccttcccaaaggtaattgcccaagcatatagcatttgataaatatgagtatgcatgattctaaaatagcatttctaagcaattgtcataattgactagggactcatacgtaaacatggttacgaaggcataagggtaaacaataatcaaggcatggcataatcacaagtaggatgttcataattgcatgcaattttatttgtaaacaaaataatttcgcaattgggatcgacatgttcaaggaatagtgatgacttgccttgctcgtagtcctgcgggtcttgatccttgctcggatccgcaaccccctcgggctctaaaattacgtgcgaagaaatgatttgaattcaattagaattcaaataaaatccaataaactcaaataaaagtcgaacgcgaatcgatctgcctatatcgactacaaagtttgcgaaaccacgttattccaattttagtgtcattcaacctaagttatttcgtgatttagaagtacactcctgaggattcaacataattatttagctcttaataaatctaaactcctaccgcgaattgattacttatagagattaccaaaaataatctataattatattaagttttgcaattctacgactataattaatctataattaaattctaattattctaaattttctaaacctccttattctctctctaattttctatttatttttccttttctttttctctctgttttttttctcttctttctttctttcttcttttctttttcctctccttttttttctttctcttcctcccggcttctttcttcctccctctctcggcttctcctcacctctctctctctcggctcacggcctacccgggcggcgacggcgaccggacgcgaggggagggcggcggcttaccgacggcggcggcggcgacggcgccgcaaggcgtggtgtcgcccggcgcggcacacggcgcggtgcggcggtaccgagggcgtcgacgcggcggcacaaaggcggcggcgcagtggagagggtagagaggaggaggagggaatggagtggggagaataggggaggtggggtttttatagggagagagggaagagggggccggttaatggcgacgcgacagcggcgcacagagctcggaacgactgcgacgcgcggcgacgcgaccgcgcggggcgcaaggcggcgaggggacgggcgcggcgacgggacgggcgacgcgacgacggaacagggctcgaggcgacggcggcacgcgcggcgcggcagcgggatggtgacggcgacggcgcagcagcggcggctcggcgacgcgacggcggacggcgcggtgtggggcgcaaggcgcgagcgcgtggcacgaggcggcgacgggacgatggcgacggcgacggcgtgcggcaacgcgcgacaggcaagaggcgcggcgcggggcgcgaggcggccagccgcgcgcggcagaggagggggcaaggctagggaatcccatcgagcacctagagtgcaatgaatagtgtattttcctatttatccctattttagcctatttcctatataaattttattctataaatcctaatttttgcataaatgaagtgtactcaatatttgtgttattctaaccaatagatacaccctagattaatattacccatattataattttatataatttatttgaatctttaattagggctaactcttattccaacgcacttaaatttaaatttaattgatactaatatggtcgcgataatatttttatttatttctatcctcacctaatctttattttaaattgtattccaactatttatttagccaaattaattttagggtttattcctaattagttactctttattcgcgattaatgaactccgaaatcaaaatccaatgaaataggcaataaaatcggcatgatgcaatttatttaaaaagtttttgaaaatccgtatttttagagttttgattttgttggtcgaattttcagggtgttacacccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacatgtttccgtgcgctgacatgccaccacgacataccggaaagaggccgtgaaaggacccttcgcataaccccctctaaccaagcacaccacacctcaggtttaacccccactcctcgcaaggcagcgggcagtcccctctcgtgcctaggtgaatccggaagccgcataggccatcgcagggcccatccaaactccatcacgcccacccttgcctagatgcgtaagctagaggaaagctacactacaagcccagccgttgcccacgctggcttgtggtaagcacgataaattcttccagggtttcccacgaaccggtccttaattgccatgggcacgactagcaaaaccatgcacccacagcccaccatgtagtcgcattttagttggataattacgaccatgaagcatggccagatgtctcgagcacgcagctcattctgatactaaaaagggtctaatactgtaattatcccatcaactgagctagtggtaattaagcatggctaagcatatagttttagctaggtcacataagtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatatgatagctttcataggtcgtaacatgagctagtcgatttattacccaaggttgac

SEQ ID NO: 64811 - DNA, 691 bp, Oryza sativa
cattgcattttattgtttctttttaaaaaatatctcttataagaatattaaaaactaactccaaggtgattctcagttactggcaaagccaacaaaaagaatgtattcatttccggcaaaaaaaaaattccatcaaagagtgattagatttgacatgcaatgatgacactcccaatcttgatatgtagaattaccagctaactttgtttattgtcggttaaattatcccatgactgctgtttcaaaatgaacccaaactctggcctatagcaatacagtgcaatgcttcttcgatacatgtatgataacacgtactattatcattggacatgctacacagctacgcaactggtgttaatggataaattgcatacctgcgaaagcttcttgtgctttcggatgcttgcatttatcaggatgaaccaacaaggacaactacagatggtacgaacaaacaacaattagatctaaaaaaaggattggaagaaaagaatcctttcagataaatggctcaataccttcctatattgcttcttcacctcatctgctgatgaatcaaatgacaacttaagatgctcgaaagggtttaacttgaagcaaccaagaatcctgataagttttgaatatgttaggaagtgcaggcagatgtatttttttttaaataaagtaaatcttatgtcaaattcattta

SEQ ID NO: 64812 - DNA, 725 bp, Oryza sativa
catcactatcgcatgatttttttagacattcatttttctattttatacatattccatcaaatgttcaaggtgcagtttatgtagcaagtgttgattaaaggcctactactgaataaatatagttgtacacttgcatgacactgggctatccattagtgagctttgaataagcgcaataattgtgaagtatattttctagtcattttcatgttggtatgatgagaaccataatggttgcaactcttgcagaattcggcaatatccgcagcagctgataaacttgcagagtgccaagaaacaattacaagcctaagcaagaaactgcaggcgctaaaatgtccagcaaatgcggatgctgtagacaaaagaaagtctgataacttgcacctgttagttgcaaatcagaattttagttctcccccatccatagaagcagcatgcaagaaagagaacgatgaacgtgttacaactgaaaagaaccttctacaggagcaagatgttggcactggccataaagttgataacaatggttcaacacaaatcgctcctcgtcccgtgatccccaagtcgccactaaccactgtttctgttgatatgaagaagaggaagaaaaagaagcagggtgggagcttgctgagtagactcatctttgggaagaaggcataaaacagctccttggctgctagcctgctacgctcctctgattaactgctagtgcatccagc

SEQ ID NO: 64813 - DNA, 20038 bp, Oryza sativa
tttgttgcagagtatactgtttaactaattagtactgggtaattgtaggtaaaaatatttcgggattttgttcctagtatcttgaatgtatcaaggcagtgccttgctaatggagaggaagatgttgcttccatcgcttttgaaatatttgatgaactaattgaatcccctgccccacttcttggggactctgtgagatcaattgtacaattttcgcttgaagtttgctcaaaccaagaactggaaataaatattaggcaacaggtttgatcagtcagccacatcctttatacatccgtctgattttacaaactgctaatatttcaaatgtgcactcattttttcaggctatacagataatctcatggcttgtaaaatttaaagcatctttcttgaaaaaacataagctggtaatacctattctacaagttatgtgccccttgcttacagaaacagctgatgaagatggagattctgatctagcagcagatcgttctgctgcagaagtcattgatacaatggctatcaatttaccgagacatgttttcccaccagttcttgagtttgcttctgtgagctttcgtcatattaatcccaagtatcgtgaggctgctgtaacatcattaggtgttgtctcagagggatgttgtgagcatttaaaagataagctagaggactgtctcaaagttgttttagaagctttaaaggaccaagagcaaatggttagaggtgctgcctcatttgcacttggtcaatttgctgaacacttgcagccagaaattttatctcactatgagagtgtccttccttgcatcttaaatgcacttgaagacccatcagatgaagtaaaggtgaaattgccaacttcatgttaaatcttgcatatggattgaagttgacgatattttctgtaataatgaactaatgtgatctgatcttgcaggagaatcatattatgcactggcagcattctgtgaggatatgggtgaaaacatcctaccatatctagatcccttgatgtgcagattagttatgtctttgcagggtagtccacggaacctacaagagacatgcatggtttgtatagtaatcattgctctaaaataatctctatatgttgtcaagtaggagattgacttgttctatgtaatcttttatttgacaaatgacaatgtttctctgcagtctgcaattggctctgtagcagctgctgcagagcaggcttttatgccatatgcagaaaaggttctagagatgatgaaaggctttatggtactcactaatgatgaagatttgtgtgcacgagctagggctactgaggttgttgggatagtggcaatggcagttggcagagcaagaatggaaaccatactgcctccttttattgaagctgctatttctgtgagtattagttgcattacttcaggcaattgaccaccttagtgcaaatatttatgttccttttatttgcagggttttgtattggattatagcgagcttagagaatatactcatggtttttttagtaatgttgctgagattttggatgatagtttcgcacaggtaacaagggaagtctgaagcttgttcaattcatgagtgctgtttatatttacggaagtggtttgttgtatattgcagtatcttcctcatgttgtacctcttgcattttcctcgtgcaacttggatgatggttctgctgtggacatagatgatgctgatagtgttgacaatggattcagtggtgtctcttctgatgatgatgtaaatgatgagccgagggttcgaaatatcagtgtaaggactggagtattagatgagaaagctgctgcaactcaagccattggattttttgcgctccacacaaagagtgcctatgctccgtatccttaaaatggtgctaatgtaatgttctggtcataatcattatcatccaaaacttccttgactggaactaggtacttggaggagtcattgaagatcttaattaggcacagtggatattttcatgaagatgtcaggctccaggcaattatttctttaaaacgtaatttcttacctggtcctctttaatgtgaaagtatgcagcagatgtttaatttctttgtttctgtaatgcccgcattattaaagttccattgtcaggtttagtgaatacaaacatacaaataactttatttcattgtaaaattgtaataggtagtttaaccttcaactccatataactatatcaaatgaagtgtgttaaaaacatacaccataaaaactatcactcaaagtgcaagttgaaagggggcagatatataacataattctccttaaaaccataaatctcaagatccattcatgaaagttttgattttatttatttattttgtgcctgtcataatttgatatctcattgaggtctgatggaaacatggaatactatatcatactgctactgcaatctgtgagtgcacaatatatagaaacaaaaattatacaaaaatgagttatggcagtgtggtctccagtatattttcactatgaatctagattgtatagccttaattaacttgaatcagttggttttctgaacttcaagctggtaaaagctagaacttagaagcttctttgatgttgttcaattgaagaattgatacttcgtggctattattaattcaagtggttgactattattgcagatatcctaactgcaataagagcaatacctcctgcacatgctgtgagtacttgtcttaaagaggcttgtattattccctctcattataccgatcattatgaaacatcaaaactctgatgcaaaatattcttttctaccatgcaggatgtattagagaagcagaaggatattcttggtagatgctaatatagcatgctatgtttttattttaagtcaattttgtcctgcatattgaaacaatactctatttctttccatttgcagatacagtaatgaacatttatatcaagaccatgagagaggatgatgacaaagaagtagttgctcaagcttgcacgagcttagcagacatcgtgagggattgtggatttgccataattgaaccttgtaagctgaacttatttaaagttggtatcctgtgaatgtttagggatgtgtgcctaaaatgtctctctgatgttgaaatttcagatattacacgacttgctgatgcaacactcattcttttgcgtcaagaatcttgttgccagcaagtagagtcggatggtgaagacgacggtgatattgatcatgatgaagtgctgatggatgcagtttcagatcttttgcccgcctttgcaaaagtgatgggatcttattttgatcctatctttacaaaattgtttgattcattgatgaaatttgctgtgagtaaactctacacatacacacaatctgaaacctatagaagtttctgagttactttagttaacaaatttctttctggtatgagtgcagaaatctcctcatcctccccaagataagactatggttgttgccactttagctgaggtcgctcagggaatgggagctccaatctctgcttatgttgatgtatgcttttatgttcttgaaaatcacttccttttcccatttttatgtccacttagtgctttgtcacatttgcatttacagaagataatgcccttggtgttgaaagaacttgcatcatctgaggcgacaaacaggagaaatgctgctttctgtgttggtgagatgtgcaagaatgggggtgctgcagcactgaagtacgtattcaaccacaagctgaaaatgtctctttctcgtaacaaacttttcgaatactattttcagaaggaaacatttttccttctataaggaagagtttagcatgaaacaagtttgaaagagggtcccttctttgtgcataccagaagtagtcttttaaaaaaatctgcaaacatcgaaatttgtttgcacatggatcttttgcaactgatgcttgcaaaggtttaatatttgtgaaagaataattttgcaccaaatacaattagatagtagcttttgaaggtaaggaaaactagtccaaataagatcaaggtatggggttggggatttcataatttggaaggcagagcataaatatgatctttggaatggtttaaaatctgaaaagaacagagaggacttttcagagagtgaaaaggctgaatataaaattactatttaatagcaatgaggggcaaattgggatgggatgtctctcaattaaatgctcagaagaaacttctttttttctgaggaggggttttcaggaagctttggataagggattttagaacactaactgtgggtgcaaggtgcaagggattttatgtcttgcttgaaactcctatctagtgccgtttctaggtatacttgatagttccaagtaggggtgttcaacaacagtttaaggcggtttagctggttaacccagcccagcacaaggttgtccggtttaggtggcttggtttcacgggttaaactgtttccccaatgcgagaaaaaagcagatcgagataatcaggcacattggcaagaaacaggcatggcattcgttccttgtgaggtcggcagcaccagatttcatggcggaactgcccaagaagcacggggaggcagagctaagttgcataaatcacgttgatgactgagtcgtcgaccacgcagtgacgcagctggccgcagagacgtggcgtgtcgagcactagatgaattgccgtttgccagggtatgttgccatgggcatggccatggccgacgcggggacgcagccgcagcataggcccatcgaagggttggggtcatggccgccgttggtgtttgtcaagtgcatggggatgcagccgccagggtgctcgtcgtgggcgggcgcacagtcgccggtgacctcgccgcatggggggcgataactggtgggggactcatcgcggcctcacgggtaaggggcacagccgtccgggggcttggccgccacctgagatggccctgctggagaaggaggcgactcatgggttgaacggggtggagtaaaccgaaccaaaccatgtacacaagcaaaagtgggttgtgttagtttgattcggtgggttcacgggttcgagcccaagattttggcacttcacaagtccaaatgctgcttatcccattttgcccccatggtttatatgcatttccttgtgatgtgtgtaatacttgatgacacaatcagatggagttaattattacggtgtatttatcagtcccctgtcagtgactagggtactctggatccattttttctttcatagtccaacttggacaactgtattttcaaaattctgctcgaaagaccaagaaatcaagctattgtttcttccagtgataatatgccaagagcattatccttaaactgaacccacctcgtcaactgaattgctaatgtatgtgactaagaattctgaagcgtactgaatagtctgctgtctagttgataatgaattggttttaacattgcattgctctttctatggagcttagagtgacttcccatgctgtaaattcagttcattgtttttgttaacgtgtactgtttgctggttcttattcatctttgtgcagatactacggggatatactccatggtctgcatcgtttgtttgctgattctgaacctgatgacgcagttagagataatgctgccggtgccattgctaggatgataatggtgcagcctcagtcaattccactcaaccaggttggcactctgcagtacataatattttgcataatttcagatttcaaacttcagagtgctggtctaatacgcattctgtgcttgattcttaggtacttccggtgtttatcaaagctttgccgctaaaagaagatcatgaagaatccatggttgtctatagctgtgtctgtaatttattattatcttcacatcctcaggtgattcttgttttaacctaccatttttcattcttggctttgctaatcatgtgagcaaagcccatgctcttttcatggattaaacatagccttttactgttgcagatccttcctctagtccctgatgtgataaatgcctttgcccaagtggtagtctccccaaatgagagtgatgaagtcaaaacagtagttgccaaggccgtttctcatttgatatctgtttatggtcagcaaatgcaacctatattgagtgctctgccacccgctcatgctaatgcattagcatcatttgccaataggagatgatcagcagaggaacatctatattcagttctttggcctactgggatgctttgtcagtggtttttactcactgaagaccatttgatttgccagatatttatagatctgccaaaaaccggtttggacatcttcattgggatatgaaagtggatgcaaatgctggaaaatgtgccagcagagttgtttgcgtcgtgattatgcgatatatttctgccttttgagttatagtgatcttttgttgggatggcttgtgcggtggttctggttgaaggaaatggccagcggtgagcttttgttggtcatcatcctggtttcgattttggttgcttgtgttgagtttacaattctttgctcgggtgtactaccattgctactattgtatataaacatatttctccatagaggtgtaattcttttgttctgaaagggagataattgtgatttttggaacctggttccttgtacagttgtacttagcatcagtggtggagccacttccttgtctaggggtggctgcccggcacgacacctacgtgtgccgtcgtttgttgcccaaaattcctggctgattgagaagccacttcgctgcctgagctccacgattacctttgctccgccgctgcttagcacgcataagcttaaatagtgcacacgcgataagattgccctgttttttcaggctgaaaggctggaggaatatacttgccctatcatttgagagaatttgaaggaggaaaaagaaaggcatcaaaatttcgagggggattgcctgattgaactagcgacgagaaccgattcaatcttttcgaaggaatacgatgttaacacaaaaccaaacgcccataccattattatgcccggggaaggatcataagcactagtgccctctgtaatatcatcgtcatatcattattgtgtcggggaaggatgataggctcaagtggccagtaatatctgcaaatatgttttttttcccacttactagcttaatgatatcagcatttggtcaatccggttcagggagaacttctgtttcttcttgacgaaggatttagcagggaccatgagtccatgactgtccctgcccgtgacgcacgttttgctctctccttttcgcgagtacttttggattaagatcagcaaaggcaattagctaaagccccgagcaactcacaaaacgtcccatcgattaatcaaatcattggctctgcaagcagcttttaaccaagaacaacaacacttgcaggttgcagctggctggatcataccgcacaacgtaaacactagccctctacccttttctgtaacataaatcagcttagagcaagtttaacagtatagccaactgctggtttcaaatcatctatagttaatctaatagtcaattcatataatagttaactataaaaatatattacaccattaatatccggtcccacctatcatacacacataacgtcttagaatccgtgttgtagctagctacaaatatatagcctgctttcttctctcttttttttcttctcgatacgtggttatagctggtttatagcatgctattgtaactgctcttaagttattttcctatctgtgctctgctgggtggccacgtagtccgtacgcgagcgtcaatcgcgaggcggggatcgatcggacggcggaggagggaggccagcccggggttgacacgtccaggggtagacagcagtggtacgtcgcgggggccggcacgatctcggcccggatcgcggccacctgctcgcccactacctcccaaaggctaggggcaccgccatttttggcatcccaacccggccgcgtcgccggccgctccacgcatgtgcgcgcgcgcgcgcggccggtgccttgcttcccccacgctaaactagctagcatttccctctcgtcccattggctgagtaagctactgcctagccgcatggatcatttggtacgcgtgctcagggactgatctgctatgggaacagagggggctcgagcggactatgatagtctcactgagcctcttctatgcatattgccagtgcgttgaaataataataataataataataataataataataataataataataataatattattattattattattattattattattattattattattttccgcatatatcgcccctcagtttatgtatatatttgctattaacatatacattgtcctattttcttctcacataaaataggaatttggtggtaggggtgattgacatgtaggtctatttctattaaagaaaaatgtagaaagttggtggtgcgggtggtggcaaattcgccattcatcaccaccatcactgttcccttttaaaactaaactagtatagaaatttaaaggatagaaggttgatgttttatgtaatttgttcaactcatctgttattttttttctagatccgtttcagcgcttgctagctagctagctttgaagttgtggcttactagcattgctaggtaagagtattactactagctataggtaggtatagtagtagacagtatatagtaatagtagggagggttacgtatttacgtattcctttcttggtgctttgcgtgccacgttggacggtatgcttctagctactgcacactttgtcgttctctcgtacgacgctgtatctcgccttttgctacggtccttttagtttctttctttctttgggggtaaagaactgatcggatcaacatattactttgtactttacagcctaaaaactacgacgacttgatggtattgtatctaatccaactccggcacagctagctaggttcctttttactcgctagcatgaaccgcgcaacgctaattacatgtgaacacagtgacatatagctattcataacagaatgacagaatcatacccctgcaggtcgttccctttttcgtgaccagcttgcccatgctggtacgctccacgccactacactatacacaggctctgaactaattctgaccatgcatggagatgtcaaatagatctctgataccgatcaaacctaatgtccacggggtattcgatcgtacatgtcctagtccacaagttcgacccagcagccatatatgtgccgtcacagtgaaatattccaaactatgacatgcgtggtacgtacgaacatattgtgtaacgtgctatcattgtacgaacaaacaagtgcaattctagctttgtacgtcttctctgtcttactcaattttttttatctaaaattctaggagaatgtgtttaggaatgtaagcgggcaatctcactatccatacaaaaccagtttactagtcttttttcacatgatagtataaaattttgaagaaaaaaaactagtagtagaataaacgggcaaaaagacttgcttgccggtcccacctacatccctattacatatgtatcctttatataattttaggtaaaaatgttaaaaattcaacccaccctattttaggctcggtcctcgaattttgaaactaacaagtacggagtaggtttgtaggttcattaccactcctagcagagagcaattatagctaagcatgcagagcaatggagatgagaagagagggatatgaaacaaaagctatgagatctagatgatttttttccctcgtaaattacttattccatctatcatcagattataacgttacattagttatgataatttttttttcaaaaagatttcatgtaattatattctaacggcagacatgtatatatttcgactgttgaaatttgatgttttgtatgcgatagcaaattgtttcaacatgcattttagtttgctttacaaaggcaaatattgcaatgactatttttttcaccatggtataactccatgtttcaactatggtcaactatagcgttggaccgcccgaattttcacgatcgatatgtatccgaaattttggcttactctccatctccatttgtattacaagagtctgtaacttacaataagctacatttggtgtttatcttacaatggcgtaatttatccgtctgctacaaaactgatcgacaacggcaaccttgcggacctactacttctgtttttaaataaatctgacttttatacgtaaatttgaatataatatgtttaaaagttcatttaggttaggacggatggagtatatgagtagctatacatgagagtagaacgatcgatggatcactgcttttggtagctagctgtagcggatagatgatggcagtagtacgattttgacagaagcagatgcgatggccccaggatcgggcctgtcctggtaatggcacgcaagattcgatggctttcaatccaagagggattctgatggcacctgccttggatttctttccggtcctcttgctgtgcaccagcaccgctgcgctagagatagggaatccatccacacgatcaagcgatcgatctcacctttttcccttttttttttctcaaacaatgtacagtgaaaaacaaagcagtagcaaccaaattcaccggtcaccacacgtccacacatgcccacagtacttctcttttcacacaaacaccagcaccacacagcaaactatactagcatagcaatgcaattccttttaattatcagagggaacaggaacactatgctaggtgaatatatattactgtggaaatctgaacatatatgcttgttgagcacatatcaggtgggagtgagaacagaaatgcatatatgcttgctctgttagctagcgttgtcatgcttaacaagctgtaagctcgaccatcagctggcttaggcctgaagagaccaatgctgctacgtctaagtgatcatattcttccagtagagctgaaggggacgtgaatacgactcgtgcatgctcggaatacggtacacttcgacgaacgatcactcactcactccacttccgtttgttcgctcgtctcccatcccttgctagtgtttgggctttggaggcgacacttggcgagatagctgccccacgcatcactgaacgctcctccaagaaacgtcctctgatctgcatgcccggatgatgttggttgggaatgcaaattgtggatcgctctgcgcctgtgattcctgtatatgcgcaagaaaaagtggtccaattattgtaactgctcggtgaaaggtatactaggtcatttctcctacaagaaccatcaataccagaacaaattggagcctaacaagtgtaggaagaatccactgtccatatatgttttttcaaataagtgagtgaaaaaaaattgaaatctctacatagaaaagtttgttcgttaagaaaaactccaaagctacacactttctttcgtgccgtgtaactgtcaaagctgttgtggactaccactcggcctatctgacaacaacctttttgttttcagactcctcgtacgtacattaagctttcacatctctcgggggtaaaaattctcctaattgttcagaagaaatgtacggaggatactaaacatgacgttgaacttatcaaaagctaccgcagtaccgctcgtggcacttcagatatctggtcggtgctgctttaggcccatcaatccatttttcgtggaaaaaagaattaacaggagttttagctgcaatttacatgcttctttctaaaataaattcattttctaggggccttttgatttggaggaaaaatataagaattttagaagattcaattctataggaaaattttctataaagatttttgaaacaaatgattgaatcctatcctacattgaaattcctatggaatgattgataaatcctataaagattttggagaaaatttagcaagagctcgaacctcttgaaaattttcttttgagtctatctctctcatattttttttcctactatccaatcaaacagtcatttccgtgttttgtaattctatgttttgcacttatattcctaacataatactgtgtttttctattcctatttttccattccgacgatttaaggagagcccttagcctctataatttatcccaaaataagttccattttacttccttacataatcctagcacgaggagttgtatttttttaataccctttatatctacccttccagtaatactattttcttatgaataagaagtattatgatcttttacccttctattctaatctcaactccgctggttagaaatgaagttatttagagaagggaatatatatattatctatcataagaaagagggttaaaaggagctatatatgatgttcgctatgaagattattgtgtacggtgttaattcagaatgagaaaattaaacaagcaccatttcatcgtggcgagtaatccatattatcagtatagattgcacggtatatttgtatattaaattgattttatttatgaagcataagtgttgttatcaaatttaagagtaaattttactttgggtcaccttttactactggtgttttgctttggaccaccctttaactaatattttcactttgaaccgaaaaatcttacttttgtgtcactttggagcacactcaaatcttttatctatctacgtcaaacttgtcatctgtcaaataaattgccgggtataaagtggtgggagttcatcgatgaatcggagccggcgtactcgaaatcgttcatatgcttgagaagagagttagggtagtccaaaacgcaacaaatgtaagattatctgatccaaagtgaatacgttgattaaaaggtggtcgaaagcaaaacaccggtaataaaaagtggtccaaaataaaatttactccaaatttaatttaattttaaagtccagctccaataaaattgattgtatttatgaaacataagggcatgctcagtggtagattctagtataaggtctcagacacttgatatgactaaggatgtaaccattaactaaaaatattttttattactattcttttttaaccattatgtaattgtgttcacattttatattttttacagaggctgagtctatattgagctattgttaaccatagtacactattttatctctcctctttctatctctcctatgtcagaaaatattcctaattaataaggttattaaaagttttctatcatagtacatgccttgacagtaaagaatggcgatatggcaaatgaaacagtaggcaagtccccgagaaaagagcggcgtcacctcccgcttaacatcctgacgttgccatgctacatgcgcaaatgcgcgccaattcttcatggccctctccagcgctgacacgtccacccctgcaaacgttacattccgccgtatatacaacactacgctacccacatgaagcaacagagcatcaacggctttccctcccacgatcccataaaaatccacagatgcgccggtgcgcagcaaaggcgagcagatcccgctgccgcttccgggctgacggtgcgccgcgcgcatatcgcgatccgctcgtaaccgccgatgtaaatgtttgggtcgcacaggtggggtttgacgagcggcgagagcaacgggcgcatgcagattacggcaacatgccccgttttacagagccctctgctctagtagtgttactgggatcggcaaagtttctttgcccaacacggggagtggggagtgggcgcaatcggcgactgtccctgtcagcagcgctttttgccgtaccgttttgggcagcgagatggaaagagcagaggcgtactactctgcatggggccatgggggggggggggggggtatgtgtcgaacgaacacgagctatcaatcagtcgaaatgtgaaaaattttgagctacgaaggaccgagcagagcaccgcgcgacggctgcccggctgggcgggccgtcgtgtggcgcgcgcgcgcatggacgagcggcaccggggcgaggcacgtcgcgcgatgcgggacacgattcccctgcgcggctgtgggcgcgagatgtcgggacccgagccgagcgcccgggccgggcgcgtgtacgtgcaatccgatcggcagagaccggaaaattttaagcagcgccgcaggcctcagagcgcgcagtggtgggctggtggcgcttttagccgtgccagcgcgaccacaccccccaccaaactccctgtcctaagtttgtgtcctcgttgtccgtgactcccgtcccatctgtgtcactcgcggcgcgccgacgtgtcgtcgtctcggcgaggcacgccacggacctgccgccgtcgaacccgcggatgcacagcacaaacgctagtagctcgtcatcgaggatataggcgccatgcatgcattgcggtcacgcgttcgccgggggatcgatcgcaattggcgtcgcgctgcgtgtggccgtgtgggaactgggacgggaccgggaaagatgctaatccgcgtatggtgctgtagcatttgggcggttgggccctctcctcgccctgttctgcgcgctaatcgggcatttgtcctgcatgcacacatcgtgaagagacacggagagggacgctttatgtgtgatcagatcaccgaaactctggaagggtgcagcttgcaacttgtgccatggatcagagcatcttgattcttgatttgaggaagaaaataattttgggcggaataatggcattgcaaaaagccgaacagcgtgcaacttttgcatgatcagtagtcttgtccagaccaaaaaaaaggaggtgtgattattttggaatttgggttggatatttccatagttattacctccaacataatgggaaaaacgttgaacctagcgatgctctaacgtagtgtatctgtgtatgcgcaattgcgcatgcacagcacagggtacggccgtactgcatgaacttccaagattggattttaaagaaggaaaaatgtaaagggtcaccgacacagtaagcataataagctcttggaacttgcaagcatctcgaccatacgccttctgttcgaagtcagaaaacgcagctaagcattttggtgcttttcttttatgttttctttttctttcttcactgtagcatgtatgacatttcttgtatagttgtatataaatatcatgtaaagccatcacatcatatttgaatagcaatatatgctacaatgataactctaataatttgtatcttgtcggtcaaaagaaatccatacaacataggcctggtttagttactaaatttttttctcaaaaacatcacatcgaatctttggacacatgtatggagcattaaatatagataaaatcaaaaactaatttaacagtttgcatggaaatcatgagacaaatttttttgagcctaattagtccatgattaaccataagtgatacagtaacccacgtatggaaatgatggattaattaggcttaataaattcgtttcacggtttccaggtaagttatggaattagttttttcattcgtgtccgaaaaccccttccgacatccggtcaaatgtccgatgtgacacccaaaaattttcttttcgcgaactaaacacggcgatactcgacaggatcaacctctcaatagttattttaataagtaatagaagtaaatctcaaactctatactaattttttttgttgtgtgtccacggacagagaccagagatgtaggggatgtttggttgcttactaactttgccaaaccacatattaggtaaggtgtggctgccacaaaatgtgtggctagcaaaatgctagccacaatttagctaaagttagccaaacatacaagtgtatgacatgtggggccatatagagaaaaggtgtggctagccatagttgagtcatcaaccaaacgagtgactaagaaattttggcatgactcactttaggtgtggcaaattgtgacctgcaaccaaacaacccctactaatccattttcattatgttaataaaaaactctataccaaattaggatgcactactcgatcattacactgtgatcagctgaaatgcttatttcaatcaaaataaataaaaaaaaataaagacaaacaagcagatataactagcgaactagcctaaacgaatagtgtcaccactcaccatggagaacattaattactagtagcaacttagtacgacagctacacaatgaaaagttgttaaagcttctagttctgtgcttttcaacttatttgcccgattattgaaacacctctacaacaatttttttttctcacagaactttttttattagatcacttgttttaaactatttactaatttattaattttaatattaaatttatttatataatcaaattgataatccacaataataatttgctcgacaatctatgtcaaacatggctagtctctgaagcaacagactctcttgagaaatgagatgtgaagcaactcgcattgttgacagtagatagtaccaaggcaacaccttcaaaaaaagaagatccaacgaataaaatgcaaataaaatatttttccctggaaaggttaccaaagttctaaaagaatgcccagcacaatccattgttgaatccagccggaggccaaatcactagcaaaatcattcatccattactaatctctactacttaaaaaataagtggtgcttccatcgtccgtaaaaaaaaccgagcgaaaaaaccaagcgaaaaaagtccgataaaaaaacggagtgaataaaaaatcgggagaaaacaatgtccgatcaaaaacggagcgaaaaaaaaactgtccgacccaaaaattacgaaccgggcgaaaaaaacatgcgaaaaaaacgagcgaaaaaaacccggtgaaaaaaagtccaatccaaaaaattcggaggaaaaaaacgggagaaaaaaatgtccgctccaaaaaatacggggcaaaaaaaaacgaaaagagacagtaaaaaaagggcgaaaaaaattatccaattccgaattatatgtgacacggtaaaaaaatcgaccgggcgtaaaaaaatgcagcgaaaaaaaacaaatctgtccgataaaaaaaaggaaaaaagggaagaaaaatcgaaacgaacccgactccgttgacacggtaaaaaaagggcgaaaaaaataaataaaatgtctgattccaaagaaaaaagaattatatgtgacgcggtaaaaaaatcaaatcctattatatctagaaaggtccgacactataataaagtagtaaaaaaaccgttcgtaaaaaaatgcatgagaaaaaaattaaaatggcagaaaaaagcgcggcggaaaaagtctaatttctattcgtcgttttagtagttcgtttatatctcttctttatctctaatctaatctaatctaactatttaaacagagaagtttctaccgtatattaaaaaaagatgcatgagaaaataaaaacggtttaaaaaaacacgtgaggaaaaaatatcagaaaaaagcgcaaaagaaaacgcgctagaaaaaaagttccatagtccgaaaaaaaacacgcgagaaaaaaatatttccatcgtctgtaaagaaagcaaaaaaaaaaaagcatacgaggaaaaaaactgttaagaaaaaacactaaattgataattgatagacacctggttggataggctccatccacttttttccatctcctacatgacttttgtttcgtcatctattctcatatagtggagaccctgcacatatttgtagacaattatcatactatttttatgaagtataactattattcttgataacatattatatggaaataatcttagaaaataaatatattctaattgttatttagagaagagtgcatagtgactctattttgtgtagacttgaccatacgaggcagtgtaggatttgattggttgcaagaatgagattaaaagaacattttagattatatgcatattgttatatgaataattcaattattttaggtaaagcaaacatcataaagttgtcatcatcaaggttgggctattacatttaagatgttccaattttttgattttctaattgtcatcgacatggttatgcatgaaaaacgtatattatcattatgttttttcacccattgcaacgcacgggcatgtttgctagtaacgcacgggcatgtttgctagtaagtattaaaatatgagcttgcttgttacaggtacacttgagaagtaatgttttttatttatatactagatgatatacttcatacgatgctgcgggagtttggtcagcttaacttttgatgacttggtctcacctgtgagtttttttaagaataattctagttagtaattaagttgtaattatgtcgaatagaggatatatcctacataccagttcttctaatcattacaattcttattgatttttatgatcaatgagcaggctacatatctcttatgtaagataggatcgttgcgttctttgtgatcaatgcgagaaaacaattgatcatgcgagaaataatcgggtcttcaaccagaagagcagaacatgggcggagattataagggttatgatgggtgatgcagagctttggcggctggctatagccgcaatccctcttatggtagtccctgtgaatggagaagggtcaccaaatttatttggagattaggcttttttttttcgttttccctcttgtatcttgttctctttgtttttttacccgctttgtacatacatttattccttcttaatacaatgatgcgccgcgtattaaaaaaagataattctcctcatcacccacttttgaatcctaatcctagtgggcacatcttaaaactagatgctttgtaccatcataaacgctcctaactagtataattttatttatatattttgtattcgtccggaactatatgttgtactatacgtgatttatatttttatcttataaaacatagttaaccgtggcattcatcctagacttacaacgatacattgcatcgtgtgtcctactgattatactttctgttttactatttggttgtgtctgtctcagcttttattattattatttttgtgtctgtctcagcttatagctaacatatatacaactgtaaaaggcagaacattaagtttattattattcattctttctatcaccatcgaagcaagcagcaacttaaaaacattttgctgtcaaggacgtactcgtgtgtaaattagtgaccttcacttgcgaagtcattgtgcttacgcgtcatacatcattccatccggtttgcatccttgtgcttgttccaacaaaaatccaaagaactaagtcattttcaacgaaaagaacatcgcggcgattcagacgaaattcatctactacgttacaatggttcaacttagacctgtggctgtgtacaaaactgagtttgcaataagacaaaatatagtgtaagcactaaaatatattccatgagaaaaaaaaagggggaggtgggtatcttttctaatagtagttttgtttattccctaatctttagccgtaggacaacaattccagaactgctacgctatgcacatctctatcacgattcttttcttcgattaaaaacatttctttttaactgctttgctaaaattatgtcgacatatttctggactaaatacagtcaaatacagtcagtttgacgatctgccatctaatcttcttcatgattcgtgcaaagtacatctgataagctgatcgaacaacttgctcctaagttcgcgactcctttttgctttgcatgacacgtgtttgtcatcaactaatgtaattactctatttacacagtaattacacatgtataatttaggacttagatatataattttggtacttacattgtaaatacactaaaattac

SEQ ID NO: 64814 - DNA, 4071 bp, Oryza sativa
  unsure (1)..(4071): unsure at all n locations
cattaaaagtaaacaaacatgtagagcttaattttatatgaattttgcaagttgagtggcccaattcagagttcgaatgaattagatatgaattttagaagttttgagccatttaaatgaatttctagaattattatttatttattgcgcaattataaattattttctcagaggaaaagggggatgctgacgtcatcaaaggggccggcgctgacaggcgggccccatgcgtcagcgggccaaggggagggtgcacggtggaccacgtccaccgcggcctcgggcgcgccgtggaccaggaccacgccggcccacgggcggccacagggcaaggcgggcgcggccgagaccggccggccgagcggcgacggcggcctagccggatggccaccggcggcggcggcgcaacgcgggcgaccagcgaaggggagatagagggagagggagggatgctcaccaagctcgcgcaacggcgaggagacaacgggaacgcggcggcgatggactcctcggggaggcacggcaacggcgggactccggcgacgtccggcgaaggaggagcggctggggcacaacacagtctgggagagaggatagaggggttaggaagggaggaggaggcgcggtaccgaggggaattgcggccggaggcggcaatggcggaggtggctcgggtacgtggtgaaggggtggtttcggtggtggcgaggagaaaggaagcggtggccgggcttgggattgctgcggtgaagccggtggtgacggtgacacagtgcggcggcggttccagccacggggaacgacggccggagctcgcaaaggcgatggcggctcgggttgacagagggcagggcggctcggtgggggattggaggaacgagacggtggccggtgctcggcttggagcggtgaagccgatggcgcaagcggagcgccgcggcgacggccaggncgccggtggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataggccccggagagggagatcgtggccgaggtgggcggcaaccgccggcggagggagctccggcgacgtgggcgagtgaggctcgaacggcgccgatttttggggaaaataggggagaacgtggaggaaggggaggacgtggggtggaccacgtccacacgcgcgcgggagcggggagacgcgcggaggaggcggcgtcgtggggcggctcgggcgtccatggcggcggttggagccggaggaaggggatgggcctgacgggtggggccgtgggtcccacctatcagccaaaggaagagaggggaagccgggtgggggttttctggactttgggggagaggggagccgagctggccgagcggcccaaagaggagaggggagggaggcggcccggccggaggggaaaggaggaaggaggggaatgggccgaaagcggcccaaagggagaagagggaattttatttgcttttctttttaattaattgattacatgatctttgtgctattaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgcaggaaaaatagtactctattttctgggggaaaaagtacaccgaaggtccctcaacttgtcatcgagttacaaaatcgtcccgcaaaaccagttatccagcgtccctcatctatcaaaaccggttacaataggtccttcggtgtgtttgaccccggttttgacttacgtgacggctgagtcagcgtgggacctacgtgggccccacatgtcatgctgccacatcaccctcctctctctctcttttcccctcttatctcccttcctcatctctctctctcccttctctgacagccgccggtgggaggatgagggtgtcggcggccggcgaggggcgacgcggcggcagtgatgacggcgacgagcgacgcggcggcgatgggggagaaactgcaagtgggcggcgaggaggagcggcgcgcgggcggcgaggatcagcgcgcgggctcccccgccagccgccgcccaccgcccacgaggcccacgaggcagaggaggaggcggcgagcggcacggcggcgacgacacggcaaattacagaggatatcaccaaggtccatataaacaagataatcaccaggcaaattactgctgctgctgctacttcaccatttgtgcatttcctcttctactatcttagctgcagctcgcacgctttgagtacgtgcattgttcaactgccatttctctcctcaattcaaaaaaaatatattcacctttttctcattcgagctaaaccatttcgatcaatggaattcggacgatctccagcccttctactcctcgttggtaagtccgagaaactttcaggccggttaactttaggctgttagcacacatcttcttcattcttcaacaatggcgtgtctcaatgcagggttcctatggtcacagctgcagttcggcgctgaggcagccggcacgacggtcttcacgctgtgcaacaactgcacctacaccgtctggccgaccaccttgtccggaaacacagcggtcgggggccatcgggggcggcgacttcaagctatcgcccggcgccaacgtctcattcccagccccggatggttggtccgaccgcttatgggcgcgcacggactgtgcaccctccggcaccgcgtcccttgcctgcgccacggggtacttcggcggcgccgtgagctgctccctcggcggcgcgccgcccgtcaccctcgccgagttcacgctgggcggcgccgacgggaaggacttctacgacgtgagcctcgtgggcggcggccgacgggggagtccgcgcgccgctcctccccccgccgcacgcgctctgctcctcgccgcccctccccgccgcccacccgcagcttctccccccaccgctgccgcgtcgcccctcgccggccgccaacgccctcctcctcccgccggctgagtcagagaagggagagagagatgaggagagagacaagagtggaaaagagagggagagaggaggctgatgtggcagcttgacatgtggggcccacgtgggtcccacgctgactcagctaccatctaggacaaaaccagggtcaaaactaccaaaagacctattgtagttttaatagttgagggaccttcagtgtactttttccattttctgggtcactcagcgagaatgaaagcccacctaattggtcaggctggtctctttcctttcatccgatcagtcacgcggccgttgccaacttgccgtccacgagagcaagcaaagcaacttc

SEQ ID NO: 64815 - DNA, 22702 bp, Oryza sativa
acataaccacatgtaatttcataataccacaccattaactttttgtctttgatatatcatgcatatgagttctaaacttatatctgaaatatatgagtttttttaattcactgtataaatgttgtagtaatctaagggcctgttcactttgatgttattttcaaccttaccaaattttggtaaagttgccaaaaaagtggctacatttagtttgctgtcaaattttgttaactatataagaaatcctgccaaaattttggcaagttgccaaaatttggtaaggtttttttttcatcaaagtgaacaggccctaagtgaattattttttattttgctacagtactaaaatagattggttaacattgtagtggaataatctcaccatgtgctagagaagttctacaacaaaacaactccagatctcttccttgtagaacagattttcttgccgtttataaactactcccctgaatgaatcttgacggcaaattgtgttggaaatggtgaggaaatccaacacaaattgtgttgccgaatttctagcaaaaaccgttgaaaaaaaattcatcttttggcaaagtgttttcataagatcatacttcctctatttcatattataagtagttttgttttttttctaatcaaatttattttagtttaataaaatttatagaaaaatttaacatctaaaacacaaaattagtttcattaaatctagcatcaaatatattttgataatatgttgaaaatgttattatatttttctataaacttagtcaaccttaaataagtatttaagtttgattaggaaaaaaattaaaatgacttataatatgaaattgagaaaattcatattctaaatacacttttgttattttcgaactataaactcttaggtgctgatgcttagttacaacttacaacaacccactaattcttaatttcgagttcaataagtaactaaatatgccagtcagaaattcattttacaaatttaatggtatggaaaacattttaaaaccattaatttcggtcacgttttgttccatctcatcatgtatgatgtattataccgaattttttagatgtaagcacatgcaatccagtaattacaaaaataagcacgcaacaaccacatttagatgtataggcaagatgctcacatgaagcacggtgcttccattgaaccacttgaccaacagactaatgggccgctgaattaagaacgttagcgcaagaacccacatcaccaattggttaaatgcatcattacgggagcatgcatggtttaattgtgttgtttttattttacaactcattgtagcatatgtatttcttacattattttttttaaaaagaaaacatatacattattttttaaaaaaagaaaacatatatatgttttcttttttaaaaaaataatgtaagaaatacatatgctacaatgtgagctatgataccaaaactattgctattagagcaagttcaatagtatagcccactactagctccaattcatgtatagccaatctaatagccaattcatataatactacctccatattttaatgtatgacgctgttgactttttgtttaacgtttgaccattcgccttattcaaaaaatttatgtaattatcatttcttttattatggcttgattcatcgtcaaatgttctttaagcataacataaatattttcatatttgcacaaaaattttgaataaaacgaatggtcaaacgttggttaaaaaatcaacggtgtcatatattaaaatacggagggagtaattgcttattatactattaatatatggtcacacctgtaatacacacattgtgtcttgaagtccatgctacagctgactataaatctgtagctcactgcttttctctctcatcgtttatctcattaaaatatgtttatagctagctaatagcctgctattgtacctgctcttagctgaagaaaaagaagaggattaatactattgggctgctcgcacgttaatgctagaaacaagaccggctgcaaaaccccccatatacttcgttaggtcctcttggtcaacccgatattgacagtggtcaagtacttgtgcgaaggttggttagaattagaattccaaacaatgcgtgctcacatatgtaattattgggctgcgtgtgtttagatataaaaaaaatcggtattatatcgaacaaagataaaaactacattgtgatttcgttaccttattgatcgttgcctccacgcatgatgtcataattgttgtcaaacatgatattagtataagcaaaattacttttcttggattttgtcgaacgataatagtgggtgatataatattgtcttggccaaaaaaaaaactatgtagttctacatcttgggccgcgcaacatggcccagcccattccgtggggcagactgcgaaggacgccgcctcccattccgtggtgctctggaaagtcgaggcgcgacgccggcgacgtgagcgccattggaggtcggcggcgagttcttcaccggcagattctgctcgcgactccttccttgcactgcgatctcaattcttgcttacttgcgctgttgattcatatggcttcttttggtcttctgctcttgtgcagtttccacgcgcaccacctgttcgacgaaacgccactgcgtgatcggccgccatggagggtcgtcctgggaggcgcaggcgcaggagggtcaaggccccgacgcgcgctgccggcatggactggatcagcggcctccccgacgaaatcctccaccacatcatgtccttcctgaacgcgcgccaggccgtgcagacgtgcgtgctgtcccggcggtggagcgatctctggcgcaccgtgccctgcatcaacgccgacttcaatgagtttgatttcattgattaccaaggggacgatgaggactacaacgacgaggtggcgttcaagaggttcgttaaccggatgttggagctccgcgatcctgccaccatgatggacaaattctggctcaagtacaaaatatcagacgggtacaatgaatacaaggattccaatgtagatgccaacaggtggattagccatgctttgcaaaagcaggccagggttatggaggttgtcgtgttctcctttccattggagctcgatcactcggtgttcacttcatgctacctgagaaaaattgggttctcctgtgtttctttacaccaaggtttcttcaagcaacttgacgccggctgtccagaattggaagaactcttcttacatgattgcactattgcggatgaggagatcttctcccagtcactgaaggttttgacaatcgacgacactgaattctccaaggcgaacaaggcatatatttctattccaagtgttacttctctcaccttgtctagtcctgagaattccacacctatgctaaaggacatggcattactaacgaccacatcagtatcagttaaattttatacattcagttatggttttgatgctaatgatctccgccagtgtctctggagcctttctggtgttacaaacttggagttgaattatgagggtacagaggtatggttatttgtattacttagtgtatccatccaccttgatttaggtatcaatatgaaaaaattgaaacttaagcttttcttctcgtcatttcataattgcaatggtttagtagcctgaacctgtaaaactaacatcgcatagctaattcatatgttgtgaaaccatgatgtattgataatatgatggatgttatcaacacttgatgcaatctagttcatgtactccggtcatttgtgcattattcaactagccctgaagtttcttagttcgaagtttgatctaaaaatgaaacatgatcatttctcatgtaggactttacatgttctagtctagatgcaatatcagggttgccaactgaatgcattttgtccaatatctgacagactattttactttagttgtactttttgaaagagagggttattggtgattgtatgtcctacacctgccccaaggccagattttttatggctgcaaatacatgtgcatgctatttgtaagatagtgaaagaaaaatattgatttgtataggctgtcattttcgattgtccaatctttcatgtaatctttatatttcaggattaattgtatattgcattttacattttagacagtatacttggttgggatgtgtaatgtgttgggtgttacaacacacagacattatgctagcataattttaatgttaggagtcattaaaagacaacatacaaacagaaaattcttctggggaattgttgaatgtcctactgcttcctgatgatatatttgtgttgttttttttactggttttggacttccatggaaaccatcctgacagtgagttgcatgtgctcgagagactcttggtgaaaacaaacaagtagaacattgtttattttggtcttttgttgacatcagttcattttctactgtgatcttttgccatccattatcttgaagctctcaatttagttgataagttttgtgattgaggaagtggtgtttttgcagctgacgttcgaaaacaatttgcaatggtgcccagaattcatcaatgttgtcaacctgactcttggtcagtggtgcctggatgcaaacttctatgcactaattgtcttccttcagaactcagcgagactagagaagttaactctgaatcttgcgaaggtaattgctttcctcaaatgtaatacagatcctactcgattgtttctatttgctcaagaggttgtgcattgggaaataacttactgtttttcgtgctacggtgcatttggaaaaaatctccaaggatcgttagcgagcttatggaaagatcatttacatgcgagcaccttaagattgttgaagtcaaatgcttggaggatgatccccaggtcatcagtgtgcaagatttctttgctagtaatggcatggcctctgttcagtttcatatcaaacactggggccaatacgaggaagaggatgagttacctgcatttgttcggtatgaggagagatgaaatgccaaaggatcttttgcatttgtttgtcatcccattgaagaatcaactcgctttctgctacattcactggctacagtagagttccgaggtcttattttgcatttttgctggtctgtagtaatggcatccaataactttgctagttttcattccactcctaatctctgattacattagcagttgttcaaccaaggacctatttatcccttgtacaacagaatttctttccattcatcaactattttttgttcagtctcttcaatttcgttttcattttacaaaaacattcttatgtccattaatttttttcccatcacgacgtgagcaagtacagatcacagcaccccaccacacaaactgctcacttaattggctttgccaagaataatgtgcaacaatcacgatcaacgaattaatcttgatggcgacgaaatccaacaatttgtgttgaggttgccacatttttagtaaaactattgaaaaaaaaatcatgagatgaaacggagggagtatttcatagcatcataagatgaaaaaaaaaacagggcagaaatttataagcgaacattagtatgatcctaaattagcgatgcatccatctatgtcgggaattcctacaccaccgccgccttcggccggcgacgacgtcacgcagctccgtgcaggtgcactccaccttcgcgaggtcctcgccggcgagcctgctcaggatctccgccgcctgcagccaggtcggccgggagcggcatgaaccgcggcggcaacacagcgtgctgttcttccagctcatgtccgccaagaggcgccggccgggccagcccgccggcgagctgcgtccagaggatgacgccgccctggtcgttggccagagcgtgcgccgtcgagtcgaggtcgccggagaggacctcgtcgttggccggttgccgacttgccgtcgccggtgaggtatccgtagaacatgcacggcaaggtttcttccgtgcccgcatagcctcagcacggcggtccctctgccggccgccaccgcgccggcgtcgatgggaatggcatcgtgcaggtgcagtggatgcattcttgtttgcgttgtcgtatagttgatgagttcgtcaatttagtttttttttaatataaaaggaaactattttcgcctctgtgattgactttgatgaagtggtcggtgagagcgaggtggaatgcccttatcatttacaaactcttttggaaattcatccacgtttaccaaatcctttcagttgatgctaccactttgagatttttatataggtatttgctagatttttcgaatgcctagaaatttgtaaattttcagtcatcttaaatattaaaaactagcatggtggcccgagcagattgcgcggctagcatcattatattttctcatataaaagcatatatattttctcattatattattcaaatatattaaaatgacaacataattttttgcaataactttacaaaactactaatgtgtaatattcatattgtattttatatacgtgttagttattaattatttttaatatcaaattttagttatttgtaaattatatatattcatatatggactctagactcgtcttttaatattttttttaattccgaattttctataaattgtatttctatatagactctatactcttcttccaatattatttatttttatttctgaatttttattatttctaattgtatttatatgtggactctaaactcatctttcaatattctttaattttttattttgaatttcagtaatttctaaattatattcctatatttactttaaactcttcttcccatgtttttcttaatttcgaattttatttatttgtaaattatatttttatacggactctaaactctacttttaattttattatgtttattccaaatattagttagttttaaattcctatatggactctatactctacttctaatattccttattttttaattccgaatttctattttttcttaattgtatttctatatggactctatactctacttctaatattccttatttttaattccaaatttctattatttcctaattgtatttccatatggactctatactctacttctaatattccttatttttaattccgaatttcagttatttcccaattgtatttctccatggactctatacacttggactctagtctcctcttctaatattccttattttttaattccgaatttcagctattttctaaattgtatttctatatggactctactttttctttttatccgattaatgtgagaatttctaggccatgagagcgaacgtggaggctcctttttctattcctttaataatataatagattgttagttcattttatcttcaacttctttgttatataccgttttagtttatttactttatcaaagttttttttttcatgtaattttataaattttatgaatttaatatttagattaattttttagtttctatttaaaagagaagggactttgtttataataagtaataggcgagtgacgatagcaaccatttgattgtcatccaaagaataacaagaggtagggtcggaaacgccatgcggcaatacagacaaactcttgttcactacggccacaacattaacaatagggagtggcgccaaagctaaattctgggagtctgcctggctccagggggtgaggcttaaagacctagcaccgttggtcttctcgacctctagaaaaaaatagaacattgcagcaggctattcaatcagatcaatggctactcaaccttaacctgccggctgaaatagcctggacaacgaaactaatagactagctcgttaatgtcttgagtgtcatccaaagtataaacctcatagataacgaggagctaggacaaaatcatgtagagtacacagcttcattggcctacaggctacaaggctcaactcctaaggcacaacaacttcaaactttaatgtgctgatctagaagccctaggcgcctaggaagtgtaagacctttgcctagctgatgatcaaaaacagagtctagacttcatataggctagcaagccaagggtagccgtctggctcaagagacagccctgcatctcctcgtgggttgcggatatacaagaagaatctggagggaattggctgtttgaatgtcatataacatgttgagccctacctaatgggaactggccacgatagtacatgaatggtgagaggcaaccggaaacataagaggagtgccaaagcaagcaattcacaccttaatgctactggtctcctgggagaattggaaagaatggaatcaaaggaccttccaacacagagagctctcgacgcctagcctactatccaagatcacagagaaagcaaaaaacttgggcccttgccggcacaagaaaactcgtggattggctaccttaggaatccctacggcatataactactttatctatatacttcgttcaatttatattataagttttttttttctaagttaaactttttcaagtttgactaaccttaaataaaacatagcaatattttcaacgtaaaacaaacataacatcaaaatatattgaacgaaaataattgtgttataaatgttgctatatattttatataaatttgattaaatttaaagaagtttaatgggaaaaaagtcaaaatgatttataatatgaacttatatactccctctttccacgtaagttacatttattacttttgtcaccaagaataaagagaaattaactcatcttacatgtaacaaaaatgaagtgtatgcacatatacaaccgataagtattaagttggctcgtcgggttctgatcaaacattcaagttacctctctatttaagttttagatgtatataaactacgaataggaacaattcatttgaaaaaactaaaatatgaaaaagttctagctcttaaggatggtgggagtaatatgaaacttagttactttcggacgaagtggatcaagctgcgttctactccctccgttccacaatataaggaattttaggtttttgcttgtaacgtttgaccactcgtcttattcaatttttttttgcaaatgtaaaaaacaaaaagttgtgcttaaagtacagtagataataaagtaagtgcaaaaaaaatctaaataagatgagtggttaaacgttgtaagaaaaactcaaaatcctttatattatgtattatgggacggagggagtatgtctattgtgctctgatgggaaataattagttggggggggggggggtgggaaacgaggaggcatccccgctttttatttcagcgccgcaaatacacagagattgttcgtcttcttcctcttcacagcccaaaccaatcgaggtttgcttcttcctttcttccaatcatcgtttcttgcatctgatctctattctctcctcgatcgccagagctgcggcgttgtcgaatcttgctgacggttgatctgctgcttgcttggtttcttggttttcccctctttgcagcttccacgcgcgccacctgttcgacgaaaggcgtctgagcgggtgctcagcgcgtcggtggccatggaagagccgcctggcaagaaaggtccggccatggaccccgcgcaagactcgggcagggactggctcagcggcctccccgagggggtcctccaccgcatcatgtcgttcctggactctcgccaggccgtgcggacgtgcgtgctctcgcggcgctggcgcgacctctggcgctccgtgccccgcgtccacgccgacatctgcgatctcatcccggacaggatcatcgacgtcgagggagagaaggccaagatggtggtgttcaacagcttcgtcaaccggctgctggagcgacgcgatcccaccgcctcaatagagacgttcttctgcagatgctgcataccagacgaagacggccatggatcggcagacgcgaacaggtggatttcctacggtttgcagaagaacgcctggtttctggaggttgtcatgctgctcaaaccattggagctcgatccctcggtgttcagttcaatctacctgagaagaattgccttcgacaatgttttcatggaccaaggtttcttcaagcaactccagatgggctgtccagcattggaacgtttcgacttagatggttgcatcgttgcggatgacgagatctcctccaacacactgaaggttttgaccttcgatactactaaattctgctatgagtacaggatatctatttctactccgacagttactactttgggcctgcgcaatactattggcggcaagcctgtactgaaggacgtggcatcactagtgagcgcatcagtggtactttattgtgtggaaaccagcgatttcgatgctaatgatctccgccactatctctggagcttttctcacgttaaagatttgattttcagttatcaggggaaaaaggtatgcttactgatcttacatattccaccttgtcttatgcatcttgacttaggtgtcaatgcgaaaaggtgaagtgtctcttcttgatacttcacaattacatgacattgtttacctgtcccctgcaaaactaactgttgctaactaaatcttatgtcgtgaaatcatgacatatcaataggataactgatgttatatcaaccactcatctaatatagttcatgtactctgtttcgtttctatataaaacaacatgttgatcacttgacctaaagcatcttagttggcagttcgatttcagaatggaactggagtatttgctgtttgatgattgacatgtgttttgtgtggctgcaatatttgggttggaaactgaaaatgcatcatgtccaaaatctgagtaatggtttaacttcaattgacattactgcatatatatttctttcctgagaggaatactacacatatatttcaaaattatgagacattcaaagtcaacaaatgaatggaaaaaatgcttcagcaatttttcagtgtcttactcctgctgctacctcctgatacatttgcctattgtgtgtcgactggcttagctagttagctactccctccgtcccattataagcgcagttgtgggtttcagtgcccaattttgaccatttgtcttatttgaaatatttttatgattagtatttttattgttattagatgataaaatatgaatagtactttatgcatgacttaatttttaaaattttttcataattttatcaaataagacgaatggtcaaatttgggtacggaaacttatggctgcacttataatgggacagaaggagtacccaacttgcatggaaaaaagcctgataaataattcacacatgctctatagactttacttgggaccaaacaagtatggcaatgtttaatttggtttttggcagtcataatatctttcttctttccttgtggtcttttactatccattatgttgaagctatattgtacctgtagtgcaaccagaatacttgtcacataatgttcatgctctcaagtttttctttggcaagttttgtgaaattttatctataatatgtcattgcatttatgtagccacataatcactccagtcttgtgcagttgacaattgaaaacaatttgcaatggtgtccaaagttcttcaatcttgtcggcttgactctgggcaaatggtgtctgaatgcaaacttctatgcactaattgtcttccttcagaactcaccaagattggagaaactgaccctgatactcgcagaggtaaaacaatttgaaatgtatcatgcatatgtgaaagcttttgcacgagtgcacatgccattagaggatatagcttacctgttttcctttctgtaggataattggaaaacaacagaagtattcatcggtgatcttgaagaaagatcgtttacatgtgagcaccttacgagtgttgaagtcaaatgctgggaggatgatcccctggtgaacgtggttgacttctttgttggtagtggaatgtcttctgctcagattcatatcgaatacgaagacaatgatgaggatcaatttcatattgaatccgataacatggttgggtttgagcttgaggacgaggacgaggacgaggacgaggacgaggacgaggacgaggacgaggatgatgaggacgaggacggggatgaggatgagcaacgttcactttttcaatctaaggacgtatgaaacgtcaaaggggcacattccgtccaaaagatcgctctcttccgtcttcctcctttgattccagttgacttcgaaagcacagagacatgtttactgatcttctttggagctaggacgtgaagaatcatgtctttcgttgcatataagttcagtcgtcttttgcttgcttgcttctgtgatattccaagaaccaagactatgtgctacatgtttgaatactttattaggcctttatatatgttttgcaaagacgtgatattaaaatcccatatcgtgctttcacttcttggttccattaatcgtttttttttctatcactgcctactgtcaggatgtgaccattttgactggaagagatgcatcatttgtttttgaattgatcatttcttgcttgatctagaaaggaaggcaattaagtaacaccggcaattcatgttagcatctcctttcgcctcataagttgttatatattatatgtgttgaacttgtccactcatcacaccaatataaacttgtgaataggccgaaagtgctatagtggataatagtattgagcctcgtgggttgtcgatggatggcatgagttgtattcaagtaaataagtaaatcaactaaagatgagaaaataaaacgatatctttttaaaataatggatagaaatctagcctcaacatctacaattggatgtacataaccaaatgttaaggttatacaaatattcttgtacaaaacaaattaataaaaaaacaaaaccctaggtattaacgtccaacttgtatttctatcaggatggggtgagatcattctgattgtggaaagtatacacggttaatattattttgagtaaattcataaaacctcaggtattataatctgaactgtacaaaatcatagggggttttgtgcgttgcaaataaccacaggtaattttattagctgttttttttctttgatatatcacgcatatgagtgtcagggttatggataccacatacctaataatagttgactaaatctcggcaggatccaccatataccatgtcttatacggaaacaatattcggatatggatggagttccgcataagaaagataactagagttctacatggaaacgacaaggactactcggattgtatccatattggtttctctagttctacttagacaaagggacacctatgggtataaatacaagtccccctaggaggagaggggacatggaacaatatatcaagacacaagatcaacatacaaaccaacatacgccaagacaagactccggatatcgacttcagacataggcatggctagtcccctacggtgcctatggctaccgtcagaaaagatatagcgttgtctctgatctcgccggatgcggattcgacgaggaagactaccctgctgtcgactacgagtcagtacaacagaccgccaagtcgacaacagttagataggctaccccaaatattatactggtgtgattatggtgaataagagcaataccagcttcggccaataggatgtagggttattaaatgttgtagtaatgtaagtgaattattttttattttgctactaagatagattggttaacattgtggtttcgtgaaatcttaggactaaaatactcatggttatgtgacatatgctaaaactcgtgtgattttgtgcgatttgaactacaatacccaaggttttatgaaatttactctattatttttatttcaaaacacacacctccaaatatagacaaaattaccatatttttctcgctgtcaatgggtatgtcatctaccattgaaaaatatcaatgtgtacaacgcttatcattgaaagaaaaaaaattaacagtaaatgtgagcacacgcgtgaagtttataatttgaacccgagtgtgcatattccaccacaaagggacagctgagctacacacacatcgtagataaacattaatttgtttctaaatggggaagctaatattttcagtagtttttattaatgtgatctcccttcgagtaagtaagtatatactccgtactttacatccgttacataaatccatatcaaatgtattatactctcaaataagtctcccatatattcccaccgttccatattataagccgcttcgactttttcaagtcaaacttctattaagaatagtatcaaattaattttattaaatctagcattaaacatattttgatagtttgtttgttttgtgttgaaaatattattatattttttttagaaaacttggtcagatataaagaagtttgatttttaaaaaatatcaaaacgacttatagattataatatgaaacctcgttagtagataaaagtgcagccatttcactgattttttttttcctacagcataactaaactcattttgtagcagcacacatactgtacaaaatcaatctgaaccgtccgatcgtgcatcgacggcctaaaaccaccttgaagccatttatatccttaacccatcaacttctcttcttttgccttgaagttgaagcagagcagacatcctcctcccattcattcttcccgtgggtgcgtttccggttccgaggcgaccaccaaaccaatcgaggttttgcttctccctttcttccaatccattcttggttctcctcccccttgatcgctggagctttcacccatcgatttctgctcgaatcttgcgctacgttgcccaatcttttttttgctcatagttgagctgctgcggattcatggcttgttcgtttcttgcatcctttcttgttcgatcgctggattttactttgaaataaacattttttgatccaatcttgcactaggacatcaaatcttgcttacggttgagctctggatccacggcttgttgattcttggtgtccctcatttctgcagtttcgacgcacgccacctgttcgacgaaaggcctctgcgtgctcggccgccatggaaggatcgcctggcaagcgcgtgcagcccacgtccccggggagcgccccctgtactgacaggctcagcgacctccctgaaggagtcctccaccacatcatgtccttcctcacctcgcgccaggcagtgtagacgtgcgtgctgtccaagcggtggtgctacctctggcgctccgtgccctgcatcaacgccgattacaagcagttcgaggtgacgcattctgaagcgggagacggtgaggcgccggcgctgttcaagagatttgtcaaccggctgctggaactccgcgacccagtcgcctctctggacaagttctgtctccggtattccatatcttatgacaacgacgatgacactgacccgcaagatgcagtcgcgaataggtggatcagccatgcttttcagaagaaggcccgggttgtagaggtttatgttgacctcgtctacgctgacctctttccgttggcgattaatcactctgtgtttacttcaagctgaaattaatctgaaccgttgatcgtatttaatcatatggttgagatcgagttctactcccaccagattttatgggagtagaaatatggagggatatatttgtccagaggtaataattcgcgtaggggtattatcgtaatttgtctttatctaactcttcaccctctctatcctatcctaatcgacgccattcttctccctctccgcctctgtcgcctcccccaggcctcgccgtcttctccgccccctccatcgccgtccgtatcccccaccgtcgctgccttgtccgcctcctccgtcgccgtccgtctcctccgcccgcgtcgccttctccggccccctccgtcgctgtccgcctccccgccctcgccgcctccgtcgccgtctgtctcccccacccttgccgcctttcccgccccctcagtcgccgtccgtcggccccgccctctccacctccggcgccgtatgcgtctcctcccccttcggcgcccttgcctcccccgccatcttcataccctgccctcgccgcctccttcgatgccattctcggcctctcgttcacctccatcgtcgcctccatcgcccgtccatctccctctccgcgtcatcgcctccagcgccctcgcggccctttgccccatccgcctcctctacctccagcgacctgtggcggctgcggcgtacgtgctcggcgcctcggcaaggacggcggatccccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgataatgctgtaggatcactattagatcctccaaaactagcagcctgacgcgagcaaaattcagtttttacaccaagtacttcataagatttctactgaggttgttgtcccaactatacaaatttgcaatgtgtctgacaaatgttatcaaatcaccacatagataattcttctgtgaccattagcgagagatgatttgcgcttgtgtttcattctattttagttgatgagcagccgacagcggtttaaatggttttgattttgcttcagtaaaattctagtactaattctggagttctctttacttcgtaaattacacacagatcgatttttatttgattcgttgcttgcagaaatagttccactccctgtgctacatcacataagttaaatttcagaagatactactagtttatagtggttacggccaacatagaacagttaggtccataattttgtaaggctctgcagatcattttattttggaggctttccaatatgtataattttcttttcattttttcagccatgcagtggagctccaatggtgagtttgcctttcattgtcttgtcggagattgcacgttggaattactggcaaaagtcatgcttcttgcattcaagagttgtatcctgttctgcgagtatgatctagcagcatggtatggggctgatattttataaaggacaacgaccaatgtctgaattgaaatatatatattttgtaatcgccataatttaatgtctatcacagaagcagtaatatactcccttgcgatatatcccacgtggttttctttggtagatagtgttcgtgttttaagacaaatgaatagacaaagatgatatatatttgcacttgggagttgccgtggatggttactgcaagatgctttaattttgtccatgtcgcgaggggtcaatccccagtaccacaccacttctttttttcaatcatctaacataactgcaactatcttttttatcttcaccaaacagaaattaatctgcaatcaccacggttaatatatcctgaaacttggcttgatagagctttattttttgctaattacaccccctgacctccacatttacatgcatatcacttaagaagtatataatcatctgaacaaagtctctcatacaacaaaataaaaagctgaagaaacgtcagtggtccatccccaaccttcaattgtgttgatgcttcttacacacgctccctctcatagctccggcttgaggattacttcgcaagttgcaaacatgttcaggaaagtgaacaattctatgatacaagtgaatctgacagtcgcggctgctttaaaatctcatctcataatgaaaatactctagcagttaaagaatatatatcatgatgatttatgagaatgcttgtggacatgcatggacaaattagtaaatcgacccggtccgaatggtccaggacttaatattttatttgtccaaaataaaccgttctgctatattctatgcaccatcgacttgaaaaccatattttttttaaaattgaccggtccggactgaagaagtaatcccctagagaacacacctgttactttccctgcatacacaatcatcctggaggtagtgcctaaaaatattgtgcaatttgtaaacatctccacaagacaggacaggaccctactttctgactgatgttccaacgcaagccgtagttctcataaacaaagttactgaagttatttggattagagatgtaacaactgcacagataatatatgtacatgaacatgatagactaagtgctgaacatgaacaaaaacagttaattaactgatgctaaaacaacagcctagtttgaactaatcctcttcgaaatacttctccccagcatcgtagttggcttcttttgaccaatggtcgtccagcatctcgtcattatcgatccgagagtagtccatatgcccaaagtcttcaccggacaggaacttctgttgcatcaagctggtaaattgttcaagctgatcatccatctcttcagcagataatgtttgcttcgaagtccctgcaggggatcctccagttttgttggagtcaaccatctaaaattacagagttacagcaagggctcggggaagaattaatggctaagttgaatacagggctatctgaaattgatcatatattacatatacgaagaaacaaacaatctgattttcagaatgcctagcaaatgatgatgctaggccagtttgctatttgccaaaatctgaactgtccgcagcaagtggtttagccaaaaactggtaaaataaagactagtaataatatatcctgttaagggctctgcagacttctaatatagtaagacacagtatttagatcacacttctgccatttacagatgaactccagagaacaaccgcatagattcaaaaaaaaaaaatcagtacaaccacccaaaataagattatgttcgtttcatcaactgcataaattaattgccactctaaactattgaacaattactacagtttccccacaatggctgcaaattttgtatgtacgaaggattaagtcatgccctaagcaattaattcaatgtagtagtagtagtgatgaactagctggaaatgttggatgctttaaccagttgccaaggcaagcatttgctagaaaatatcaaagatcaattgcacaagaaatgatttaatttgctacctttgctgaggtttaatgatggacttatatcagtaacacatcaatttctggaaactgttttgagtggaatttcaagtgacaggtgtatttaatttgcagctcaagaccaatattattgttcagttttctttcaaaaaaaaatcattgttcagtttcatctttcatgcttacaattcaacatacaaaatcgatttattagatctccagtttaacatccgcaactgtagattctctagtatagctataagctagtatacacagccatttgtatatgcatttatagaggcaaatttcagacaagttcaccactgaggcaacgagcaaataggcagactagcataggccactcgcagcggacagagtgggcgcaggagaccaggatgccggcatggaatagaggagaggaaggggaacagatacaggtgtggggtgggaggagtggccacctgaggattttgccgcaccgagccgctggcagcgccgccggagattttcgcctgatgcgacgcgctgcaccgccgggcaccggatgcgatgcgcctggccgccgggcacctccgtggcacctgatgagacgcgccggagggagcggagacggcggcaagggcggggagggcgggggaggtggacggcgacggaggggagcggaaaaggcgacgcgggcggaggagacggacggcgactgaggaggtggacaaggtggcgacgacgagcgatacggacggcgacggaggcaaggcggcgagtccgggggaggaatagcgcgacggagtccacacctgcgatgcgaaccgaagataccaaccgatgcgaacccaagaaaacatcccattccaaaattacccctaaggcctcgtttggctgcttgtgttttggtgtggaacaggccccaaacccacccttccgtggaatgcagcccacgcctggatcaattcccacatctggcccaaatgtgaatttggatgttcgtgtattgctgtgtattgcggctcgatccatgccgacccacgggtgagagaataatcctcacccgaggcctggaactctgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacaaaagcagcagcagcggaaaaaggcgatcctagcggggcttcagctccactccacaggcaaaactcaactggggtctgagccttggtcttccaacttcatcttcagctcagaagcactacacttctgaaaagggggaataatagcaagactgagtacaaccaccgtactcagcaagccacaccaacgatgcagatgtgcaaggggatacaaggatggtttgtggctatttgcataaaggcggttgtaaaacattttattgagcaaaacagtaaaacggttgagtaattaaagtaatattgaatctccactgatcaacgctacaccacgttgaacaggcccaaccaacccacctgaactacagtgtattgagtcgatttattaagatgggactaatcacggtgaatctggtcgatcgcccataaccgcgggcacggctattcaaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccgttcgacccaactccatcacgcccaccctcgccaccggtgcctaggaaagggtcaagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggattctacacgctggcacgcaaaacgaggaaaaactctaataaaaaccaaggaaacagtacataaaaagtaaacaaacatgtagagctcaattttagatgaattttgcaatttgaatggcccaattcggagttcgaatgaattagatatgaattttagaagttttgagccatttaaatggatttctataattattaatgatttattgagcaattatcaattattttctcaaaggaaaaggcattcgctaacgtcagcaaggggcgccggcgccgacaggcgggccccacacgtcagcgagacgaggtggcggtccaccgtggaccgggaccacaagggcggtccaccgcccgtccacgggatgaacggcccagatcggcccaagccgattgggtggctgaggagagcggtggccgggcacgggcacaaccgaggctggcccgaccgaccatagagggcggcggcgcgcagtcatcggcgatggcgggcggcacagggagcggcggcgcgcagcgcgggaagcggcgagaggaaacggaggcagtagggagagggaggtggcggagctcaccgaggggcacggcgacggcgagagcagctggcggagggaggcggcggcgctccacaggtcgacaatgaggaggggctcccggcggcggaaggcggcgaccgggcggcagatggggaagagcgggacgcggcgaagccggcgatgcagccgatgcgtcgcagcggcagccggggtgaaggcgaacggcgaccggaggcggaaaaaggcggccggtagggtggtatggcggggaggtggttctggtggtggaggggaaaaagggatgggcggccgagcttgcccttgcggtagtgaagctaatggcggccgcggggtggctgaca

SEQ ID NO: 64816 - DNA, 33601 bp, Oryza sativa
aatccacaaatcatcacaatttatagtcatgaatttccattcacatgttttcaactgtatcaattcccatctccaaataaactaaccagataggatcgtcaattcatcatcgctcccggtcatcgtcgctgtcgctgagagacgaataccaaacactagttgagcaccgccaccgcacaacggatctgggagaggggagggggttggaggagccgcctggaaccttctcgaggaccagccgtcatcatcgttgccgtggcaaccatcgtcatcgtcgtggcagccgtcgtcggatccaccttccggccacgggtccgccgccaacgcccctccctgccgccggatccacctcctccaccgcaaccacccctctcctttgcctcctgcaggccgaatctgtcatcctccccgccgcccgcagcccaaccctccccgcaccgccgcagctccccttgccgccgccaccacccacgattgagggagagttgggaggggaagggagaggagaggtggtcggtgtatctcggaggtagggagaggtgggagagatgcggcggagaggaaatggacgacttggacgtagtctccacgtgatttatgcctcccacaatttttttatggtgatcgctcatagaccccgccagtaaaatcgatttttactagcggggtgctcataagacatttttattagcggggctaggtttttagtatctcctgtgatttttacaagtgaggttttttagatccattagtaaaaataaaacccttgtatcacgaaaataaatcgttttttaagtagtgtatgtatagctagctaattaaggagtcactttcctcgcttcttgctagctggggaccggtctgccattttctctggtcagtttttagatttttatttggcatttttaggagttttgcgtgaggtagattagggtttatcgtttaatattcttatggaggtagatttgtttagaatcttttgtctctcttacctatttgtcgattgccactacatttacgaggtcctcaatgaagatccatccatgaaagtttgtttgttggttgccgatgatccaattgacagaacagggtttaaggcctagaccatcaatttgtttggtgatgctgtcttataggtttgtcaaatgatcgaatatgggggtagatacttgttcaaatactcttccattcttctttatatatatcacgtcagttagttcatatatttagggatggaggtaatatcttttacgcatacccgaagtctcggtgaattgatgcgttatgtctgaacacgtctagctactcatgacttttacttgacttttactaggatgttactagggccctatttagatcccaccccaaaattttacgccctgtcacatcgaacgtttaaacacttgtataaagtattaaatataggcttaaaaaagttgcacatattacgactaatttgcgagacgaatcttttgagcctaattgcttcataatttgacaatgtggtgctacagcaaacatttgctaatgacggattaattaggcttaataaattcatctcgtggtttactgacggattctgtaattagttttttttactagtgcccgaacaccccatacaacaccctatataatatctgatgtgacacgccaaaactttacatcgctggatctaaaaccccctagatacggatcatctttgtgctggcaagtactttttttttcttataacaaagggcttgtttagttggtgaaatgaaaatttttggatgttacatcggacgtttgaccagatatcggaatggggttttggtcaagaatgaaaaaactaatttcataactcgtctagaaaccgcatgacgaattttttgagcctaattaaaccgtcattagcacatgtgggttactgagattcgtctcgcgatttacatgcaaagtgtgtaattagtttttctttttatctatatttaatgctctatacatgtgtccaaatatttgatgtgatgtttttgcgaaaagtttttgggggaactaaacagggtggagtttattttttttcactacatttggtggagttttttttttccgttataacaaatttgttcaaactagtgcggttttcaactatttggcacattttatttgacgctgatgggagtcgagagtcagcaaacaaaatgaaattaaaaaaaaaatccgtgtcctatctcatactcctacctttcttctagacttgatcaccgcatgctagccaactcaactacatacaagtcgactaccaagtcacccggtatttgaaacgtattccaagtagttgtgtatagtacgcatcgtgaaccttttagataaacccctaatgaaattggagtgccaagtgccaactttctgaccatcacgaggtgtacttaataaccataaaatttctccagttcttttcttgcaaaaataatcacctcctttttcatattttacttggcgcgcgcggggtatcatattctctggttaaataggactccctccgtttctaaatatttgacaccgttgactttttagcacttatttgaccattcgtcttattcaaaaacttttgcgaaatatgcaaaactatgtgtatacatataagtatatttaaccataaattaaatgataggaaaataattaataattacttaaatttttttaaataagacgaccggtcaaacatattttaaaaagccaacagcgttaaatatttagaaatggagggagtagaaaatttcgcgcgcgagtatttaaccctgaacgtctggcgccgcgccgccagccaccgttgacgacacaccgacgccggcctttgctctgcagccaatcttcgcaccttcttggtctcttcgtcgtcatcgccgccggaggaaggcgagcagcagcgtcgtcgccccgacgaggccaacgtacagggtcgcggtttcttggcttttcttttttaaaacttacttttgaataacggggtttcgatcttggtttgattttgagcgctgatttggggctctacaactagacccatagatcttcacaggccgacccaatttttggctgtgattacctgtctgcatagttgtgtgaggaggggtccggtttccgaccacatgcgagactgcaaagatccattttcgcggacgaacaacttaaaagggtcgtctgcgataatgtttttaattttgtaggcgaaccttaagccgtccacttgtaaaaaaactaatttttataggtgaaccgctaggagtgccacctgccaaaatcgccgatggaacaactccctaaaaaaatctatgtcgtccccgtgtaattcttatcccaatataataactctatcgactaccccaaccttagatatcctctccctctcaaagtgcgcagcggcggctcagtgctgagaggaggagcagcggcagtgaggtaggggtgccagcggcaggagctcggctcctccctcccctcttcttctcctccccgcttctcccctccaatcctggcaacagcggtggctcggtgatgagaggaggagcggcggcagcgatgacgatggcgaacgccactcttcccccactcccagcaacggtggccggtgggtgctactttcttggcctctctcctgtctctacctctccctttctctctcgatctctccagtctctactctgccactgaagcgcagcagccagcggggcgtgggagtagagcagctggctgggcacgggatccgccgtcgccgcgaaggagttgggggtggcgcggtggagggcaaccacgatgacggacgaccaaatccagcaaagacaggaggtggtggatccggccgtggcggatccagtggtggctgtggcatccgtgatgacgatgatgaccttgacggcgatggcatccatgaccacaacctgcttgctgcgacgatggctggcggcggtgggcgaccttggcccgggtggatccagcaggctttggacggttgtgatcaagttgtggcggatctggctagggtttcgattttaggaatttttattttttttaacaaatttttcttttcacagtcaccctaattttcgcatgtggttgctacctgcatgtaaaaatttgattttcgcagacatctgagtgtaggcagtgctactacaaaacacctgataggttacggctcataggtgccggtttagaaatatggtacctatttacagtttcccacctctatcagacaaaaatccaagataaaaaccgacatatagtatatgtgttggtttttttatactataattgccagttctagataaaaaataatacctatactataattgccagttctcgcttgcgggacgagagattgttttagccaccttcccactcctgccattatccattcgcccgttctctctctcgcctacgccttcctctctttttcttctctcacctgtgccgtttcctctcctttagctctctgtcttcttttcgtctctccccagcttttcctctccaccggagcctctccctggcggctcgccttgccacggccgacgcccagtagctagcggccagcggattcatcggcgacggcaagggcggtggtacggatgccagatccggcaggcttgagcttgagggcctctggatctgccccccccctccccgtgcggcgccctctagtagatccgtggtggcgatggcggtgggctgtagcattccctcaacgtcgtcaagtgcacgggcgacgatttttgctgatttgtggatgtttttgtcgttgattttgtgtatgttcacgattttgtgatgacaatcgatcagtgtggcgatctaattttgatttggggatttggggcaacgggtagcaactcgatgcatcgacttgaatcgagccgatttttttttttttgcctagcgagcgcctcgaaggtgctggttgcgaaaccaacaccaatggctcggagtcatctgtgccgcgtctgttgtgtcggtgcccccatgtgtttttccaaccggcaccgatgacactttctgtagtagggcaggttatccacccgcctgcgaaaatcgattttgaccgcatggaaaaaatcgattccatagtagtgaactatactattagatatggtgcatctttgtgctggcaaggttgtttttcttatagcaaagctgtaatcttttccgatcctaagtataataattcactcttttatgtatttggcacctttcatccatttgacgctgatgggagtcaaagacagcaaacgaaataaataaaagctgagccctaccctaccttctcttcttcctctcggttccggcttcataatcatactcctcttcctctctctagccggctgcgtggcggtgggtaattcctattgagtattcgtgggtgggtttagtctctcttgtatgctatagcctacttctctattttaaaaaagggataattacattcttgcacctactttaaaaagcaattgtgttgaatctatcatgaaaagacatatatgcccatgcaaatttatcttacttatctgaaaactttgtggttttggccatgttttggtatcaagctttttggtagcattttgacaacaagggtttatatgatttgcatgaattctgaaatgcgaactttgagtattggcttccaatgagccaataaatctcccaatcacaattggtgatgcatttttttccaaatttcactagtactcctaattaaaaagaatatatcagatatactaaggctgtgttcgggaggaggggttgggaacccctcctctccggcacgcaaaacgaagctagtattattgcatgattaattaagtattaactaattttttttgaaatacggattaatatgattttttttaaaaacaactttcatatagaaagtttttgcataaattacaccgtttagtagtttgaaaagtgcgtgcgcagaaaacgagagagggggttgggaaaatgggggaaagaacacaacctaagcaatggttggtaactgtctaacaacaccagtactccctctgtcctataaaaaacgtttatgtccagattcattttattggaaaacgtcacatcatgtcctaggttagcactcaaagtttatcccgttcccatttttaacacttctatcaattctcatatcattttccgtccgctttgattgctattgactcaaacacgcacacgatataacatttctacccctcattgccatgcattctacgagtactttttaaggttgattccataaaaattgttttctttttgggaggaagtactaaagtacggaaccatgatcgagtaccaactaccaagtcactgagtatttgaaaggtattccaagttgtatcgtcaggaatctcttgaacaaacccctattgaaatccgaggcctaacaactctctcacgatcacgaggccaggcccataaaatctgcacggttcaattcgtttccttaaaaaaatcacctcctttttcgtattttcttctgactcaagtcaacagtagaaaactcttggcgcgcgaatatactacataattaacctcagacgtccgcctcgcaacgacaccttttcgccctgcagatgagatcgctcttcgtgtctcggtcctcgatcgcccaatcgaatccgctgcaacttcaagcagccactgcccactgatccactcgagcggatcatatcgtccggagctctagctagcctcattattgccgccgtcgaagtggctgaggcaaagagccaccgccgccggctgccggagcggctcgccggagaggaggaaggcgatcgagcgaggagagactgcagcagcagcgtcgacgactaaacgaggccaacacggacagggtgggtttcgtttcttggccttttatttttcttttattttttttggttttcaagatataatggggtttttcttggcttgatttgaggtggtcgccgttcttgagctgatttgtcaggatttttgactggtttgggaattgggatgtagggattcgagattttgtggttttcttaggagggtagtgcggctctgcccccttcctttggggtcttcttgggagggtagtgtagctctgcccctttcccgctgactggagttgcgtttggccgttgaagtagtctctttgtttttctgctttctttttgtttgtgtttttttcttccttcccatggcataagccggtttggctaattgcttgtataaacaaactcttatttcttttaatatattgacgtgcaattcttttgcgcgttcgtgaaaaaaaaagattttgtggttttgtggacaaagtttggatctttgtttctttcgtaatatttgttgctgcctcagattacccctttgttgataattggatttcatttaacttgttgtttctccatcctaaaatatagtaaaacacaaccatcactaacacgatagaccaataaaatttattgtgacccccttcccccctcctccccaacccaaaatcaccctaacaaatataatgcatgcatcaatgggttagaaatcacgagtgtaagagacacggtatctaggtacccaatgttatgcctttgggccatgttacacaagatgggccaggtggcctaaagcccatgcagtgtggtggatcaaaggtaaggtgtaaatcttattccatgtaaataggatttttagaaaacaaatttagaaaagggagaggtggttgttaattgcatatatgcatctgcgccttgtattttgaaacatgaaacaaagtagtgttctgtattttgtaattgaagatttccaaagatcatttcagcagtagtaatgcatgattttcaaaacttcttttcttcccggactgccatgtcaacaccgtcaaaaccacgtttacagatgcgacgttcgggtatttataacaatttttaataatagcacactaatagagttactcgctctgtccacaaataagtggtcctaatacaagatgtaacatattccagtaatacaaatttagacagactgtctagatttgtagtactaagatatgtcacatcatataataggtgtatttattttggaacggagaaatcaccaactaccagtagtaaaatttgctgacatacgagagggataggtgaggagagagaaatatcaatgttaagcttaatatcatcttttagcccatgataaaagtaagttttatagcatgaaggtgggaaaaaggaaggatggataatataagaaaaatatttaagcgactattgtctcaaccattataaggtacacccttcgtttcatatttgttttgactttttcttagtcaaactttttttaagtttgattaagtttgtaagaaaatatagtaacatcttcaacacaaaataaatatatttaatgttaaatgtagcaaaactaatttggtattgtggatgttactaaattttttacacacttagttaaacctaaataaatttgactaaaaaaagccaaacgatttatggatgatgtgtattgtctcaaagcctcgtggaggctcaaagtattgtgcatgcctttatcaaggcgatatatatttagaaatttttttcgtcaaattttgtttaaattccactgggttcgtctatgactgctcgattatatattacagttatctagaaaaccgtcagggccggagaggttttcgataacaaattacattcttaaaccataaacaaattcaccttaattcgtttgaacctaaggataaattggaacggttttagaaatggaagggtggataatgtccagtagaacagttgagggattctttttctacaagcgtgcggatagtttaggcataatatggatctgttcatttaattttctaattggactatgtttggcagcggcacaaggaaaaaaactcactcgttttcttcaatatgtatttttgcaaaatcttcggtgacatgaggaagggggagaataggggaaagagagaggaggctgacgtggccacgctgacatatggggttcacgtgggtcccacgctgacttagccaccacgtaggataaaatcggggtcaaaaccactgaataggggtgaaaacggtacggaaactttccggattgcatacttattttcgaaaacggaatctgtcggtcggaattttttcggaatttttcggaaacggaaacaaattcggaaatattttctcggaaacagaatcggaaatgataagggcggtttccgtcggaactcggaatcggtcggaaactttccgaaaattttctcgaaattttcaaatattttctcggaattaccagaaattttgtgactaaaataccctggattctttttttaagcactaaatagtgaataccatggtgtttggctggtattttttaaaaaaatatttgttatgcaaatctaaaattacataagaatattttttcctacattgggattattcaacaacattactcttttaaacatagataatttattcaattggatttatcagtttgaggggttttttattccgataaattttcgttaccgtattcgcgccggtttgttttcgctccgttttcggtttcgataatattcgattctgttttcgtatccggggtttccgattccgattcccaaaaaaatatgaaaacgaaaacgataaagatggtttccgtccgttttcgtaccgttttcacccctaccactgaaggacctattgtgaccggttttgattagttaagggacgtcagatatctggttttgtgattgggggacgattttgtaacttgatgacaagttgagggaccttcggtgtactttttccctaataggttgacaaatttctttcccctttgttcctgtcccaaatatagatggccaaaaggctagggacccgatggctcggcccaggaacggcatgacccgactggtgtggggcccgtgctagaccaacccgactgttgggccgtgcctgggcctctgcctcagcatggtccaatgatcaggtaggaaaaatagacttatttgagccatataaggcatgaccaaagagatgagcgatgcaaaatagacttattccatccatataaaacacagctcaaagagataaggaaggcaaaatagacttactccaaggaggagcacgggggatttcgtgcctccggaccggccagcacagcctgggtcttattgggccatgcctaagccattggtgtagttcgtgggcaggcccgacccggcccagtgtgtaggtcgggccgtgctggcccgactgatcttgggctcaggcctggtcgtgcccgggccagaccgggcggcccatttgaccatctatagacccaaactatatgagattcttatataccttttgtttttagatcgaagcaatggtttctatgggtttcttcctacagttaggattcgtaattcttctagaaatataatatggagtaattataattaccatggtaaaaattgtcacaaactatggggcattgattatgttcccttttttttttttacttttgtgttacctggaagatgtccatgcgtaaacacacaccactatatacgcaggcacatgctacaagagatagaatgttttgtaacagttgattcttttgttgttacaagttttttgtgccaaattaagtttcatagccatggacctcacacgtcatgctcttattcccctgggggctaaggcaagatggagtaaacaaattcttggccacatcttagcgaacattagcaaggtggtgtcacaatgtaaattcttattgaaattgcatatgtgtagtgcagccagtgcttctccgactgttttctttcttgaacatgcataaagctaaaacaactttatctcacaaaaaaagtgctaatctatataactaattgtatacaacaggtggcttggtgtcaataatatttatgcgatgaagaatttggtggaactatattatgagagggaaatccagctgtttgtcctcgtcagcttcgcactccaagtgttcctctttttcactggcagccttcggcggcgcagcaccaacatattcctcagtgtttctatttggacagcttatttaggagcagattgggtagcagtttatgctcttggcaacctctcaggagtacaggagagcatcatatcaaggagaagtcagctgccactgtcttttttttgggcaccgtttttcctcatccatctcggtggtcaggacacaatcactgcttttgccatggaggacaatgacttgtggctgaggcatttcttgaatttggtcgtgcaagtagtcctcgccgtgtacgttttctggaagtcagctagaaggcagagtgcggagcttatagtttcgggtgtgttcgtgttcatcgttggagttatcaagtatggagaaaggacatggtcactcaagtgtgggagctcaaaaagccttgagagctcacctgggcatcactacaagcaacggtttccggaactaagagactctgattgcgactatcgaaatatggtttccaatgctctatgttcaatgttcaatgtcctcaatgtctttgcagcgcgcaacttgttcggttatagcttcccaagtgttggtccagatgatactcaagtcgacgccaaaaaaatgttcaagttggtggagcttgagctcgccatgatgtacgatgacctctacacaaaggctcttgtgctgagaacaaggacaggcattatactccgatgcatctctcacgcatgctccttcgttgcttttgcactcttccttgcgagtgataaagatcggtacattggagttgatattgcaattacgtattcactgtttatcggaggctttttcctagatttttgtgcgatgtttattgtcataacatctccatggacttgggtctggttgaaggctgcacagaagagagactggctagccaacttgtcctggttcctcttttccagtgatattgggtggcccgagagaaggccactgtggtctagttccattggacagtacagcttactcagctgggactctggatcagaccaaccaacaagatcatgcaaccagaaagtgatggctctggtgagaagatcggcgaggttagtcggcgttggaaagaaaaaattgttttggatgagcaagctgctggacactaagttcctagaggtagatgagaagacgatggagtttgtggtggaggggatcaatcgcatccgcgacgaattctccgatgtcgcgtcccgggcatggccaaagcttggcccattcctcgaaaccataagagttcatttcaccgcggactttggtgctgccattgtcgtgattcactcattcacagaggagtacctgatgaatgctgctgctgcagcagaagaagaagaagaagaagcaggtcagggaggagaagcaaatgatatgatggaggtgtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccatgcgacgaaacgttgagggagatggtggacatgtggacgaggctcctcatctacaccgccggcaagtcccgggggccgatgcacgcggcggagctggcctgtggaggggagctcatcaccttcgtctggctgctcatggtcaaggccggcctcggggattccgaggcgaaaaggatcctcattgcaaattctgcttgcgccgacactaatacgaaggaagcctatgccttttatttcgcttcgtgacgtgtatctatgtaataaccatgagccgccggtcagaccgaccaaacacctacggtgtcagaccggctccgtgaaggaataacagttatttccaaattttagtaatgtttttctattttgaatatgatatatgtgttgaatttggatgttaacaccgtcattcctgtattcaaatctttggattcacaaatgtacattattcctgatttaattgaggcatgtagcttggcagtgaatgcccatgatgggcttgcaaaggcatctgccatttgtccagagatatagcacgatctaataactgactccctggacaagcttcccttgagatgtgcttctatgctctcccactaaaaaaaaagcatggatttcaaagaagacgagaggctaagattagaaggtgcttaaccgtctgaaaatcaattagaaagggtactttcgtccatggagagaattaatctcgcatctgatgttggctccttcggcgccggaggccaatacgctactacagctactcgatcattgcccagatcatgaatgcagaacagaagataactggaagaaaaattaacaacgaataggatcatcgatggtatagcttgatggagcattcaacctgatatatccatctcacagttcctactcttcgtctgaatgcggttgcacacttgcactggatggccatgaaagaaaaaggttctctaggacagccaattgacgcaaccccctaaaaagacgctccacgtcgcccacgcgcaggcagctcgtggcgaaccctagctgccagccgccccctcccctcctcatctcttcgtctcgccaccgcattggagtgcgccgctgggagaatcgggcggcaagcgaggatgacagtggcggggctaaacctcggtgacattccgcctccggcgtgggggaggaggcgcggagcttggaagctagaggacgacgacggcttatctggcgtgaggcagcggattcggcaccgccccaaccggatccggtccccacatagccagattcaacgtccctacttggatctggccggggagcaaccgaagtgggtggtggcgtgcggggacaatctgcggcgagaggttgtggacgacgtggtgaggctggaggccatggacagcacggcgggaggcagtggtcggtgcggcgaaaccggtggtgtcaacaacaacaggacgatgtgggcggtgccgatggtaacaagaggctggcacggtggcaccagcggctgcagggaagcagtgaaggagcgacagagctggcggctgcgcggggatggagccaacggcagtgggaagctggcacgagtggccagtagtggaggtgtcggcgacgctgggacaagagcggccagcaagcacgacatggaggctcgcacctgatgagtgcggcgtagaggcgacggggctagtaggagcggtgtggtggagaggccgcctgggcagcaaagacggcagcgatgtgaccaggtagctcgttgtggacgacacaggcaaccgggccaaggcagcgatgatgttagtgccatgaggtcggcgttgatgactgcagttagttcctctccaagcgtttgcccccttgcagatggccacgttgggtgggctagtgcgggggagaggggatccatccttctctctcaccctctctctctccaacctgtccacgtggatggatctggagtgcgtcggaggctgagatcctgctttgatggctagccgacagcgaggtgttggtgcagtggctgcgtgttgaagggatttggctggtggtggctgctgaacctaataggcactcaatgacgcgggagtgttgtccaatcccatcttttttttcatctctttttttttgggtttgtgtggaggttaccccttgtattgcatgaggggtggctcaccttctcttttctcacttatttcttctacctcatcattcaattctatatatgtgacattttcaggtgcaacacatcaagtattatagtacttgccctaacacgtaggtgctttgctaccatcctcactcctcatatgcctccctagggtgtgtttggtagtacaggtttccaaccgggaacaatacgcgcgaaaaatggagcagtccattagcgcgtggttaattaagtattagctaattttttttccaaaaatggattaatttattttataaacaactttcgtgtagaaactttttttaagaaaacaccgtttagtagtttgaaaagcgtgcgcgtggaaaacgagagagatgagttgggaaaaggaggtgccgaacacacccctagggggtccctccctgtgtgagcagccatcgacgcgacaaatgcctccatccattgtgtgaacaggccacgtgatgccacctcttcttcccagctctcaaagctataggggttctatctcacatgacctctcctctccatatcatggccttagggtgtgttcagttcgtgaaaagaaaattttttggtgtcacatcggatgtttgaccgggtgtcagaaggggtttttggatacgaatggaaaaactaatttcataactcggctagaaaccgcgagacgaaacttttgagcctaattaagccatcattagcatatgtgggttactataacatttatggctaatcatggactaagtaggctttaaagattcgtctcgcgatttccatgcaaactgtacagttagttttgtttttatctatatttaatgctccatcatgtgttcaaagattcgatgtgatgtttttgggaaagaaaatttgggaactaaactagtcgagtggatctggtggaatttgaccattggtagcttctcgtccttccggtagtagtgtaaaatagcaaaggggttctcgctggttagcctacttatccaccatcttcgttctcctccctttcatttcattctaggacttcgtccttgcgatattcattctcctgttttcctttagtttgcctataatacttgtgtagttatggatattgtgcatatcacaagttgcgataaattttgagggttcaatgaaattgagggtaaagcctgtacaatatatccatgttcctaattttgatacatgagcatgccatctttcatttttttaatataaactagccacatgtcttattcacgtgtttaaggattggcattgaataatattttttctctttttttacattgattagctatagttgccacacgatttaatgcccctcgaaagtacctctactttcttatagagacattttataaaatgcatcttcacttctagagataattcaccaaaaggtattttgaaaaatgcctccattgcattgtagaggcattttaaaaatgtttctatagtattaaaaagatgtctctacagtgcatttttgttgtagtgtttgctggatcgataaacaagcaattcgtgtggatcaaatagcagtgcccaattccatttaaatttttatgattgttgttttataggtgcctttctagtgaaccgaggttaatagttggtcagccatatattcttgatgtcatgttattacagcacagcagatacctgtaaacttttcattgtgatattttgcatatgaaatttacaataaatatccttgtaacttgtgaatttcacagagataatatatggctggaattctgattgtttgctaatgaaaattttttgacataaatgtagaaggtccctttattttttgccaaaaataaataaattgtttgcagatgtgatttgggtggaacaaatagataatttggtggagtgcacatacaacttgacaattcttacatgccaatctattgcagcaacctttcccgtctagattatattatgtgtagttttgacctcattaatttggcggtaaagttcatttttcatcctgaactataaaactcaaatgcttttcagtggttgtgtttgaaatggatgtggttttcctattttatactcttactgtgcatatttttatgcaaatatcacttacttagatccagagtcgtgaaacatacctgattgaagttcatactatatcaaattgatcaaaaccaccatgaattatgaaatagggagtagaggtgaaaaataattggtttcgtagtttagggtggaaaatagattccaagcaaagttaagggcaaaaaatagagtttacacttaatttggtttccatgtcctgttcttttgatggactggcctcatctttccgagaaatcaactcaaccacttaccaaatggtactgattttgtaaaggttactgaattgttagttgcactgaaattgttgtaagttttgttgatgttttcttaaacatgcatttcatcaaggataggaattacctgatgagtacttagtattgtaaccatatcgataagtagaattaactacagaaggaatagttgaacagaaatctctgaatttagatttacaaaatcgctacggtgctatgttacatttgtaatatctacaaatgttttcccaaaaaatgggagaagatagattgttagttattaatatgacagtgtaactcaatttagtataattattatggtatggcctgtgattgatgttttgttttcaagctttggttctatgcaaattttaatgttacggggtatgcttatgtgtcgcaaatgtagacttttatgttcaataaaactagtcatcttgttatgttagcttttttgtgttattgattttgatttaagttgcacatataaacaagcaccactgtcttttttttttacaaagttacagggtgttcatggtctatttgttgcccactggaatgttttcttaaaagagagaattcttagagacttcttgaatcatatcacttcaactgcaatatgatattccagcttcgattagtataaatgacaatcttgttcaacttcttacaactgtatatatggcgaagtattacacagatacggttacagtcaagagaaaaggaaggagaaaatctgggatatatataggggctggcagctatagaaagcccaaatcatatcagccatgcattatctcttatcacaggaagattgctggttattaatcctaactctacttcatacatagctttagattataaagatgtagggaacaacaaacaaagctactcaaatcagctaaagtactaatcaaactttcaaactttaatcagttgaaaaagaacgcatatgcttccttcaaatcagctgcagcaccagcagaatcagcagacgaaatggacgatatggtggacgtcagccggacccttctcctctcggattcgccgagcccttcccgggccatgagcagccaggcgaaggtgatgagctcccctccgctggccagctccgccgcgtgcaccttaccattggacctgccggcggcgaagatgaggaaccgcagccacattgctgccatctcctccactgcaccccagcttggttggacatcctcttctagtatcatcttgtacatttcctccattgttccttgccttgacacaccatccttattctgctgtataatgttgtatagctcatccagggtcatcttgcttccttgttgtgtcctagacagttcctctctcgatttcgcaaactcaaccacggtggcttcggagctggcattgagcggaagcatggaagggtggttgacaaagaggtacatcatgtagttggacagttttcggcacacctccaccatatcatctgcatctccccctccttcgtctcccgctgccgcggcttctactgcattcaaatatacttgagtgaatatgtgcatcaccacaatagcacatcccatatctgcgacaaaacagacccgtatctttttcagcaatgggccaagatgctgccattgttgttgctcggagacttcatcgctcaagctactaatcccctttacgacaaactccatcgtcttttcatcggcctccacatgctcagtgtccaacgtcttgctcagccagaacaaatcttcttttccaacaccgactaaactcgacaatcttctcactagagccaccactttctggttgtatgatcttggctggtctccaccagaaacccagttcagcaagttgtactgtccgatggaattcgaccaccgtggccttttctctggccagccaatatcactggaaaaaaggaaccaggacaagctagccagccggtcgcatttctgagccttcaaccacgcccaagtccatggagacattatgaagataaacactgcagaaagatcaaggaaaaagcctccgataaacagcgaataggtgatcgcaacatcaactccgttgtacctccgtttgtcacatgtaaggaacagtgcaaaagcaaggagggaacatgcgtgagaggtgcatcggagaatcatgcctatccttgttctcagcacaagagcctttgtgtagaggtcatcgtacatgattgcaagctcaagctccaccaccttgagcatttttttggttccctgtaccgtgtctcgagcaataacaactggggaattagattctggaccattaacaaatgggttacgcgctgcaaagacattgtggacatttagcattgaacatagagcatccaaaactaccttagaatagccatgatccgaatcgtttaattccggaaaccgtttcttgtagtgatctccagttgagctctcgagacttttaaaccttccatacttgagagacagtgtcctttctccatacttggtaactccggcaatgaacacaaggacacctgaaactagaagctctgcactgtgccttgctggcgatttccagaaaacatatgcagctaggactacttgcaccaccaagttcaagagatgcctcagccacaagttgttgtctgccattgaaaatgcggtgatgctgtcctgcccaccaagatggatgaggaggaatgatgcccaaaagaaagctagtggctgggttccccctgacatttgcctctgaatatcatcgtgtcgtgagaggtaaccaagagcataaactgctgtgaagtctgctcccaaataagctgtccagatagaaaccctgaggaacacattggtgttgcgcctccgaagactgccggtgaaaaagaggaacatttggagtgtgaagctgaggagcacaagcagctggatttcccgctgatgataaagtttcataaaatccttcattattataaatttaagagcacctgtgttggatattccagtaatcatttagtacaagttttaaaaagaagattacattttcgacgtactacaacccagaaacgtaaagaaaaagaagtcagagtaaattctttaaaattctaggtatatattatgatctaaattgcataaatccagaagttttggcacgtggcatataacactggatatattatagtcctacagtttcatataaccgcactgtttattaattttacttgctactattgtgtcaaaacaaaaacaaaaaaaaaatgcttaacttaatggctatcaaactttttatacaatagatcaaataattcttcatatatttcagaattaatttagaacccacaaatatggtcaatcaaataacaatttattaacagcatgattttatgaaactataaaaccatagcaccaagaataatcatatgctccgtgctaaaattccatttttttttgcaaacagcaacaaatcgattcacaatattaaagctcgatgcatgtatgtacaacaagaaaatagtaaataccccggttgtttgtgacagtttttgcccagtgtaattaattagttatacctataatatatcctatctacaattccctccgtttcgttccgttccacgatataagacgttttttatctaaatatactagcatacatatgaatttatacacatctataaacatatatatggatccatatatgaatctataaaatcccaaaacgtcctataatgtgaaaaagagaaaaatacatctatttaaaaatatagcaatcgaaagagatacaacctaatactacgaatctgaacagatatattggtaccatgattgtattcccatctaatcctagatttactatattttgcaactaagagaatactattctaaactcatttctctctctctcctatgtcggccggctttgctgccatggaaaggaaggaggagaccgacctctgcacgaccggcgtctcccgccaggaaccccagccaccggacgacggatcagccgtacgtcgccgtgtccaggaggtagcagatcgagtggaggagggacacgggaggaaggatcggatcgagtggacgacagagagacttgttgttgacgaggaagtgatcagatcgtcagggacgaggaaaactctgtgaaagaccgtagctaggctttgccgattttttctcaagtcaattctactatggagtttggaccacatgacactcacagcctagctaccacggaaaccccaaaatcctactcactccctaggatttttttttaaagaaacatggtagtacacttgtccctataaacacacgtacactttattcatatttataacaattaatgtattgaagttggttgatacgaagaagagaacgcggaaaaattaaataaaagatagttgtgattgattgagataatagtatagatactagagagtctatatttttacaataaaatttaaaagtatggagagtatcaagcatatatcacaagtactagatggagagcggtaagaggccagccggttgcttccctggccacgtgatataatgatataacgtacggtaaccttttcagtttttggaaaccacggtaatcctcacgataacagcatggttcacgataaccacacagtttctgcacatgataaccaccttactgtgggttaaaggtaatctcaccaagacggtttggcgaatcctgatactcaccaggaaattctattgtgtagtgtcatccaattgtgcaaccatggtgatagtataggtggtttcaaagtgaggttgtttttttaataaagatgcagtacccaccatgagttggtacggttattaatcattggctgtattagttttgcttttcatagggctgcatatgactagatactttaaaaaaagtacaatggcactccaaatactatagcgataagcattccacgttggattgcatgctgagctgaaaagagattagtgaagagagaaggcaaacaagtgactaagggtatgtttagcagagcttcaacttcgaagtttatcttcaagagctcgatttgaagtgaagttgtagagcagtttaaaccgagcttcaccttcttaatttattttatgagagcattctagtcagtttcactctagctccctttttaggtggagttgaaactgtttggttgggccttagctccagaagacatgtagttggagctagagctctgccaaacataccctaaatagtcgctcgctccatgcgcactccaagagcgttgtatagtagctttcctatcgcttgctcgtagccgatgccgacaacacccccatgtggtaatgtggggccgtataattagcgacatccaacgccagggagatcatggagaaacagcagcgcggccacctccagggactacgagggggaataggcaccagagaaagacggtggcgcgatatagagcgacggcgacatgtcagttaccatgacgacaagaaaaagaacagaaaggagttgatatagaaaaaataactagtgaaaaaaaggtagggaaatttctgaccataccgatattgttttcataaagaaaagtaagatattgtttttagctttatgtaaaatttggtttttttaatttatgtatgaattatattgaagtcatcactaaaatgttagttagatttataaatataaaaagttcccaaccatagtgataccattttcataaaattttagttattaatatcgtttccaacaattttcatcctaaaaaatccaatcagagaaaggaataggagctcccaatggcagtggtagtgtcctggtcagcaacagcggcggcattccgggctccgcgacacatagttcactgttagcttttttggctcccagggctcccttagagcaagtttaataatatagtccaactactagctccaaaaattaaggcaccatctatagctaacctaataattcactcatataatagttagttgttagttgtatatatattgcatcattaatacttattcacatatatctcttatattgtttattggaacccatgctttagttggctataaatttatagcccattttttctctctcgtcttctctctcctccatataaacacaaatatgatgtgacaaatcgtacatcccgcttacatcattctattatactcggttttatggcagcaattctaaaggaaagggtaggtagagggagaagatgctggaatcttaacatttcagctgatgtcgtggcagatgagcgaattggactctcaactttatcgcaaccagcaaaaccaattaattttacagaaaaactagaaaacgggattctgttcaacgggataacctagccttcacaacataagcatacatgtagcggcttgccggcttacatggagagatcaaccaaactctatacaaaaggcaagggcccacatgcatgtactatccttttttcttgtccatccatgcagctagcttatgggccaacgtgcatgtgcgtacatgctcgacattttactcctgcatgtacggtgcccacatgactttggcagagaggtcgatcagttctatgcggtagttaatcatcaataatgaatacacttattagatcactagtacagaaatataatccctcatacctaatatgtattataactgaaaaaatatagtgcaaaaaatggttccttggatccaatacctacatatatcgtaactgatatctcacaagtatcatcactagtacccatgtatcatcaccaatacctgataggtatcatcactagtacctacgtatcatcactgatacctcataggtattatcactagtaccagacaggtatcgtcattggtacccatgtatcatcaccgatacctaacatgtatcatcaattggcacctatatgtatcttcaccgatacctcacaagtatcatcaccagtacctacatgtatcatcaccggtacctacatgtattatcttcgatactgggtatcgaccaacccagattgttccaactgatatcataggtaccatcgagatacttggtacctagatcaacatgattcccatatgtaccagatctagtactgggtatcgggtatttgggtatcaagtacctggtacctagatcggtctgatacctataggtaccatacctagtgctggtatcaaggtacatgaggtatcatatacctgataccacctgagtatcgggtactaggtgtacctgaattgatgttgaacgatacctgttggtattgggcctggtatcagatactagttttagtatcaggtatcaactcacatgccacgtcacatgcatgcatgcagctagcaacacagccacgtcacatgtatgcatgtagctagaaacacagccatgagtaatcagtagaatgctacgtgagaggaagcaggtgggggggggggctagcgacgcggaacggaagggtatcccgttcccacgggatcctacggtctagctatcctcttaattttatgttatttgagaccattcaacaactttattttgttaacgtacaatagagttagttgttggctcaaggctgagagcaggagcatggcggtggcgcacagtatgagggatggctcttggaggataaggaaggagaggatcattgtaaaagcattataggtgttaaaaaattacaaagatgagggtttttttttcttttcttaagggaaaaaagaagtttgaattaccccaaactattacagttgctcgaattacctccttaaactcaaatactagatatttaacaccccaaattctttgaaccggatgaattaccctctcattcaatctgaagcggttttttacaacatggcgtacacatggcagtccaatcagcaaaacaataattaaaaaattgtgtggtcccaactgtccaatatttctctcttctccagctcaactctagcaggcagacatggtgaggagggcgctaccgttgctgcccctattcctctcttccctctcttaccagtatctcagcaggcgaggctggctccagcgaggcaagcggcatccactgccacccctcttcctctctttccccagatcgacctcgggaggtgatgcggactccgggtatcgacctaaggaggcaataaggaatccggcgaggcgggcctcgaccacctattgacgaaaaatctgcgctcagtcgatggtgccagaactgtgttggcgcgaactaagtcaacgaacacaacagactgggagattagcttagctccagtgaaggtccaaaggttgatgagatgtgggcgtgtcaatcagtttgatcctgcaactgacaagatatacaaatagcatatcaatgagccgatcggctgacaagccgatggaataattccagccgatgtcgatagggttttgaacaatcgactaatggtaatgtaattaaaccataataatatccagtagaaatcaatcggctaacaatgatatgatagaataatcaccgatccgaaggttaaaacatacatcggctgaatatccgatgtcatcaaatccacaagattagacaatgaaacatttgttgtgatcggctaaatccaacatgtatgcaatccttgtaagccgatgcaacgtccagatacctcattggctgaaactctgatgaaacccttattggcaatcaagaagcgggctagagattatgattctaagcacgacttagtagatcaaacttaactgatgctgcactaagtatgaaaagaaacataatatctagacaatcaagcctttgactgattttcagggtggtagataccttagctaatctaatatggtaagcgatttagccgataccaatataaaccctaaagcgaatgtcagccgatacaagtaaatcgagctaccaaactagattatctaagatgtatgatagataggtgcttagattgacaatatcagagtgtcgaaaccctagccccgccgatgcaaatagccatgacaagtataaactcgtcgaaaaattagaaaagtaaaaaggtggcgatgcgccgaagttgtattgatcgtggagatagtttacaaaaaaaaacctcgggtgtacatatttatacccatgggtagatactagtcgttgttggataagaaagaaacttttctaaagatagaaggaaaacataaagtctttatgggacactaaacacactttcctaaagataaaagaaaactaacaaactcttcctaattaatagataatttgacatgccgcatcctctttgaattcagtcacttctggataagcttcccttaatatattaatttccttaaccgaatcctccaagaatccgactgctagcgacttgataactcccattggccgattccagaactctgaagccgatactgattttaggtcgataatgtcttcagggcttaccaaatttcactgttaacaccaccgcagccctctttcccaggatcgacctcaggaggcaatgcaggcttcggcgaggtagggcctcagacgccaccaacgcccctcttcttcggcaccgacgagctgagcactggcacatggtcctcgcagagtgcatgctacctccatggttccaggtgacagagctcaaggttgtgaagaggcggcgaccaaaagaggagcttgtgcggaggcggcggtgagctcctggccaacgagcgtcgctgcgcccctcccccctcccccctcccccctcctcgagccctcgccttttgcatcaccctcccaccagccgccgtttgcatcatcttcctgagcgaatcctgcaaggctgcaactctgtcgccaaccctgcctccaacgcccttccctaggaaagcttgagctctgcccgtagccacagctccccgccgtcgaccagagattcttccccgccacgcccgccgttgactagaggcccttctccttagttttacatcactagaagcattgttatttatttcaacttgatctgttgtagatgtgttggaggcaccgacagagccaagctcgctcggggaggaaattaatgggaagaggaaatttatctttttctcccttcatgtgccggccttttgcttttatagttaattggatccatgccaaaaatatatcaattcagaaaaatgccactactatatattcaacacatctgttacgtgccactggaaattgggaaaactagaaccgtgccactccatcatgttatccgtcaaaaaatttgttagcctcaattgcaagtgggacctagctgccagttcctctcttttctttccccttcctctctctccaccaccgtagacggtggtctcgagctaacggaggaggacaagatcgagtgctctgacgacgggggcggcatcccggcagccgcctcgggctcccgtgacagctgcttcggactccgatgacaactacgaggaggacaagatgcagtcgccgtcatcaaccccctccgcagtgggaggcctcgggacttcctctctctccaccaccgttgcagccgccgtcgttgaccacctccacggtgggaggcctcaggagccactgccgtcgacgccgtcgtcttcgaccccatctgcggcgggaggctcgggagccaccgatgtcaccgtcgtcaacctcatctacgggggagagctcaggagtagccgccgccgtcgctgtcctcgtcgtggtcatcagcgagccgcaccgcctccgcccagatcaggcgaggagggccgccggcgttgtctatggcgatagaggaggatggaagaacagctccgcactgctgatggaggaagcgtcggtcctcgagctccgccgcgtcggccttgagcttcatcaccaatgctgccgacgcccaacgcccatctcgtctctccaccgggattgaggaagaagagagatggaaggggaaggggcaaaagtgacatttaacagggggcttagacataggttgagagataattggacggcagtggcgtggttctaattttcccaaattttagtggcacatagccgatatcgtgaatagtatcggtatttttctaatatgccatatttgcagtggcatggatcaattaaccctaaaaataataggtttatcaatatgttttcttttaaggttgttaacataaactaagttcttggaggcttaaatgtaacaaatactgaatatttgggagatgaatcagataaatctggaaaatgtgtcatgcatccaaaatatattttttttcatgtaaagtcggaacgtaattcatcattttacatgaaatctgagaattcacttttaggcatagtagtgtagaattttaagtgaactaaaattaatttagaataatttcaatctgatgaatttgctcatgcgtaaaaatatattgagactggtttctggccgggccaaacaaatacggggagctacagttagccgaccatagataagccaaaaaataaaaaactgactctataggttagattaactaggtgattccccgtgctttgctgcggaaattcttaatatattttttcgacaatcaaactaggagtgcaaaggaaaaaatgatgaaacctcacatatatgccgtacttatcaagaaataaacaaatgatactcgcactttaatgtgaaacatattgataagtatgtattaaatattataaaaataatagatttgttaaagtattgtgcaaatgatgtgaatgtgatgattggatatgtttgcatgttgatttgtggaattaaataaattgtagataatgtaatatgcttgcgtgagattaaatatgtaattattgctagtgggtgatgataacgcatggttgtatgttgagctttagatttagtaggctataacttttatagaaagtcaaattaggagtacaaaggaaacaataatgaaaccttagatatatgcagtacttatcataaaataaacaaatgatactcgcgttttaatgtgaaacatattgataagtatgtgttaaatattataaaaataatagatagatttgttagagtattgtgcaaatgatgtgaaggtgatgattggatatgtttgcatgttgagttgtggaattaaataaattgtagataatgtaatatgcttgcatgagatggaatatgtaattattgctagtgggtgatgatgtggtatggttgcatgttgagcgcttagtaggctataactttatagaaagtatagattagtcatagaagcccgaaatcaaaggtcatttatatttatattgtgtgactacatgagtctagaattgatgaggataggggcacatttataattttttatttagtggatcgaagaatgaaaaatatttaaggatgaaaatgcaatagtgcttgacaaatggtctggcagagccagggtttacgatttcgagatggccttctgtttcgggctctagcggaatgacggttttcacgaaatctggtggacaacctgtagattccgaacaaatttcacaaaccaaaatttgaatacaaattttctgagattaccaataagctcgcaaaaaccggtcagatttggcaaaattccgagcaaaatcatcgaaatttcaatcggtaactagaaaaagaggtaagtatttttttaatttcattattcttttctttcctactgtaaattaatacattattttttaaaaaaaaattatcccaataggttctatgaagatcatactatttataagatttttttctcttttttatcaattcaaatttaaatttggatgaaactcattcaaatctcaaatggtttctacttttgagcctcgtcgaaacgtcgaaatttcgtgaaattcgactggttttcgtcggaattatgaacctgggcagagccgttccatctattctccatggagacgttttcagaacttttcccgtccttaattcaacatttatctgtgatgtgatgtacgccacgtggtccaatcagacccaatacaatccgccggcttgagaaggagggatgatgatatgtttagttgaccgaaagctaaacaatgcaaaaaaaaattctaaaactatattttataagttaaaattgaccgcagctcaaacaaacgagtccaacaaattaaataatccacgagttcattatcatcatgtaatgaatcatcatgaatccaaaaatctataaagtttatcctcactatactaatgttatttttctcttctattgtaaagccatatcaacttagttgttcttagtgttaaatgattcatcaaagatgcaaattaattctcttctaaaaaaacatatcatgcatcctaaccgtttataacattcaaatatttttttaaataagcaaataaattttataactcacatatactatttatcatgtagtttttttttaataacgcgtgtgatttctatctagtaacaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcggcgtcggcgtcggcatcggcgtcggcgtcggcgtcggcgacggcggcggcggcgccgttgctggagaagaagatcacgtactgggaaggttgccctggctgcgccgtcgagcggaggaaggcggagaatcccggcgtcccctacctgcagttcttccacatctggatcatcatcctcgtctcctgtacgtaatttcatatgtactagctcagttagcttaattaggacactaatttaagtaattaggattgtttttttttgtcctggaaaagattcctcctcagaatttgttgattagcacgccttcttacttaattagcttaggtggaagttgcttaagagcaagtttaatagtatagccaactactagctccaattcatctatagccaatctaatagctcattcatacaatagttacatactacactattaatatatagtcccacctgtcatacacacattacgtcttggagttcgtactacagctggctacaaatctgtagtccgctgctcttctctctcctcatttatcttcttaaaatatgtttgcagctggcttatagcttgctattgtacctgctctaaccgatgaggttccagctggtttcattcggcagtttattattattaattactttctcttttcctgaataattatcatcgttgactaaggttgtttttactttgattataaattaattttaaattattatattacgataaatgaaagttgtatggttatatttgtatcgctacactacaataatataacatatgtttaaaaaaaatatctgtattttaaaagaaaactagttaaaatttaaacttgaacaatgatcgggtcaattattcgataacggagaagagcactgcagagcagagtgagtgatgcctaactgttatccgtccgggtcagtagatatataacgtgcgcgctaacattatctaatattccctccattacaaaaatcctaggctgtttagcaaatactatgatcagatcaaaattaagattactttttactcaattttttgaacttttaagtgtttagattatgtttccaagcatggctttagaatcattgaaatgacgagaataatgcaaattagtctaggaatgcttatatagtggtacaaaatttaaatacaagaagcccttataattaggaacggggggagtatcacagtgtcgtttctagtagtacatcagtacattagtagtctacacgaagatgttcaagtgttaacagatacatcaatgtgatattgtttctttttgctgccctttatttcagtctttttttttccatatgttcagtttagttgttttgtaattgtagcacgtttgccgtctgctataaaaggtggatttctaatattttttttctttttattctaggtttgccaataacatttatatatcccttcctgtatttcatggtaagtgcttctcattttaaaagatcaatagaaacaataattttcttatccacgggattgcattgcaatgtagttaggagcttaggtatcatagtggctctgacagccagctaacagccctactcacttcttcccataaaaaataaaccttgtacgagatgtgaaatatcataatactacaaatttgaacataaggttatctagatttgtaatactagatttgtaatactaggatatataacatctcgtactatgtgtaatttttataggacggaggaagtgcttgtctcagtctcactgactaaagaacgtagtagagggcaaagaggacagtggcagcagcatatatgcaaagggaggctagggtggggtgatagggaggcgaagtagagtgtagaagaaaagagcccaaggagataagggagagggttctggctggtggagactagagacaaattagggtttaagggtggaaagtatgttatataaacttttggacaacaaatatgataacacttaaatggggacaaaatggaaaagattattatggatacgatttttgcttagaaccttatgtgataatattaattatggttttcaataaaaaccatctaaaaattatatttttaattatgttttttgaatagctcatgtgggaaatcccattgcatatgatgtttaagtagaaccatctataataagtttgtgtgacagtgttaagaaaccatttgcaataaggtgtccctacgacttctttttaggtagtggatgttactcgattctcttttttaatgttgtcacaacccactaaacaactaaaactcaacatgcaagcatattaattattattagtgcatcctaaagactaacatgcaagaatgccacgtcaactcaataggtacctaaagctcaacatgcaactatagctattacatatacaattttattacatcctaaacctcaacatactaggatgctaaaatatcattcctcacataatttttgtaatattaaatttcaatccgaaccaaatctatccatgtc

SEQ ID NO: 64817 - DNA, 711 bp, Oryza sativa
attcctgcagcccatttagcaggcttactattatatttgctctaacccaaaaccaaccagaccattttcccagcgttgtgatttgccccattcgcacgccaccaccaccggtggatttacaccgcatcgctgcgcggccgcacgacgcacgtgatcccccccacgcagccacgctgcggaggcagaggtagcgcgcgccgccgccgaaacaacccaacccaacccaacgtcccgacccgatcgaacaaccaccgcgaaaacagcgagagacgtgcggcgcgtgcccgcaatttctcgtctttttttccgcgcgggcgccgcgcttccctccgctcgcgtttcacgtgccgctttcctacccgagaaacaaagattatactaggcgtttaggcctcgtcttccttccttccacatgtacacctagtatataacaagagggagacaggctacagattcacgggaaggtttcgtcctcgtttcgtttcttgcagcaggaagccaaagtgtatttcccgagctttgatgtgagctagctgattttgctagagctacaacatggccggtagtagcgagcagcagctggtcgccaacgcggcggcgacgacggtggccgggaacgggagcaggttcgcggtgacgtgtggcttgctcaggcagtacatgaaggagcacagtggaagcaacggcggcggtggcttcttgccggcggtg

SEQ ID NO: 64818 - DNA, 696 bp, Oryza sativa
tccatagcgttttattagcccatgtggaaagatcattttgcttttgtgcttggactcaccttgccactcggctttatggtggagctgtgcatccaacgattcgattgtgttgatcccatctagattcgcgcggtcatggtaactgagggcaacggaaaccttatggtttgtcgatatgcgaggacatataggcagctggtggcctaaggggaattgaaccagtggcaatgccttgggtaaggatgagccgattgcccaaggaggatgaggtggaggtgggagtgcgcattgaggataagccactgatgacgtcttatgcgaggttgagcttgtcgtggcggccagagaaaggacgcaacggaggtgtctggtgaaggaatcgaggacaagccggcggtgggcaaggagacgtggcaccactaaaataaaatcgtttgtataatggtatttggtaaaactcgatggtgaaatgtagaattagtagatgtttctggatagcaaaatgttacaggcttcaatgaaagagagacccaaaataagatcgggctagatttgtggtacaacgagaagtcccacaaagctgaattcatcaaggaatgggttggattttaaacagcaatattataggcttttggattgaaaatatttcttggattagcccaaacctaacaagcccaataaggctgtgggctagat

SEQ ID NO: 64819 - DNA, 704 bp, Oryza sativa
cctgcagccaacctgggcctccgcgacggcgacctggaggcgtcgcgcgccgcgctccaccgcttcggcaacacgtggagcggcagcatctggtacgagctggcgtacctggaggccaagggccgcgtccgccgcggcgaccgcgtgtggcagctcgccttcggctccgggttcaagtgcaacagcgccgtgtggcgcgccgtccgccgcgtgcgccgcccggcgcgcagcccgtggctggactgcgtcgagcagtacccggctcgcatgaacgcttaagctgcagtggtaagtatgcagaggctaatgaacggaaaattactgcaacgtcaaaagacgggatcggcatgcgatgccggttaaggttcaagcttgattaatttgtgttggtgtattagcaagtcggtttatgagccatagactaccataaaagttgtgcgagacatgtgtactgaaccagtgtacgcgagttcggtgatatgtgaacttatctacgtttgattctattatttatactgtcatatgctacttgaattaacctggtggctgtttattaagtgttgctgcaatggactgatagttgttcaagtatatgtgttttatttggtccctggactagcaagatagggagcatagcacacatttcctttttttaatagagtaatttttacaaaacttaatatatttttatcaaactatcacaa

SEQ ID NO: 64820 - DNA, 1181 bp, Oryza sativa
cgtggctctacagcctggcccagcccccgctcctcgcaccgcgcaaggcgcggacacaattggggggcctcggggtggcgcgtcaggcccctcggggtgctatgtcagcctctcggggtgccacgtcaggcccctcaggcccttgccctgcctggacccaaggcccttgcccagctgccatgtggcgaggggggaccaggctaggcggtcattaatgggcggtgccccaaccgtccctcgaagcatttagtgcggtcagggcggacgtgtggagccacgccactggcccgcctcaaatcgggcgtaaccggtctgtgaccggcctgtcaccggtcacatccgattgacgcgcggccatgccccacgtctcctttgtccccggtggagtggaggtagctatgtattgtcacatcaggggcatcatctggactcctctccacgagaggagggcagccaccggtctgcgctcatttaagagcgaatgacagggctgcccccccacccccccccccccgtgtcaggtggaggacggcgccgggccccaccaaagggccaaccgtggcttggcttccgggcgaaggcattcgctcgtttaagagtgaatggcagggctgtcccccgtgtcaggtggaggatggcgctgggccccaccaaagggccaaccgcggtttaacctccgggcaaaggcacgggccgcggattggccacgggagggtgcccccctcccttctccatggaagagtaggtagaggcggtgcatgtggtatccccttagactataaaaggaggaccgtgcccactaaacaaggggggatggttttcttgaatgaagccaaggcaagctctagcctcaagttggtgatgtccttggtgcagttctagagtcgatcaaagtagaataggagagacaagctctctggagctagaggaactcttgtacttccgatctatattcccacacacaggagtagggtattacgcttcgtagcggcccgaatctatatatccctttgtgcttgtgtaagctttagtggctttaaccgcggataatcgacctcccagagtgcacctcctcctccggccgaactcacaaaaggggatctcacgatctcccgctagagaggattactcctcgacagcgtcaaatattcatgatcggagggagtattatttagggcaat

SEQ ID NO: 64821 - DNA, 527 bp, Oryza sativa
ctcagaaataagaaatcaacatactactgacaggttagtttttcagcaagctctcagcaagcagagagcttctgttcttgaacatattcacttgctcattgttcaccatcctggttaccttgtacagcttcaagctgcgactcgaagtattcccaggcagcttgcccagaactgatgacctcttgagcacagacccaagaattttgacgaccatgttcttcatcctcatcatcttcattatcggactcttcatcatcatcactgtcagactgttcatctaagtcattgctcggcaacttgtcactttccacaggacctgaaaaattttggttccaattcagttgtccattgactccattcaacacatacaagccatttgaatcacagtgtaatatcataaaggaaaccagagtcaaattaatcctaggtatattgtaaggctacatatcaatcctagcctcctaagtgttgcaagggcacatatgcatcaaccatcaatgttgagtaaaatttgcatctggttcaga

SEQ ID NO: 64822 - DNA, 913 bp, Oryza sativa
gagcttggctagcttgagctagagcactcactctcactgatcacttgctcacacacacacacacacacacacactcactcacctctccaaccaacacggcaacacaccaacacaacacgagtatttatacatgaattgccattgccattgccatggccttcttcttgatccccattgtgaaaataaagccaagtgctcctaagctagctagctcatgagacttgtttctatgtgcatgtaagatgcatctctctatctctcttttcatgagaggaataaggtggttggaggcatgtaacatatgtgttgagtatagtacaaataagtggaggagagaagaagggcaacagagagaggggctatttttgccagaaaaggaggaatcgttttcatcccaagtacttccaatggtttcatgcccccatttggatctcctctctatatctacagcctttctggttaagctagccctcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaattgtatctcaggtgttgatctttcagtttcctatagcaatgcgtgatatttgaagtattgttagtcttagaaatttcaggatggctagtgtcatgaggatggattctaatctctcgggtggacatccactcgtttcttgcatgtcacctaaatgattatgaaaaaatttcaaaacaaaacacaagatagtttaatatgtaatatatcacttcacaaacatgc

SEQ ID NO: 64823 - DNA, 1255 bp, Oryza sativa
cgaaaggcgtcagctcttgcagcatccggtacgccggcgacgaccagttggccgccggcggcgacggcgacgacgccggcgtggccgcacaggagatccggagcttgaggcatcgggcgaagtagtaggccaggtgatcacccgggcttgttgcttcacagcttcttctgccggcgatgtcggcgaggaggtcgtcaagcctcgacatgatcgccgaggcgtggacagcgtctccggcgtccacggccatggcgccggcgaggagaaggtcacctgcgctctcctcctgggttgccaccacgttgccgttctcgtgccctgccactgctaatctctcatcaaattcaaagctagctgctaatggatcagcattggggacagagaaatcatcttgcagttgcagcaaatcattagcagattcttggattgccatcatttccaagaactcatgatcttgatgaatctgatcgtgagagtgatcaccatcaaattcattagcagattcttggatcaccatcgtttccaagaactcatgatcttgatgaatctgatcatgagagtgatcaccatcaaattcattagcagattcttggatgaccatcatgtccaagaactgatgatcttgatgaatctgatcatgagagtgatcagcatcaaattcatacatattggcattctcatgaggattttcttctgcttgaggagaccataggaggaggctactgctactgatctcttcaaattgtgtggagaagggaatgagaagggagcaagggtatgacatggtctccattgatttgttttgtgatttgagctgttaactcaacatgaattgcatatgctctggtttatgtggttttacacagtttatgtagacaaggatgaagcgggtgttaggaccatttctgaagataggagtgaaataaatttatatgtgtggacctaggatcttcatggctaatgtaagctgatttgtctgatcttgaagccccaaatgggacattcatatgacaaaggttctttttttgttgcctttttgtgtagttccctctaccaactttgtaagatatgtgagcaagcaatcgtgccaatttttctgattgattagaatgaagtagcagaggaagtgagcgtgtgcatgccaggcaatattcctgaatgcttgttgctagatgtcagcatgtggtttagttttgaatcatatgagcaaaacgatttatgcatgattctacaacctgtggacaacggggtgcag

SEQ ID NO: 64824 - DNA, 5658 bp, Oryza sativa
atatgtttagattcattacatctatatttatgtgggcaatgctagaaagtcttacattgtgaaacggatgaagtattttaatattgatgagaaatatatattgtaattcctacactttggtgttgcttaggttcacaagaaagaggaaattgtcctttatttttcagttaggatttggacaagctatatgttctgaagaaatttgtattacgagcaaacggatacaccaaacatgctgaaccgccaagcaaattattccagtcaggcaattggacttctatgaatcttattgtatcaaatgcacatgctcagaaatattggcaaagctaacgaattctccggcgaggtatgtgttctccgatagatgtgcctcgtacacctccagcaccttcttcaacttctccacagtctcatccacgatcttctggttggttgggatgccatgcaaggccgggttgatgatgcactggaacatgattggcgatagtgctggattaaattggtgcgtctccacctcggtccagagatccaccatggctgcctccttgaggttaccttcacggagtagatcgacctcgctcgtcttgtaattgcggaggatgtactttccgattgcgcgggactctgaaacagatgatgcaatgagatttctttgtttttaaccatgttttaaatgtgatagtttattttatagtaaaaatagttacgaaaatagtttgcacgcctcgtggtggaatctctcctttcttgaaatgcatataagtagtaataaaattttttgattgagccgaagaaatctcttttggctgttggatatgccagtcatttgtttggctctgtgttagcaatcatgatgacagaaacatttccggtcccttcgaattacaggattgagaaaacgtaggaatataaaaaacgtaggattttgataggaataatgcaagtgtaaaacagaggattgcaaaacgcaggaatgaacgtttgattgaaccgcaggaaaaatgcaggaattggatgagagagatagactcaaaggaaagttaccaagaggttgaagctcttgctaaatttcctccaaaatctctatagaattgtccattccataggaatttcaaaggattggattggattcaataacaaagggcttcataggaaatttttatacagaattgaaatcctccaaaattcctattattttcctccaaatcaaagggacccgaagaccatgaattaatcatgaacaatagtagccaccgacagctcccgactcattaaatttagaggtaaaaaacagagtaaccagaaagtattaaaatggtacaggtgcatttctcgggtagataacatatataatcgtcgatagtgagacatctattatctattatgatttctttaatcttaagatataccgactcaatcttcaaaggagctaataaagatagggatgtacgtgtgtgcatttattgggtaagtgtgcatgggtttatatgagcgtatgcttgtgtattgtgttcataaaaaagttgatataattttttctgagttatatttaattttaatcctagtgtccataatattttacacatggatgtatattatttagtgagattaaacatcagaggttgccattaacctctgaatttttaagaaatcgtaagcctccgtctctttaacaaatgaaacaatatatgaaatgtaatgtttatcccttgttcgtatgcctattcaatgtaatcagaaaaaaggctgataagttttcatttgagagttgagagcaagaattaatcgaagccaaaatcaagcatatatactaacaaaagagatacagatccccgtcctggaaagctgggatttgcccaaacggctgcaagaagagaaagaaagcaccattcatggcgtcgccaaattcaggaattcaggagcagagcagaggcggcgcgctggtacacgtacgtacgttgcgctggaggtgttcgtggctcttgtgttccttggccttgaagtcgacgttgtgcggccgtctgaggtcccaaaatctaggggccgtatacacatacggtatatatactacgtacggtataaatttagtccacgtgccatagatctatattaagttatatagctgaatagcccaatacagaaaataaattttagttcatcgttaggcctgttttagcgaagccgaagcgatcttcatttgactcccatcgctttgccttgatcacatcacgccactcgcgtcgtgccgcctcgatcacgtcatgccgctcgctgcttctgcgctctcggtgacttctcggcgtctcgcaaacgaaaacaacaagttggcaaatcgcgactcgccaatagccacgctcgtgtcgatcgtccgccggtcgacttctctgctcattactgctatttatttttctttgaagttttaaaatgttatatatagataattttgtcacatcgaatattaaatggtatgtgtttataagactatataaatatataaattagtttatctatacatgtaggggactccatgtaagtttttgccctcggccctaaaaccccaggaccggtcctgttcaccggcgccatattctccgcgcgcgatccgagttcatggcggcctcggcgtgtgcaaacagaggatcctttggagctagctggtgcctggtggtagctttagcgtgcgatttctggagagaaatagatggattggttggactagttggtgtggtgtgtggacagtgtggtgtactgttcttgtgggacaaaagaagcagaaagaagagcaaaaatgttatcgcttgatactttgatgactcgtctagggtgaggtgagtgtcggtaatgtacagtgccttctacaaacaatattatccttttggatttggaggattctgaaggtcaaggtgctggtgcttgagacgtcagctccatccgaactgggataaaggcccttcaaactttcaacttttccattacatcgaacttctacacacgtaaacttctaacttttccatcacatcattccaatttcttcaaacttccaattttagcgtggaactaaacacattctcaagggtatatccccttgtttttgcatgtcacttaaaaaatcatcaaaaaatttaaaaaagatttatatgatagatcaatatgtgatatgtcactttatagatatgcatattcaaattcaacttatacaagtagaaacgaaaataataaatctgactatgaaaagaacgagtaattcacaatcaattttttaattgtataagtcaaattttaacttgcatgtttacgaaaagatatttcatatatatattgatctatcttgataaattttttaaaatttttttgataaaattttaaataccatgtataaaacgataggatatccttcgagggaaaaatacacttccatcatcattcgcattcgcgctggggagccggttgcgcatgttacatgttgtaagaaaggacattcaaccaaccacacaacataatggtgggatgctgtggaacaggatcatctgacacacagtgatattatgtgtgaggatgtggttgcttttctctattgcgattagcctgttaggtgtaagatttgtagggactcgaatagatgggatgcctcatgggcccaacgagctgctaggcgtgagggtgaaactataaagcgaactaggtgaaaccccgcgcgttgcgatggacacattagaaaagattaaatatggatgtaagtataaaatgtctagcagatgatgtgggaatgtatgctatactataactatttttatttccagatgattgttcagcagtagctgctggttcagaggaaatggatggttcagcagattgccgctctgaaactgatggatgtgcatagtttcgaaaacagtataagctggacgttccattttttttaagagactaaaacagtactcagtgcataggtcccctttatgcccgaaaaccacaatgtatgctcaaatataattctgacaaaactcatgtgaaattcacatatactgaactgactcattaaagcatccaatagttctcatttctttttttttttaccagagaacagtgggggggggggaagcccccacggttgaatttcatttataaaagagaaaactggaccaaattgacattacagatcatcaatccatgattgcaaaataggtctatcagctaacttaagcctagataaatgtaggcttaactcttctcttaaattcagcttccaacacgggacagatgttcgaaagctattaaagatgatatcatttctttgcttccaaagcaaccatgcggccaccaaaaaaatttccatgaaacaggcattactgaatccatttatctgagaatgaatcatctgatgaaattccaaagaggtatcccaccaaagtccaatagagttccaacatgcagtagcaaaagggcattggaagaacatatgctctcttgtctcaggagttcccaaggaacagagatcacaggaaagagggacattggggggcttactgtgctttctctctagaagatccctggtatttaatctgtccaagaaaaggagccatgcaaacacctttatcttcatatagactttactggtctatatccaagacaaacacaaaggcggttggattgaccagaaagaaattttataaaacttatgagaagagtaaacattagagtcccagatgtatgtccaaatgtcggccgaagagtttaaacttatctaagcaatgtcctccagatatagtttgtattcatcataggcttgaactgaaagaggtaaatagaattgatcatccactgccctctgtaaatgttgttggacaaagtcattcttgtgcctgacaaaagagaagagagtaggatacacctgagcaaagacctttccattacacaagtcataccagaagctcactgaagatccactgttaattgttggccttgcaaaacctctgaatagaacttcaaactgaacaatgtccttccaccaaaatgagccacaaacactggcattttgaggcaatatcctagagtaataggaattccaaatcagtttaacccaaggtatctgcatatgctggttgaaaaactttcctaactgcttgaggagaagggccctattttgcactcacaaatctattacacccaaaccacctttcttcttgggcctacaaaccttcccccaggcagccaatgattttttggtggaagttaaatcctttcccctccaccgaaaatgccttcttactctatcaatattctctatcactgccaccggaagctgaagggagcacatatagtaagtgggcattgctaacagaactgaatttacaagagttagcttatctccataagagaggaaggaagaagtggccacaagtcttctttcaatccgatcagtgagaggagaaaaatccactaccttgtgcttagaacaactgagagggagccctagataggtgaaaggcagagaacccaggacacaaccaaaagtctttgccagacaatcagccttctcttcatccaaatttaggggtatcagacatgactttgcataattcactttcaatcctgtggaaagagtcactgtattcaataaagcttttagagctagaagtcgtttcccgggctgcagga

SEQ ID NO: 64825 - DNA, 1021 bp, Oryza sativa
attagagttttttctcgttttacgtgcgagcgtgtagctctcgtcgtttcggaagatcgctttcatgaggatcagagttcggaaggttgttgtgaagaagcaaggcaagtcactgtaacatcccggcctagggcttaataggattaatagaatacttatatcaacaagttgcaacttcttttccggaagccaatctccaaagaacttcagggttaagcgtgcttggcctggagcaatttgggatgggtgaccgaccgggaaattcttctcgggtgcacacgagtgaggacaaagtgtgtagaaaagacatgtgttggcctgtgagggcagtctatgacctatgaaagctatcagatgtaagcgggcccggcctgggggaaggcgggacgttacaaaatggtatcagagccgactctcgcggtttcacgggcgcgtgtgtcgcagttggacacatggacgtggccaagagaggacgttcctggcctagggttgatcgacgggggcgtcgatctctcttaagggggtgagggtgtaacatcccggcctagggcttaataggattaatagaatacttatatcaacaagttgcaacttcttttccggaagccaatctccaaagaactccagggttaagcgtgcttggcctggtgcaatttgggatgggtgaccgaccgggaagaattattcttcccgggtgcacacgagtgaggacaaagtgtgcagaaaagacatgtgttggtctgtgagggcagtctatgacctatgaaagctatcagatgtaagtgggcccggcctgggggaaggcgggacgttacagtcacacattcccagaattttgatcctaatttacaaatgttttatcgtttgcaaataaaattgcatgtcttgctaattacatgggatctgggtattacctatctgtttgcttgtgccatatttacttgatatctgtcctttgtcaaccttgggtaataaatcgactagctcatgttacgacctatgaaagctatcatatgtaagt

SEQ ID NO: 64826 - DNA, 2301 bp, Oryza sativa
tcttcagatgctgtatggggaccattgaatgctggccacatcactgctgaaaggatttttaccttgtaaccatggccaagagcttccctacgaagtccaaggctaaacataagaagaatttgtattttacattttactgttgactgtttaattgacaatagtttcttgggatgttccttgtgctttgagcacagatgttgcagtttgcagtttgttgcaacaactctgaaaatcatctgaggaagatcagtcaaacatctgttttgagtaaagggagctgttcttatttggttaacttggattagttgtgtgctcaacttatgattcgaaagtagagaaaaaacagcctgctcagattggttacacatccatgtaactttgttcaaatccggacagacacacatcacatatagctgagtgtttttctcctctcaataaaatgatatttgacatatacactgtaccatagttcagcattagaaatttcaataattttttcttctcaaatgttctaaaattgccacaaactacatatttcggttttaaatttcctcgtggaaaaatttggccaatagtaggtcttgttgcaatcgcagacataaaaggtaaccaacgatgaattatggattatcatgaccacaagtggcgtaagctttctatacatctcaataaaaagcgttctttttctatccatgtccaccatcactatttatctaccaatacaggtgcctccatctatattcactagagaaaatgtttcatacatttattctttctttaccggttttcatatatttattctggattgacaagcacccaaacaagataataaaaaaaaaggtaaaatcagatgagcataatttgcagtttacaagcagtactctgaatttcgatccaatgcttctccggtacaaattttgaatggcacaaattgcgagaacagcgtaaaatatgttgtttcccagaagcaattttggcatgggaagcatcagaaattgggtgatgtactatagagctggatgaaatgcttgatatgtactgagggcacaataatgtttattccactgtcaccaatcattcttcttatcaccaacttgggatttcagctatgcagaaatatctggacagctttatatagttgatctgggcttgtcgtaatatataactatcgacattaccaaggtagcgactatgcagtggtcgccctatataacaaaatttaatgtcatgactggaaattatcttgttctcaatgtcattaacttggtgagctgtaatatatgttattatttttgttgttctcaaaattgttcttccaaggtgatcatctcaaattgtaaactaacattcttgcaatattaagtttaggattcaacgaattcaaatttgatttttgaggtcatgagacttatactatgatattttgcatggtttttgtagaaccatgtgatcattaatcttggttatgaacaattgtcaaagttagggtttgttttgaagtttcgattctagctcatgaattgagagacgagtgctttagatgcactttgtaaacacatattgatgcaataaaatcaatttactttcaagagtttcatcgtttttatgtttttctggatcctgacggtctaacggagtacaatgggcaattagaccggcggcggcgagtaagagaggagatcgacgggcggtcacttccgtggtaaggcagtggtccaaccggtagcaagacaacagtcagactggcgattgtactacggttagtccggagttaatctgattgtcagattgagctacattgccacttcatcaaggttgaggataacttatattttagctgaaagttatttggtttttggcattcaaagcattcaccctactctgataggtttagctcttgtattcgatcatacagttttgatgtgatttctttccatagcattatcattacacttattgacggcatgattttgaaaattgttttgaagaaaaattttcgtaaatattatgaacccagacaattcccttgatggtcatcaccattgttggatccactaatccacacttgccctaccatttctgattgtctgttatccaccccacaaattcctctgtctgcttactcaattacagatatctccaaaacaaggaaacaaacgaaatcgaatggcatgaacaactgaagaatggtacaactatgttaccactgcaggaagccagattagtgtcggttcttagtttgatcctgcccaatataatggtctcatctggataggaaagatatcatatgtgctttttaag

SEQ ID NO: 64827 - DNA, 14442 bp, Oryza sativa
gaacacatgttttaccattaatcttatttaaaaaatttatccaaatatattagatataaatcatgcttaaagtactttgagtgataaaataactcacaacaaaataaattgtaattatgtaattacgtaatttttttgtcaaagacgaatgattacacgtgtgagccttttgttgtctaaagcaaattcttgtgataaactactctaacagtaataactccagtatgtcaagtactagtagagaaaaagagatattgtgtgtgatatttttctttatgtattatatatccatattaagttatccaaatggaactttggctaatcaccttaattacgagtgtcatacaaaacgaggtactcgtgtccattacttcgtctgattggaagatcgtagtcctccattatcgctactacagatttggtttttacatgctgcctgtaaaaacgtgttttccacataaggcttagcttttctgctaccctcctatatataagaaatttgaaattttgttttcccgtcaattgttaaaaattctcgccaaattaaaattttcaaattaagtggcatagaataaaaaggtaacatatatacactaacaacttaataaattgttttctatccacaatatttattaaagtacgtttttatgacagttgagcggtcttcatcctcggttgttacgcaacgtggcacacagtactacctctatattaatacgacgctgttgacttttttctaacgtttgactattcgttttatttaaaaaaaatatataattatcatttattttattgtgacttctcatcatccaatgttctttaagcatgacataaatattttttttactgaacatgacataaatattttcatatttgcaccaaaattttaaataaaacgaatggtcaagcgttggtcgaaaagtcaacggcgtcatacattaaaatacggagggagtattatattacccatcttctatattcatcaactctagcaagtaaccctcgtggatttgtgcacaaagatcgagggtgcttttagcccaaattgcattttgttttaccttttcttttgtgatgactgccaagccaattttttttgtcttgtagaaactagaaacaaaaacagaaagaaagaaatggaggatgaattcagcaaaatacagaaggaggtgagcatgcgaaaaaatagtaggcataagtaggtgtttctgcaaacagagttgcagatataggatcggtgaacacttatgcgtgatggctgcttggtacagcctatacagcacatcgtatccattacttcctccgtttcgaaatatttgataccgttgactttttaaatatgtctgaccattcgtcttattaaaaaatttaagtaactattaattcttttcatattatttatttcattgttatacttttatgtatacacatatagttttacgtatttcataaaagtgtttgaataagactaacagttaaatatgtgctaaaaaattaacgatgtcaaatatttagaaacggaggcctatttcagacataaatcaactgaacaggctgcctccgttgcagccataggaaatgcagcaggccctatacttaaagccactagcctaatcctactgtgtatactatgcagcatcatgaaaaatctactgccttgtggcaaggaaaaagaggagaattagttctagtgctccaacaaatatagtaaattctctgtatacacttgaaaattaactcactcaatctctctcatacccctaaaatatatacccggtcccttctatatttccgaaattgcaacttgatccaacgatgttggtttgaatacaagcttgaaaaacgattgaaaattttgtttgaatgcaaaatatctgtattttatgaaactaatggaactaaataactagtgcaaaagattttcaacataaattttaaaaataaaacaaatgtaataaattgaaatttaacaggacaatggattttttttctagagtaaattacacccacggtgcaacaacttggcaggtgggtgtaatttggtgtaataacttgaaaaatgagcgttctagtgcaacaacttggcaagaaggtgcaatttagtataagaactttataagtgatcgtataaatacaacaacttgcaaggtaggtacgattttgatacaataaattaagaagttgtgacaacttaattatttggagcatttttcatataaattcaaaattttaagtgcttgacaatatactagcgtggatttgtataaacatatttatatttttatcctaataactaataactctaataactaataactgagtcaattaaactggatgtagaaattattatatttcggttgatatttgagaaggtgaagaaaacaaaatattcttaaaggtaactgtatgtaaattgtatgtgcaatataattcttaaagattaaattcaatattataaggtaatatccatagaattattgtgtattggcatattgacatcatgaaaaacctcacctagcatatgcttagccaaattgattcaccaaaatactaaattgtcaagttcttgtactagaaagcacccacttgtcaagttgttgcacccggatgttcaattgtcaagttcttgcactatatcgtacccatctgtcaagttgttgtaccgtgggtgcaatttactcttttttctatggggagcattcatacaaaaatgagaagcacctaaaaaaattatcatgagcattaatagccccttctttatatgaatgctcctcatttttatgactttttaataaataaaaaaatatattttgtttttctttcattatctaaaaataaattttatcataaataatgtgtcacacaataaactcataactataatagtctcatgcgataaacttttatatttttcaacaatgcaattcataaatttctatgttcgtccatgtataagggtaaaatggctatttttatagatattagatgatcaactaacaatcaactgacggaacaagcatgcaaatgatcaatttgaaatttcaggggtatggaaaggatcgggcaaatttcaagagaatgagagggatcgagatttcaatggtatacgaggaatttatattgaagattgaaatattctcgtcaggcagtacaaaggagtagcaaaagttctcttcaaaaaaggagtagcaaaagtctaatcatgcattgatcttgttgttgtttggttccagcacgtgggaacgaagaacattgcctggcctgctattttccgtgttcactaccatctggtgagcatgttcagcttcgctataatctgcatttccatgaggccttccaagacaaagaactggagctcaccataggactaaaacaacatgtgggattgcatgaagctgtgtagatctctacactttttgtgtagtaccttctatgctgaaatataattttaaatttttgctttatttgtaaagaggactattgagttccaaattttcaatgctggaaagaacatgagcttccgcgaggcctgagtatactgtaataaagtgctagagtaaacaggctaacattaattatatatggtgaaaatgggtttacaaagcgttcgatcgagaagcgactagcagttatatatggagtagatgcatcacgcacatatatatctctagcttcattttaactccagacctaccattaatatacactttaaagatcttgattacagagtacttttctgagttgcaccctagcatttcctcgacatattttcagacggacacgttaagtcactatgcttcaattctgaattaaaaaaaaaagatccttccatataatgtcaccatgacatggctgatgcatggcccatgaaattgaagcggcctcgcaagctaaaattccaaggtgcaatgcataacattatgttttactccaatgcctgcaacaaaaattcatgaagtattggagtgctcagctggttataggattcggaggtgttggtaaggcagcttcagctggggatttctttgcaacattattcaggcagggctcttgccctagtgaccagcatatcatgtctatgatctcaagcagtagcggcatgctagagtttgtacaccattggagcaagaggtgttggaaatttaattagcagcgtctcttcttagagcattgctagtatagtacaattgcaaggtattgtctagtaatgccatcacatttagttatagtaaattggttgctgggttggtaaactgattgttgaaaaggtgaatccatctccaatgtgtctatgtagaacagttccccttagctacttcatagtatgtgttaaatctcccagtttggcagttttatcttatcttcagctaaatcctttcatggttcgaatacatgcagctgtggattttttttttagaaaaaataaactaaacagtccaacggtagaaaaattgggcgacaaactatatgtgtcgcgcacaactagatcctcgtcaaacatatagtaaagcaaaataacccttaaatgtagcctgtagaaggcccaaaaataacctaacccagcaaaatattgagatatataaaaaaaaccctagctctagccttatcctctccagtctccttgtctcccctcccgttcgccccatgcaaccagccacagagagaggcggtgcatgtcaccaaggcgcaccggcaccgtgcactcctctagatctcgtcgtcgtcagtcgccatctctcctcccctcctctcccctctggcctcatgtcctctccagtgtcccctcaccctccggtctcccgacaacgcacgggcggcgtgcggggaggcgcatagtcacggcgcagagcaacggcacggccgcgcggcaagggcgcggcgaccggcgaggatatgtgatgtgttgaaccttgaactcatgtctgtgtcatgtgtttgcttggctggctgagtgtgagtggctggcagcttgctagactatcatggtgaatggtgaagtgttgtttgtgtattgaatgtcaaagtatttgtggactttgtggaattgtggtcatgcatgcatttagttaatggatggaatgatggatcaatatgtgtttttgctgagttttttatgatactatttaaatattcatgctatttttgatagtgtgtcaattatatatgtacaatatttgtcctgtgttgattggatggagatgctacccctgcatctccagttggggttggggtcgggggcagggctgttttcgtccaatccggccctgccccgctccgttgccatccctagtgcttgaacatctagagccatcagaatacccgggagcatgattggcagcacatatatgggtagcaggaaagacgccatgtcccaagcacatcctcaacacaatctgttcgtgaatccggtttccactgaagcctcctaagccaaaagtattactgatcctgctaaagttaggaaatgaaatttatatataattggaaatgtcatgcatataaaaaaaatatcttcatttggaagtcatacctgttaaagtttgatgtagtaccctcttttttttattcatgtcctacgaagtatgaacaatacaatagagaacaagtgaacaaccatgcaatcagctactccaccatatgttccattcctttcgtatattacttttattgtgtgcaatatatggaaagggatcctctaacgtaaagttacctctgacgtcccgagagcagtggggcccacatgtcagtcaccacgttcctctgactttacgtcggaggatctcaatccgccatatatacagcctctagtgcaagaatatatttgatggcacctcaaccagagcaagcaaaagcaaagtagctatgctaacagagatatataactcgtggaggaaaaagattggagaagcatactgaatttgagaactactagggtagtattaacgaaggcaagaatggcccatttgtgagtagtactgttattgtttttttttaggaaaaatacctaaaaattctcttccaaacctgcaagagcattctcttccagatcttttaaattccaaaacatttttcctgttcaattaaaagtacgacatatctgttacgtacgtaaggagggaagttcaattaaactaatgagaatgtccggttaagctagaacgtgtggctgtacagccacagtgctgctgtagttctagtagaaatttgcttgctaagtcctgttgatgtactgccacagctagctgctcctaacacgggcaatattcagcatgttcttttgcgctagctatctgcatattgtttagcaacatgtaaacacgaaacaatcgatgcctacgttttgcagaatgatactctgctgctcaaacatagccacatccgcagcaaaattatgaaggcacgttagaaatcttgaaaaatgatggccgccattcctcaagtaagtgcaagtggaggaattcatgaagatagtctgcaactgagtgggccaaacactcattggagccatgccttccgtttctacctgatacctcccattcccaaccactcctgtaaatctctcaatgcgatgaaaatatctgagctcctgagcatacaaaatatactgacttgctgctgataaagatgttatttgtgctaaactagactagagggcagaaaggcaataatagtttggaaagatagaatatatctgttggtcactcttttctttcagtgcctatatgtatgcatagaactaaggatttgagaggagaacatgtatatgtttgtcttcaggggtttccatgtctttatagatataccaccacatcacttcatgaaactttgggaggcattcaagagtgttatatctccatttaacacaatgatggaatattgctggctaacttagccgacgtgtaataacgatggaaataatggagtccaactttggtaggttcaaataattatctcttgttaggaaacagtaataatacacacactcactccctctgtctctaaaaacaaatctacaccttttatttttagggatggagggagtatatatatataactacagaaaactattaaaatgtacctccagtacctcctcgcagaccatacaatcactgttcgtaaacttggcaaagacacgcagcatgttttgttatgtgcaagaaaaaatacgatattcaggttgttgcacaaggccttaaaataactaattgaaaaaaaaatgctgagtagctagatagttgtttagtgggtgcgttttcactcataaatatgattgtggatcgcttattatatgaatctaggatgatagaatgtgacgttgcttaataagtcaatctgctctacttgtagcaattgctcttcaattaatgcaattgcatctcaccatgagattctcatgtcatcagagcaggtacaatagcaggctataagccagttgcaaacatattttaataaggagataaatgatgagagagaagggcagtgggctatagatttgtagccagctgtagcacgaactccaagacgcagtgtgtatgacaggtaggaccatgtattaataatgtagtatgtaactattttataaatgagctattagatcggctatagatgaattggagctactagttagctatactattaaacttgctctcattccttctcttatctccaaatcaggacaattgtgaccctgtttcatgcattttctgatcaacacaaaatcagttggccattgtgaaaattcaatcaccctggcaaacatgactggaaatcagaaaggagtgcaaccaattgtgatgaggactgatttgggcttgggtggcatgaggacagcattgcgaacagtaatacattgcttttggacaacgcttttgggctacattcttcatggccgaagacattttccagttctctacagcgcacttgcggaagttctcgattgcactacgaattgattgattcaaagtttgattcattgtccaacacagagaaacattaaacaatataatcaggcctgactgctcaacaatggcccagtgtgtccatggagagatgtacgaaactaaagcatcaaatctgggcattgactgtggatagttaagtgatcgaagtccattgcaggaaccctgaggcctgatcatgtatacatgttcctagcattttaattcattgttgtcttttgtacggcatgagtaaaatacaagagatttggatataagcaaggctgagaggatggtttttaagagttcttttccgcaagtcacaattttttcatttttcattagcacattttccgaactgctaaacggtgttttcatgcaaaaatttcctatataaaaatttcttaaaatcaaataaatatatattttttaagttttcaataagtaatactcgattaatcaaattgttcttatccatctggccccaccccacccaccgctctctctccctctctctctcttttcttccttctctttcttctcctccttgatctctcacactacctcccatcggctctcttgcgcgcccaccccacccagtgtcggcgacagcctaacggtggcgcctcccctccgccagattcgcccgagaggggaggtgtcggcctggcgcgaggtgtagcatcgccctccgccagatctggccgggaggggaggcgtcggcccggcgtgaggtgcgacggcccagcgacgccatcctctctgccaaattcgacgggaggggaggcggcgacggcagcatctcccctcctccatatccggtcgggagggaaggcgccggcccagcgcaagatgcggcggcagcctagcaggagttgtgtgcttgctgttcatattgttcttcctgttgattgatgtgtgttcttgtatgtctataaattaaattgttgtatgcaatatttttcatgttcttggatagccttcaatctcagggtttgatgaatgtgcttgtggatggggaagctgctgatggggaacacgctcaatgcatcagctcgatttgagtcggtgcatcgagcctttttttggctcacgtacgcctcaaaggtgccgattttgaaaccagcaccaatcactcagagtcatcaatgccgccttcatggtgccggttgggaaatccgacaccaaagggggttttccaaccggcaccaatagccctttctgtagtagtgaacttgttagtctttaatttaaaatcgatgcataattgtttcattatcgccaggaaaattgtgccgtgaatagttttaaggccctcaaccggcggtctgatcggccaacatatggcggtcagaccggcccactccgaggaaaccggtagacttccaaactttggcaatttttcctattttaatccaaggtgtcaaatttgggtgtaaacaatatttttggccaaaaatttttgagatccaaacatttgtagagctctctctactgaacctacaacgtgcaaatcataagcagcttatgttaattatggcatcattcagtatgagacacgcttagggctgagaggaatcaggagaatgtgacaaccatttgcataggttcctagtacgagttggcaaagtaaaagccctagttatcattccagaacatacatgggcatcgtctgatcctctgcggtgcatggtaaaggaggaagtcgatgcaggctcatatccaacgtgggtatcgagtcaagcactgaagacgagggatacaagcgggccaacccgcgagtttatttatatgtcaaattaatgataattcatgagtattcgcgtcatggtccggtttaccgcatcaagatatgcaaatgggtcgatccataaactcatttataagttaaattaataggtaacccgctgatcaaacccgcgggttacatactaagtttacctataagcaggttcgcggacaagctcacttacacctctactgaagagacttgttagtacatgtttctgcctttctgctacttgaaacatgatcatatctgctaaattaaaattcgaatttaaattggaacaatgcatatcaattttcctccctgtgtgatggatctggattatataatgttgtaatcgctatgattgtatatgatatagttttatgcctataaatgaaaataagagatttgtaaatacattatttgtacatcaaaatgttgttgagttcacgtagctcaatcattttcccacttgcctgggaccacaaaatcaatatagtgctatcatatcgatggtataaaatgaagcaggatagcgtgtgagaaaaaaaagtatattatctccgttctaaaataattgtatttgtagtacttagaaattgtcccaaaataattatctctacagagtattaattatcccatcaatcacttctcattcaaattcgttatattctactgttaatcactctcatactttcaccaatggctctgttatggcaaaggactgaaccacagaatcgccaatggcccacatgactgtccccattcaatgtatccacatctctaaattcaacaattaatataacttaacaacaacacttgtgttttaaatcgctaacggtgttgtcaattatccaaaagtatgttttttctagaaactttctacatcactaatatgattttttctaaaaactttctatattagtgttacttagataaccatttctaagaatttttaggtctatatatatacttaattcatgagcaatttgctgtgtctatactctctgcacagttatcaagttagaatatactcatgacttcatagagttcaacggatcattttcatacatgcttgtgaccacaatgctaagatgccactgtaatattaattgatggtattaattgtttttaatagcatcaatcaatatacccaagtggtgaagccaccggtgtattcacttgttgctgtaaaatcaaagatgtttttgattgttattctgtgatgaacaattgccattggagattattggttttgatatttggaatttatttacgaagtggttttgaagatgattggatttacaggtgagtaacaggtgttgttattttatgtgaccagtcagaccgggcagtgtgtgtcagtcagaccggcgtgtatcgcgcggtcagactagcgcagcctgcggtctgatcggccgactctgtgtcggtttcggtttcgggttatttgtttggatatctgtgattgtttcatgattatggcttctagatggatactatgcgtatgtaatactgttgtttgctactaatgagtcaagttggagatagcttggtctcgggatatggtttctttgtttatttcatgtgtaggtgactcgatgcctcgggagagtatttgcggtgatggaccgggagtcggcttggggataagacgacgtctgtggaggtcagagatcatgcaagatatatacttaggctagagttgatgcacatggttgatgaagatttcatatggcatacgatggacgtattgtgtgcatatgggatgcggagtcgaatttggaaggagtccaaatttggtatgagtggttatgtaaagtttgtttcttgtaatagagggtttcctaaggtttttaggacttctagtatgagtttggttcgtggctttaggctgcctacctcgggtataaatagagggggagcgtgaggattcccggtatcgcttttgagatcaattgagttgagagtttagttagggtttcgagtttagtcgaaatttttgtaaggagtgctgttggtgcactttgtaagcacagagagaatcaataaagtcgtcatccactttaagagttcttcgatttgtgtttcaccgggtttcggcggtctaaccggcggtgcactggcggtcagaccggcagcgtcacagcggtcagaccggcggggacacggcggtcagaccggcttcggcaacaagcgacaagagctgatctcggcggtcagaccggagatctaatcttagtcagaccacggcaaccaggcagaccgcgatccgtcgaattcgagggtaacttttatttccgctaaaagttttcggtttttgggtataccaaccattcaccctcccccctctggttggcttagttcttgtgattcgatcctacaagtggtatcagagccttgttttcttcattggattttaatcgatctagagtttttgccatggctgctcgttttacaactaagcctcatgttttcgatggaaccgatttttctcattggtgtagtaggatgcaatcttacattgtggctgaagattatgatatttggagaaaagtttttcatcctgaagagattaatactgctgctttaaaaattgaatttgaacaaaattgtaaagctcgcaatattcttttcagtgggatttctcgtttggattatgatcgtctttctcatcttcaaactgcctatgagatttggattgctttgagtaattttcatcaaggaacaaataacattaaagaacttcgtcgagatcttttcaaaaaggagtacattaaatttgagatgaaacctggagaagctttggatgactatctttctaggtttaacaaaattttgagtgacttggatctgttgattcttcttatgatgctaattatccacaatctgagatttctcgtcactttttgaatggtcttgacatgtctatttgggagatgaaagttacatctattcaagagtctgttaatatgtctactttgactttggattcgctttacacaaaatcgaaaacacatgagatgaacgttctttctcgtaaagttgattctaagtcgagtgctttggtttcttcctcttcttctttagatgttgatgcttcttcatctaagccttcttttcttgctttatttaatgccacatccgatgataaactcgaacagatcgaggaggaggatttgactttggttgctaacaaagttgctcgagctataaataatatcaagttcgggaaaagaggtggtccaaatcgttgctttgaatgtggttcgattgatcaacttcgttcgcattgtcctaagcttgggagaggcaaaagagaagacaaagatggtgagaagaccaatgacaacaagccgaagggtacattcaaagggaggaagatcaaggagaatctcaagaaggcttttgatcaagtctacgccgcgtttgaagcactaagcgatgtagatggagagagtggagatgaagataagggaaagaacatctccggtgtttgcttcatggcgtgtggtgaatcggagtcagagtgtgaagacaatgaggtaagtgcttttgagaaatctattaatattttgagtgcaaaaagtaagaagtgtgagaagatgtatagaaaacaggagtttatcattgaatctcttaattctgaaattgctagattaaaatatcttattcctaatgatgatgattgcaaaagttgtgaggttttaatgaatgagatttcaaaaattagagatgttaatgctgcacatgatttgaaaaatagatcttctctagttcttagttttgctttgcacacacgcactttggatgtgttgtttttaactaaaaagttgttgcaaaaatatcaaattgcttttcatgctagtttgatgtttaacttgatttgtgctaaaaagttcaaacaatctcatgatgttttggattgctcaacatgtactttgaataagatgaaactaaaaaatgctttaggttgtgttgagtacatggaagatgttgtgaaaaccaatgagttgctttcttgccccaagtgtcgtaaaagcaaaggtgtcatggtagattgtgaaaattgtgctaatttggaaaaagagatttcttatttgaaaaattccttgcaaagattttctgatggtaaaaagaacatcaacatgattttagatcaatctaaggttagcacccataatcgcggtttaggttttaatccttatgctcataatactagacatcctcgtgttgtgttaggtgttggtgctagaagtagtgagattttggttaaaccttatactaataaaactgtatttaaatctgctggtatcatgtctaccttgggtgcatcttcttcaaaatccaatgttgtgtatgcaaaacgtcatgttgttgcttgtgtagctaagtcttctgattctactaatgtgtctaatcatcgtgaaaaatatacttgttctttttgtggcaaagatggacatattgttggtttttgtttcagattagctcataaacagaaaaaggagagagagattgcttttgcaaaatcaaagtggcaaaaatctggttttcccttgaggaaaccgatcagacgcagtgggtcccgcggtaagaccggcgaccggtcagaccggctactgagcggtggtcagaccgggcaccagtcagactggcggtacagacgcggtcggaccggcccccggtcagaccggcagtaccacctcagtcaaaccggcctcagagaaattt

SEQ ID NO: 64828 - DNA, 4767 bp, Oryza sativa
cgcgcatatgcgcgggcatgtgcgtaaatttttttttacgaatgtccatgtgtggatggttttctatcaaaaatattctttcactttatcgtaaactaaaattaaactaattcgacgtgctttgaacgctggttacttagcaacatataaattgaactaaaattactttaaaccgtgttatttctaattcatgagaaaaatttgtgtcgaaacaatagatgtgttccctatgaatgtccaattatttttgttagattatgtttgaaattttaaatatattcattttattagtcttgataaaatgtttgaatatttctatttagaatgggttataaacccaacaaaaacaaattttaaattagataaatttcattttattttcaattctttttatctccttttttttggataaatccactttatgaagcatctttgaaatgctttgatctctgtaagtcagaatgaaaatatattgggttgatcctacaacctgccatggggtaaaggcatcaattctaaattatctcgttccaattaagtaagaaaaattaaaatagatgtcgtagtattttcttagcaaattaccactaaactggagtgtcatgtaacaattgcatgtttctagattattctatgctatatgtcacaaattcacaatatactgtaggaagttttacccaaaaaaatagatctggtcttttaattcctatctgtaattggcttatatattgctgaggccacatcatagttgtttcattcttaagattccttggtgcaaccaacgtgcccagtacaatcagtatgttgttcaactggacacgtgacttcatagatcatatatataatttagaagctatgatcattttatgattatttatttatctcatgaagtgatcatttattgataaaagcatcaatatcaaaatgtatgggtaaatagctcctatatataagctgagaaaaagttgatagaaagtcgttagatgtctaacaagatataagtaatgggtctaccagttttataaaaaattgagctgtgatattttgatttttagtgagcaattttagtattttcttttctttaaggtaaaatttgctacaggatattaaaaacatgtaattggccgagggacaccgtaagaacacgtatctgttgtggcacatcgaaaaaattggaaattagctactagaggcccgcgatattattttataatatccaaaggaaatgcagagagagacaataacaaaagtatgacttttcccctacctactaagtctggcttgcaaacaccttggacgcagcaaccgcacccgccgtcggtgaggttgctaattaccagttttttgcggtatcccatagcagatatatgttcttgcagtgtctcttaactaattatacttttttttgatgtcctgttgtaaattttaactttattgagaagaggcttcaatatggatgtgggttcataatgtaattttttgttagcagttaaatatagtcaatatgggcattaagttatggttttcgcttagaaaaataatagctggctagacctaataggtggagattcgtttgtggtcttttctttgctcataaaaataattttaattttaattatcatagagatataaaaagctgagaaaagtaatatcgcacactgcatgggaacggggatggaggaagggttgagatgtttcttttttttagaaaaatattgattgtagatctaatataatgtgttgatgtttaagtaaaaaaccgatggttgggtattatttttttctcagatttataaggtttttttttctaatttaagtgagacaagtagcagcttagcaaaacacccatacggaaggagaggaaggagagaaagggaagatggtttgggatgttttttattaaaaaaattagatacaataatgatgtaaaataatgtgtgtatcgatttaagtggaaaacaatggatggatgtttctctaatttaacaatgtcatacaacgatttaaaaatatttataagatgtttaatggacttttaacacctatttttgagattattttctataaagttaattttagttttaagtatgacagggataaaaaacagaaaggaatcgggagcctactaattgatcactctggcgtggtggactgtatgggggacgtgggtggttttggttttctaagataaatctaacgataatgggttcgccgatttaaataaaaatcgacgaagatttatctattttattaggatgccacgtggcggcttgagagtatttatagggtgccatgtcacggtttgggagtgtttgtaggatttttaatggatttttaagtataagatagatagatagaactaagtacatatggtttttctctttatcttatatggtagaaaattatattttatatttttctcccgattatactatgtacttatttttactttatcacacagatattttttcttccgccgaacggaacataagctttattgttttttttttccgaatcatcgtactgtacttatgatatgattttttgttttgccgacggtacgtattttcccttttatatagggaaggtattatatatacacctaatgattcgtaataggtccaccaatttaaataaaaatcaactatagatatagatatagatataatctaatggtttaaaatgataggtccaccaattaaatgaaaatcaacggtgagattagacagtgccacgtggcggtataggaatgtttatagagtaccacgtggtggcttgagggccttttttgcaagtttaatggacttttagtatataactaggaaggtagtcgcgcattcgcgcgggcatgcatcataggatgcgttgcttagataaatgtttaacatatttttgttagctttatgccatataatatttaatcgtcctttaagcaattttctataatcttcttcatcatctaaaataagacatatttagtatatttagaaaacatatctacaaattaaatctaatttaaaagctaggtgtttctttaggggctaacttttttctatcaaatcttaaaaatacattagttgctatcaaaagtgttctatttgtaccatctagctagcgcttcttttatttggtttatattgatgcaatttaattattagttacaaatgaataagatagagatgatatgcatgcatcctaggtctcgtttctctgtgatatatgtgatctattgtattttttaaaaagaaaaacctaatcaacttgacccttaaaaaataaatttagtagtaagaaatataacttctaaaccgactatgtactgtaaccttagtgtgttgcttatatttgcaataatatgcggagaaattcataatacagtggcgcacgatagagaaaaaaatcattaatctaaccacttaattaaaaaattgatgcgatgcaagaaaaatcattaatatctaagacaaaagaatgaagcaaaataagttacaagattttcagcaattagttcaaatgtagttcatattggcatttttttttctattttctgttttgttttatataagaccacgcgaatgtgcgggcatgcatcataggttaggtttgagaagcttataaggatataatattaccggagaaaatctgccacaatttaaaagtacgatatatattcacaatttttttcgttagtattgcttatataattttaacctattagttacatttataccatatcatattcaaataatttctataagcaattatttataatcttcttcatcatctaaatagaaggtagacttattttgtttagaaattaaacatgcctaccaaattaaatgtaaagtaaaagcaatgtgcttttttgttttttaattggattactgatgttagctagatcgcccattgtttattgacagatgtatggggtagcacatgaggctacactaaattcatgagtttgtaatatgattgcatagtttgagagataatccatctgtgaacatttcatttagagtgtgtgcgaggctccacatagcctattatgaatacgattagatggttaaatataatcgtgtaataattatttttggaatgtgatgtgtcataaatacgtggttgtataatatatgtaggaggaggacccgtaagatataatagtaaagcaaatagccaacatggtcttgaattgctgatttgattaaaaaaaactacagctgctcaagtgtatcttaaattaaacgtgaagatcatctaaaaataattgtttatttatagcaccaagatcactcctattgtaaatccctagcgcttgcacgttcacacctaaatcagtctccgtgagaaatagatctaataatttatgatgataaattatagtgtacatgtatatcgcgtatttagaaaaaaaaaatcaggaactggatacatgcatcaatcgagcacacggatgccatatataattatcctgcctaatgacaatgacaatcaagcaatcaaataagtaaacgtttgcagctaccacatataattgtccacgtacatgcatgtgggtcggggatagaagggtaacgggggatttagttttgatccaatggtcaatagtattgggtccaccgctttaaatgaaaattaccggttagatatttttcttttttctcagaattttctttaaattattagagcaccacgtggcagtttaggagcgttcgtaggagtccacgtggcggttcaagagcgttttaaggaagtttaatggacttttag

SEQ ID NO: 64829 - DNA, 6165 bp, Oryza sativa
ttactattatgccacactatgaactgaatttcacacgtgccgtcttaggggcgagggctctccttttggcgaaacataggtaacaacatgaaacccttcgtcctttctattcacgcttctctcgccccttcttttcttcgcctttgctgaccgttcgcttttctttgagccggttgtgttagctgggacctcgtcgtctttcgacggatcttttttcttgggctgccgttttgatcgtcgtggcgccgtttcctacgagaaggcatataccaaatttactattagctcgggctaatagttatcacggtgaacagtttacatattaagtttacttaccccttctttagggggaatagttatcacggtgaacagtttacataccttaacaacaagactaaaggtaccttcatagtctacatactataacgctacttaaacccttttgcaactaagcgagctttatatctatcaagactaccatcttctttcctttttatcttataaacccatttgcaatcaatgacatttctacccttctgaggaggaactaaatgcgatgtattatttttaatcaaagccatatactcagcatccattgcaagtttccaattcttatctttcaaagcatcttgtaaattttcagacacaccagttgaggtcaaaagaccccattttactgtaccatcagtgtagattttctccttgcgaattccactttgcagccatgtgcgaagacgtgctgctgcgtcagactcctgattccgatctgcaattccaagtccgcgcctcgccgtcggatcggcggcagcgataattccaagtccacgccttgccgtcggatggccaccgctgccaccgctcctccaccggctaccgtcgcctcgttttcctctctcccgtttgtgcgcgtgcctgtcggtcccttgccgcgtgcctgctggcccttcccgtgcaccgctaccatgcaagtcttgccgcatattgccgcgccgtgccggtgcctgccagccgcttgccgcgcgtgccgcaccgtgccggccacttgccgtgtcgcccgtccgttctgcttgccgtgccaacgccgtgtttgcctcagctcggcagccgagccgacaaaccctagcgttgcttggtcggtttcgtgaccgacccgagccaccggtttcgtggatcggcgttggaccgcacacgttgtcccgaaccacggtaggtcggctccttgagatgctgacctatggggcctatctgccagtgccgtttccccttgttgtccaccctcgggcgtttaagtataataattgaataaggatttttggtttatagtaagaacacagtgaagcttctaaaattcatatgtacttcatctgtattccgttttaatccattcaagattcagtaaattcataaaaacacctagaatctattaaaaataattttgtttcctgtttcaatagacttctagaaggtttgcttgtgtgttttgtttgttgtatagaatgcggcagttccgacactcatgtctacttcgaattggtcgctgaagcccctccaactcaagagcaaggcaagtcatacacaaaccattgatcatattgaacctatttttacaaatccctcgctttctatttaaattgcattgtttttataatgtcatgtgggatggattcctattgtacttagcctattgttatcctatgtcatttatagcttgggaaataattttactggatgattggtttaggtgatgcttggatcaattagcacactatgggtttcacattaactttagtccttaatttaatgattgattaccaccatggtaataagtaaactaaaatatgctaaaatggtgtattgtgggtgcatggttttgatagtcgcacccatgacaattaaggaccggttcccgggaaacactggaagaattactcgtacttaccacaagacaacatgagcaacggctggatttggagtgtagctttttcctagccgacgtactaaggcaagggtgggtgtgatggagtaggatgggtcctatgacgacctctgttgcttccagattcacctaggcatgagggggctgcccactgccggtaggggtgggggcaaaacctgaggtgggcacgattggttagggagggttatacaaagggtcctatcacagtctctttccgaggtaccttggtggtattgaggcgtatgataacatgtcgtggggctgtgtcttgtgggtaaagttgtacacttctaatcagagtaaaattattcgaatagtcatgcccgcggttatgggcagtcaaccagattcactattattagtctcacctgaatatttggacttgttgaatggtttagttcaggtggtttgcttgggcctgtttcaacgtggtttagcattggatagtgatgtttaatattgattaatttatatctagtgttttactatattcaacttgtgattttaaaatgccagctttatgaaaatatcctataccctcctttggtactatcttgcatcatgccttctattggtatggattgttgagtacggtgggtagtactcagtcttactttatttttcccccaaccctcaaaagcaaagtattattcagatggagattattgggaagagtaggcttgttgcggacgtcaaggatgcctgtggatttgtagacgctatgttttctcaagagatcgatgattagttaactcgattatttatttccgatgcatatataagacttatttatatttttgtaagacgtggacctgtgtatcaatattatcgtcaatgtaccctggttggtcctggacagatattttaatacacattctgcttgaaattcgtgttaacgaatttttaggcgttacagacatcacatttcatttcattatatgcaggcattgacagtcagatattatgatttaagaaccatcaacagtcgccatgatggcagcgcaccggttttgccgtggttggaggggtcgttaacgtgaatgaccttggcggcggcggcaacgaagttggcgaggaagaacggtgccagggaagtcgtggccgagggtggagcgtgaggagtcatatgcctacggacgctggcctgttgacggtgaagttgagagctccgaagcagaattcggcccctacagcgaagcggagtgtctggacagattcgaggacaccggggcccacctggacaagttggccggagttgttggcgaaaaatttgaaggagttgaaggagaaaagtttggcggtggggaaagtggcggtttcgcgaacgtggccccgtgaaatgcatgccatctcctcgaagaaaagacgattgagtgccccctaactagcatgccaattttcgatttctaggatcgagaatatgaggtgcgctagatcaaggagagatggtgacatagacgattatcctggtttaggcccttagcatggggtaataccctacgtctggtgatgtagattggatctatgtcaactaaaaagacaagagtgttaccgcttagggttagtgccagcgcccttatagagctagggcaaccgacgacatgcttcgtacagtatccctcataatccgggtacctaccatctgcttactagggacgagatagacttccttatctcttatccctttctatatatccaaagtattacatgggcctaggacactcagcccaccctatgtagtatgacccaaatgcctgtccttgggtatccgggtaccgtgtgccccatagcatgcatgacggtggaaggaggtgacgacgcgcctcgccgtgatcagcagtcgacgagcgggatggttgcctggttggcagctgcctccgccggtacaccatgcaatgatagaaactacgtcgctgctggtgtgttgagaaggtccagcgagagcaaccaatgggtttgcattccacacttccccagcggcgcgtcgagaacctccagccgtggttgttcacattcgctagtggcgggcggggcagcaacgacgaccaccaccatgggccacagtggcgggggcggcgttcgcgactacatcatcgccaagtgcacatgctcccactggttcggactcctctggtgtggccggcgcgacgactgctacacgaggactcatacacgcggtcaatgttcgacgccatccttgccggctacgtgacggcttcttccacctggatttgcacccaacaccattggtagtgtggcacctgccgcgcaaccacaccgcatgcatggtgagctcgccatcgctcgatctgcttccatggcggagctcgacaaggcttcaagggcggcactattggtatttcttacgatcacagatagaatccgcaagcgcacggatataccaatgtagcacttcccctacggagtattccaagtgtatcgaatccaagggaacgtgtgtgattatcttctcgtcaggttcatccaaggacacaaagctaatgtgggcatagggcagagaggatttccgaatgagaaacagtgtctagggaaagcttaactttaatcgtaacgcaatacttcaggcactggcaacccgctgttcccagatgtcgctctactatgtaccaggacagggaggacttaagtgctcttgagggctgtcaccacctctacacccacctcaaacatactgtgggatacgctacacccacctcaaacatattgtgggatacgcagcaaccactagagattaattacccagacaccacgtttacgcaattaataactactctagtgccgatcaaacactaaagcaatcactataaataaatggactataatgaaccatgatcccgtatgctaattaggaactaaccaagaagtaattctcactaagcaaaccttaattactcacaatgatattttctattaaagcagagtaattaacaagatacaaaagtaagaggagattgccgacaactccgggattcctccgattacttctaccttaatgtaataccccatatattaaaagatttttaggttttttttgtttgggttgatgtcacgccctgaagttcccctcccttgctctaaattcataaaataaatcgtccgaagaaattgtttaatttaacctagagatgaatccctaattaataaatgcaaataataatcggaattggcatgtggaatttttcttgagttctacatgtcaaaattcactaacaggatttttagtggaattttcagagccttggaaataattttaaccaattaaaatgagcaaagtgcaatattaaatccctggaaaatcttttcttctttttctttttcctccttttttctctcttcttgggccgtcggcccagtccgttcgcctcccgcgcgctcgccctcctctcagctgggccggcccactccctccctcctctctccgggtcaccgacaggtggggcccacctgtcggccccttcttcctcctccagccgacggcaccgccgccgccgaaaccgccaccgacgccgccggtttccccgtttcccgcgcccactccgcccgtaccccacgcccacgtcgccgcccaccttccccgcacctcccgccagctcgcgcgcccgcaaacggcgggggatttgaaatttcccccactctctctctcctcctccatttcccccacgtcgccggccaaatcggccacctttccggcctcgtccgcccctcccgagcccatataaaccatccccgcactcccctccacctttttcctctttccgccgctctctcccgtgccctccatcactcccgcaccgctacacccgccgccgccgccttttccactcctccggtcgccgctcgccgccgctggagccgccgccgagccaatttgccaccgccattagcttcgccgccgccaaagctaccccggccgccgcatccccatccaatcccgccatcggggcccgcttctctccgcgcgccggtgagtaccaccatagccgccgccgtcggccatggctctcgctcgtcgtgggcaccctctctccctctaacccctcacacttcctctcttagggtgtcccggagctcggccgccgttcgccgtcgcccttcggtcgctgaccgtcgccgtttgccgtcgtttcctcccgcgccggccgaaccccggtgagaactccctctctcttcttcccgcgcgcgccgcc

SEQ ID NO: 64830 - DNA, 7280 bp, Oryza sativa
gatgcaccgtcgcccgcgtcgccggccacagtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaccctaagagccctctgaaaccttttcatctgcatatgctttttgcacttggatttgtttcgggaaaaattttggggttttgcctctttggtttgtgggaaaaatcttggtcgttcattcggatcggatccttaaaattagctcggtctagggttttagaaaaattttatttggagtttatttgacagtcagtggggaatttatcgggtgatatgcattaggtcgtgtctatattcgatggggcaatgttacgcgcatcatttttcatgcatctagtttatgcattaagctatagtttagtcagtcgcattagtgtctttatccgggttcatgaaaaatgttctatgcataaaaatcatcatgcttggctagttgtttgggccatttgttgcttggtttaaatttggatttgagcatgcattgattcctatcccttgtctaccttagaagtcagacatgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatggtgaagacaaggaatgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaatgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaatagaagagagagttccgtgcgctccagcaaggaaccatgtcagttacagagtacttgcatgagttcaaccgccttgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagctcagtcagaacaacccaagaagagggctgtaggaaagccaggaccctgcttcaactgtggcaagcacggccactttgctagcaagtgtccgaagctgaatcgcactggacccaggttcatccaggcccacgccaatcatgtgtctgcagtggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcagaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactactccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggcagtggatccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagataaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttgtaagatatgttgagagcttgtgcacttgactttggtggagcctgggataaaagtctaccgtatgcggaattctcttacaacaacagctatcagtccagtttgcaaatggtaccgtttgaagcattgtacggacgaaagtgccgcacaccacttttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcaggggattatgtgtacccttcgtgtcactccgcttcggggagtacaccgcttccaaaccaaaggcaagttggcaccacgctttgtgagaccatacaggatcttggaacgcagaggtgaagtcgcttaccagctagagcttccacctaatatggttggtatccacgatgtgtttcatgtgtctcaactgaagaagtgtttgagggtacctgaggaacaagctagctcagagcacattgacatccaagaagatttgacctacgtggagaagccagttcgtatccttgagaccagtgagagaaggaccagaagcaaggtgatcaggttttgcaaagttcaatggagccaccactcagaggaagaggccacctgggaaagagaagatgaattgaaggccgcccatccgcacctcttcgccagctcttccgaatctcggggccgagattccgtttaagggggtaggtttgtcacgccctgaagttcccctcccttgctctaaattcataaaataaatcg

SEQ ID NO: 64831 - DNA, 10522 bp, Oryza sativa
  unsure (1)..(10522): unsure at all n locations
accgggactaaagatgctcccatcttaagtcccggttgggaacaccaaccgggactaaagattgatttttagtcccggttatttgaaccgggactaaagatagcgatctttagtcccggattcgtagtcccggttggaaaacgggactacaagggggttacgaaccgggactaaaaagcatttctccaccagtgtggaaaatagttcagagagtggttgccctataatagtcacacatcatatttacacgatatacaaaagaattcatataacatattacctacattatacttagtaatttggctctatattttgtatatggagtgcatatatagtattaagctatctatctaaaatactgtgtctagcatatatgtctaccaattaatagacgcacgtatcctctctcctctcactcacctccacatcaaaaaatatactatgtggcattctctcctacacggtgatcgtaccattattcatgcccttagtgctaagtgtgattggttaaaactggaaacatgtaacttaaccatgttaatatcctatattatagaaaaggttaaacaatttattaacaaaaggtaaaacaatcgatagcaagaaataaaaaatatgttattttaattttactaattctaacagcttatatacaaaattttaaaattacaaacgtgagactaaattcaccgtttgtttgtgtatactgtcatgctataattctccgtaggaattatacaaacataaaaccaaaaccaagtacatattgaatgatattttttaatatatgatatttacatagattttattagtattaaagtaattactctaaaaagtatacatgtgcccgaggggaaaaaatcacatgataaattatccagcgcgccaataggcacgccaataggcgcgccgattttctaatgaatactactactgtccttcagttgggcacaagaaaaagtttacttctcgttttcgctatcaacggtgtgtttcatatttcttctcattttcgctatcaacggtgtgtttcataaattgtgtactgtttgcaggccaggaaggacctcgtaccacgtgcagtacagtcatactcctaaggccttgtttagttcctaaaaactttttccaaaaacataatatcgaatctttgggcatatatatgaagcattaaatatatatattagattatgctagaaacttgaaaaaaatactttgcatttttgaacaactttcaggactgaaaatcaattttaataaaagtgaggttatttgtttgggagaagcaaaaaaacaaagaggagtacagtaagatcttcacttccaatataggtaatttgcctataaagtatttgggtataccgattaataaaaaatgaatcatgaataaagactggaaacagactgaggagaaaatggaaaaaagggtaggatgttggcaggggaatttgcaatatataggaggaagagtaactttgataaactcttgtttgagcagtacacctctatacatgttgtctttttacagaatttccaaaggagtgaaagaaaaaattgattttataagaagaaggtttctttggcaagaagaccaaaggattaggaaataccatttggtacaatggccagtagtttgctctccaaaagagcaagggggtttgagaattagagacttagacattatgaacaaagctttgttgggtaaatggctttggaacctggagaaaattgattgaatgtggcaaaagcttttaaaaagaaaatacctatcaaagaaaatcttggcagcccagaaaatcaaaaagggggcttcacatttctagcaagggattatggaaattaaagatgttttctttagttattgctggaaaaaaccaggaaatgggacaaatactctgttttgggaggataactggatggggggagcctctggcacaaaaattcccttacctatacagagtcacacatacacattatataactctggcagaggttaaacaaaaaggttggggtagcataattttagaaggaacctattgggagacaatttgagggattggaattacattaaaagttgctgtgatcaagtaagactccaaagatgaaactgtttggggactaaccaaaaatgggatcttcagtgtaaaatccttttatactgctatgaaaatgcaagaggctgcttctatgatgggggtgatacacaagaagatttggcagataaaagttcctatgaagatcaggatcttcctttggcttttgttgaaagatagtgttctaaccaaagacaatttaaagaaaaggggttggaaaaaaggaaatgaaacatgtcagttctgtgataaaaaatagtcaattcaacacttatttttttattgccccatgacaaggcttacttggaatgtggtggcatgtacttttggtttgcaacctgtgaaaaacattcaatatgctttgggttgggggtttggatccagaaatgggataaagtaacaaaatacttaatgttggtggggatagcagctgtgcggtggtctgtttggaagacaagaaataaagcttgttttgagcggttgttgccataggaccccactgaaattttatatcaagcgtgctcatggatgcatgattgggttattctgcagagacaggtgggaaatcaagaaaagctgcgatggggaatccaattgctaaagcaggtcacaaatgaggtgttcaattcaagacatggatggcgcgcccttcagaaggattacaagcagctgagcggattagaagagaggagagaaatatccaagttttgaacaaggacacatttgttagcctgtttaggagagtcatctgttaaatatctgttgtcgcttttataaactctaaacgcaattgtgttttctttttttctcttatactgtaaactgtgatatttctcttaatggataaaaagaaaactaattgcacagtttgcatgtgaaccgtgagacgaatcttttgagcctaattaggccatgattagccataagtgctacagtaactcacatgtgctaatgacggattaattaggctcaaaagatttgtctcgcggtttctaggcgagttatgaaatctgcaggacaatattttttatcacaaatgtgagcatctacaaacaattgagttttttatgagaaagttaaagaggattttagttctaaaactttagtgacatatttcttgatatttgattctgagtaaaatntagctaaacacatattttttggtcatggttattggacatcacaagtcatagtgtttcacgaaacctcatcgagtctaaatttcaattcaccaggaatcaactggcacatccaaacgagctacgtatttgaaatgattatcaatttggtattattaattctgttgtggaattatttttttacgataaactacaggagaggctcctacgactgtgattgtagaattattgaatgatgaaaatattatatttgagaattcaaatttctattatttatttgagaattcaaatttctatcattacagaccacaacttgctattattaatccaaatttcgaagaaactaggtattcataagaatacaattgattgactatttatttgttatatttgttgttattaatttcaaattttggatttaccaaataatgaaataaattagattattttgtgagggaaataaactataattcaatcccgaaacaaagtgcaatttgatatttatttttttgaaatttgaaataattaaatcaccaagaaaactaattaatattttattagaacaagtatgagttggaatttaataactccagattctagaattattacattatgtacaaactttaattgagactctagatcaagtacaactctatattataattatatattattaaatcataaacaaacttatatcttagagtgacaaccaaatagaacgaggccatttattaatttagaatttaaaaattaattttcacattaatttagaaactaaaaattaatatttatttaaggctcctagaacagcaacttaaataaatagctctcccatgaaagtgacatcatgggaatgttttctgtcattcagcttatttcttgtttaggcctgtttagttcccaaaataaaaactttcacgctgtcacatcgaatgtttgtacacatgtatgaagtattaaatgtagggaaaaaaccaattatacagattgcgtgtaaattgtgagatgaatcttttaagcataattgcgttatcatttgacaatgtggtgctacagtaaatatttgctaataacggattaattagtcttaataaattcgtctcgtaatttttctgacgaaatctgtaatttgttttgttattagactacgtttaatactttaaatgtctgtccgtatatccgatatgacaaccaaccctaaaaattttccacaactaaacaaggccttaggccgtatttagatgctgtaaaaatttggccaaaatttttttttgacgtatacggatacatttgaagtattaaacatagactaattacaaaacaaattacagattccgactgtaatctgcgtgacgaatcttttgagccaaattaattcgttattagcacatgtgggttactatagaacttatggctaatcatgatgtaattatgctcaaaagatttgtctcacgatttacagtcagactgtgcaattagtttttctttttgtccacatttgatgctccatacatgtgtgcaaacatttgatgtgatgaaaaaataggaagtttgaagaaaaaaagttagaatcaaacacagccttagtttggcacgtttagctatgagtaaattgcgccagcggtaaaaaacttggcaggtgggtacgatttagtgtaaaaacttgtaaaataagcaaactggtacataaacttaacaatcatgtgcattttgataaaaacacggttacatacctatggttcatcgtattttattggttgtatttgtaaacatgactgctagattaattgttggcaatgagtatgttttacagtgctcatcaccgaatttgtatgatcagatggatcgctcggaaattttgttagttggcatgcacttagttttgataatcattatttttctaattttaaataataggttattttagtattataaccaagcaaatgcaatacatctaaaaccttattcggaactcaagatgacctaactggctgctttttctttacatagctgaaaaagtatggtgtggaagagagatattttaaccaaaatgcacgtactaaccaagttgttacatctatataatcattttttaaattcttgcactagatcgcacccacttaccaagtttgtgtactgtagacgtaatttactctttactatcaacagtgcgtttcatagatgtgtgtcctgctcgcggcccgctgggacgtttgtaccacgtccactgctagctgtcattgatcctaataaaatttctcccacttgtcagcaacaagtgcatccaaacatacagtttattctagaaatcacaaattaataagagcatctacaaacaattgtatactgataaacttattggaattttaattctaaaattctaaaatcggggcgttacaaataaattcacggcataaatttttaggacaaacagactataattttaaaaataaatgctctataaacatattttcaaatatgaacctatttgccagggtaagattgccatgctggtaaccaataatgccgtatatcgtttgttaaaagaaaaaaataatggcatgaaaggatttcaccatagtggacaatgcaaacacttttactccatgtaccatggtgctacagtcattttggtgggaaaatagggtagataagaaccggtctaaaattttcacaagaccaagttcaccaagttctggtatttttctaaaggcaaattttgctacaggacatcctgacttcgcggttttagctgtgggacaccgcgccgaagtgacttttgggggaagaaactctcaaaagttggatatttgctggtggacaccgcacccattaaaataataatttccaggtagggaggagagagaaatcacgtgaaatatcaaaaatacccttgggcccacatgtcagctctcctatctctcctctctctcccctcttcccacgctaagatggcgacatgctgaggtgcgagctcgccctggacgccgggctcttggccacctccgtgccagagccggtggcgtcgccgacctgtggctgcgccatgtcactctcattctcctccaacaaccgcatcatcatctccatcgtgaatgcgccctgtcactctcattctcctccaaagatttctaatgcttgcaggcttgcagctcaaaattttctcatatgaagatgttggaaattcgtgcattccattaacacatactgtgtcagcaaccataaaaatcactcattgtctcctttattcaatcacaacttggcagagttcatcaaatcaaagtaggaaaatttttcgcacacccaacagcaaacaatggcgcgtggccacgaactcggagatcacgcgccggcggcgttaacgaaggcgaccatcctgttgagcaactccttggccttgccgccgtcggggtcgaacaggtggaagacgtggccctccccggccgtctccagcacctccaccgacgcgtcgccctttgccgcggccactgcggcggcgtacgcgtgggcgcgccacctgaggaagtcccccaccgcggcgcacaccatgaccctgtcgcacgccatctgccccagcgccggcgcgccgggcaccatggggttcatccgcgggtcgtccatgccggtggtgcaggggcacgcgtacatccacagcccggtgcccatggcgcacccctcggggtcggggtactcctcgccgatggcctccgagccccagatctgggactggaacaacgtcatgtcccggcctagccagaaggaggggatagagaagagagatgggagagctgacatgtgggtccaggggtatttttgacgtttcacgcaatttctctctcatctccaatcaaaaattattattttaatcggtacggtgtccaccagcaaatatcaaactttttagagtgtcttccaccaaaactcactttgcgcggtgtcctacagctaaaaccgtgaagtcacaatgtcctgtagcaaaatttcccttttctaaagcacttggaatggtgtggtgtgatgaaggtagggtgctacagtaatttaattagattaatgggagagatagttttgattggaatcatgctatacgtacgacccatccatccaaccggcgtaccactgaaacggcagagcaacacattgcgagacggcgtgatgattcgtactgcatgctgctgacgccgcgtacatcgacattgtagtcatctgagagtcggatgttgggtcgtgtgtgtagcattttccttttgattgtaagcactggtatcaaataaatgtcactccaagaaagattggaaaataaattttggtaggttctatttatgtagatggaaaaaaaatctaaattactcctaaactatcgcgatggtctgaattgcacaactaaacaacaaaacaggatatttgatatcccaaactctctaaaccgaacgagtaaacccctaactcaatctgaagcggttgtgtggcgcatacgtgctaacctagtcaacactaaaaagttaaaaataataaaggacccacatataatataggcattcttccctgctctctccaccctaccctagctaaatcacccatccaccgctgccgtgtcctaaatccgcatagcaagcatgccgactgtcgccaccatcggccacctcccagcagcgcctcctcccaaattgtgacattctagcccaattaggatgaggcctatgtagcctacgagagctgtgtgtatatgtttagtaccaccttgctagtttagcaaaagtggaatcaatttataaaggtttgtccctccaaccatactactcccgggttaaccctcttacacgaagcaaggatgaaagtgtaagtggaatggtatttgtaagtgggaatgcccgtcgaatgggttggctacgcggttctagacgaagggccattacaaatggtaagtgaggcacatgacatggcatatgggggccggtactagacatacggacatgcgctaagaggggtgtgttcctgtacatttgcctatatgcctgtgtggctatgtgggtgagttggactgacggggacgtcgggtcctttgaggggggtgtgtgtgacatcctgactcaattaggatgagccatgtgtggcccatgactgctacgtgtacacgtttagtaccaccttactagtttagcaagagtggaccatttgcctatatgcctatgtgggtgagttggactgacggggacgccggatccttgggggggagggggtatgtgacatcctggcccaattaggacgagagctgtgtgtacatgtttagtaccaccttgctagtttagcaagagtggaaccaacttacaagggcttgtctctccaaccataccactttcacttacaagggcttgtccctccaaccataccactcccgggttaaccctcttacattaagcggggacgaaagtgtaagtggagtggtatgtggaagtgagcctgcccatcggatgggctagtgtaagtggagtggtatgtggaagtgggcctgcccatcggatgggctagctacacagttctggaggaagggttgttacacagacgtgttccctagttctggctccggctgcgacctcctccttgtcaatcccattgcctcctcaccccttccccttcctcctctcccccttcggcagtcatgtctcgagtgacgacctcctcatagatgagcccgctcactgttgtcctccatgaactaacacgaggagcgtgccgcacgctgatttggtcctagggccatggcgcgccgcgccggcaaatgaaaaactctaacgaatgttcgggagttagggaataatttagaccccttccccttcctcctcctccttgtcaatcccattacctcctcaccccttccccttcctcctctcccccttcggcagtcatgtcccgagtgacgacctcctcgcagatgagcccgctcactgttgtcctccatgagctaacacgaggagcgtgccgcacactgatttggtcctagggtcatggcgcgccgcgccggcaatggaaaactctaacgaatgttcgggagttagggaataatttgggaaaaatcgggaactgcaacctataggtcgacagggaagacatggctgtacgagtgcatgtcgcgggagactgatgacatggtggcgtggtttttgtgtgttaacgtcaaaatttggtaagccccgaagtcatcatcggcctaaagtcagtatcggcttcgagttctggaattggctaatggaaattatcaacttctagtagttggattcttgatggattcgtttaagaaaattaatcaattaaagaaagtttatctagaagagagttgaaggaggatgcggcatgacaatttatctattaattagtcagagttaaatagtttcttttatttttaagaaagtgtgtttaatgcccgatctggacttgtgtttctccttttatctttaggaaagtttgagttttatccaataaggactagtatctacacataggtataaatatgtatactcgagcccttgtaatttatctcacggatcaatacaactaatctcgacgcattgccaccctctttttcagtatttttcttattatcggcggaacttggcacctgacacggggctgcatcggctttgatctccggcgaaggggtaaaccctacgttctattggccttagtgaatgtatcggctacatcggtgttgttcaagactgcatcggttcgacctcttggattgctctggttcggttaagatatttgcctacctgatagttcaattttatctttaatagcattgtgtttagagacgtatcggtttagttgagactgtctcggttaggtctaatcttctgacttagccaatatatctcaacaatcacaatgatactttagatagattagttatatccatcatattagacagatttattggctcattgagtgcttcattattatatacaatctcatgttctattggttaggtctgacatactatatagttgttgataatccctaagtcttgctaagcccataggttcatgctaatgttttatcggagggttagccgatcttatttgatgtgttaaatttccctttgattgttttactctcttagttaaatttaatacatgacgagcaccctggaaaacaatcaaaggctcgattgtttacaccttatacttccttcatactaagtgttcatcaattgggtttgacctactaagtcatacttggaattgtaagaactaacttgctgtttggttgctgataagggtagcatcgggg

SEQ ID NO: 64832 - DNA, 2114 bp, Oryza sativa
cctgcattatgtcattataacctgtgtcttctgcagctttgagacactgtcaagatcatcataattgagagactcaaggtcaagcatatcttcaccgccatcctcatccatacccactgcctcagcattttcttcttcctgaaaattttgacgataaatgaacaagctctcaagagtatcgcttattaaatctagttgcatggcagaaatagaaataaactcacaggataggcttcattgtctgacagttcatcaagatctgctaagaaagaatcagcaaggcttgcctgcgaagtggcaccaatcagaaaaaaaaaaggcgaacaagtgaccacggaagaaaagaacttgcaaaccttaaacagaatatggatttagcacaagctactatcaagcagttagaatgtactcaccatgataactcctgctccaacttattgaggaggatcagtacacctgattcatagtggttatgtagtcagtggcactgtgcaaataaaaagaaagatgtagtaagcggtattactaccaaactattattgtagaatgaacattggccactataaatattagtgtaagcaaagttttgtgacacattttctaatttacaacacggcactccaaacagtaaagcttttttgggcagagaaatacgaagtacataattaaacacttaattaaccctttgttcttcggtttatcgatttggtctgcaatgcggtttcgccaaaattcagcccttcggcaatcctaaaattatgcacatctagcaaggggaggcaccgaggcaggcatgagatgtccaaccgaggattttaaaaaaaaaatagttaagaaactataccgctatacttcgcataaaataaatccgctaaaaactgattggtttcgagaatccgtaccataaacgaggcccgattagatttatcacagcaaaataatccaaacagagtaggctagggttcgtcaccaacgacaggaacaaatccatccgactcccaacggatctcaattccacacccgcccagcataagcaaggtagaaccgaaccttcgtctgcgtcgattgatcgcctctccgccgccgccgctgccgccgcagccgcgccgccccgtagcgaggatgagaaggagaaggaagaggacgttgtgtcgcggcaaaggtatgtttggtcttttctgaggttgttccgcaaaagtgcatcatgcgcaatatacacgaaggggcctttctgaaaatttaccaatgggcttgagaaatccatgggcccacattaattgggccgaatgagaattgggctcgcgtcaagaccacaatagattgtggttgccctcgccatcgccggcgaactcgctcgcccacctccacctgtgccgccggcggcgccggctctccctcccgccgccggcatcttcgcgctcctccgttctcggtccccgtcagcttggttcgcagcggtgtgcggtggcgtgaggacggggagcggtttctcgcggggcccaacggtgcctccggcggcggcaacgagtccttcctcttccaggtgtgtttatctgggacttaggatgcatgaaagattgtcttctgtttgatttgcggcgcagcagacgatgagagaccctcgcctcctggatcctggtagaagtgaatactgttagtatacctgaacaagaataggggtagagtgtggatagtactagtacggagttattatgttgattaatgggttagaaacttagaatgctgagttctgtttttgctcggattcatatagtcttcattcttcaaccttctagtatcatgtcatgtcaaaatggtaaacttgttcttttgttttaatgtgaatagcttacattacaacattatcggggaaaagggtgggaaatgttgtaagcagaagctttgctttcccttttttttttcctatcgccacttatttcagcttgtgagtggtcgtgttctaggtgtggttaaatcgtgagaaacgctcaagggtttttttggctagctccacaaggtggtgggctagccggcctgggtttgaagcctcacccttctatttatttaatattaggtcattccctaatatttgcgttttaggtgtggtcaaatcg

SEQ ID NO: 64833 - DNA, 3824 bp, Oryza sativa
gatgggttatttatcgtcaatatatctatctcgtcagttacatgatcaaattgattgacacgcccacatctcatcaaatattaggaactacacagcagcagcagaagatctcccaaaccttcgtagtgtttttttttttgcgtcaacactgtgccaaggaggaggataaggccttgccggtgagctcaacaggctggccgtcaacgcgtacttaaggtaggggagggaagagaaaagaataaaaggaattgagtaacaatgactctttaacatgtgggtcctccgaattttttctttttttatgctggctgaactaccacgctggaacaaaaccaatccagatcgagatatggaggttatttgtctaatttaaaaagtttgaggttttacatatccggttttgtagtttatggggtgtaattcgaacggccgcgagtctaggggcaatccagattttttttctttttaaaatatcaaattttaaaaaggtttaagtaaaacagaactccatgactccatgtgtttgatggtctactgcaacaagtggtaccgcacttattaccaattaatgtagctcggtttcttgctactccgaggttcacgacttgttcaagttttcgttgaaacttgcttttgtaaaaagaaaaaaacatttttatactttattcacttcatcaaaacaaacctctttagtttgccgattgggatttagacaagaaaccgaacatgctgaaccgccaagaaaattgcacagtcatgcaattcggctgctgtcttatttaatcaaattgcacatgcgcgaaaacattaagaaagccacagcaagattcaggataatcatcaagaagagaactatccgattggccatccaccgaattcaggatttcaggtcgtcctcacgcctacgccccctgaggagccatgaccgcggcgagcttcttgacggacggcctcgccatgagcctctcccaccatgccttcacatgagggtacgagtcgaacagcgacgcgtacggtgtccccatgaagtagaaggtgtaggggaagtggttcaggtcggcgaagctgacgaagtcacctgcgaggtacgtgctctgtgacagtcgtgcctcgtacacctccagcaccttcttcagcttctccgcgctctcgtccacgaccttttggttagttgggatcccacgcatggctgggttgatgatgcactcgtacacaatcggtgaaatcgccgagttgtactggtgtgtctccacctcggtccagacatccaccatggctgcctccctcaagttgccttcccggagtaggtcagcttccctcgtcttgtacttgcgtaggatgtactttccaatagcgcgggactctgaaacggatatgacgtaagtcagatttctgagccctcgctactacggtgctctataattatcgttgatctgatttgatcaaaatatttaaatctatttataataccaccttgttagttagtggtagtagaaaagtaaagaggcattatgttaaaaaaagatatgaaagggtataatcatcacttagcagtgactaaattatatatatttttgttttttatgaatatgagcgataccaatgtaatcgatgaccacatattgatctagccggaaaaaaacataaatgataaatttaccctaatcactttattagtaaattactagtttactattaatacggttcagattatttctaccagtagtatatcactataaatagagagcatcggagtatcgcttaacggtgtattattgtgcagtaaaacatgtttagtttggttagttctgtgttaacatcatgatgacaaaaacatttcagcgggaagtagctagtcatgaccaagagtagccaccgacactccgacaactccagatccatctcattagatttattagagttacaaaacacgctttttagttattttcaatcttactaatttttgataggataatgttatttatattggtccaacataggcaatatgcagagtgatgtctttagatgatatgaacaagatagggctgttctgagggccatatttgtagacgtgtgtcgtatgcttcgtcgatgtaaccggaaaaaaaattgttccaagtaaaacctggtacggctcttaagagttgagagcgagaattaaccgaagctaagctaagatcaggcttacttaccaaagaggtacagatccccgtcctggaaagctgggatttgcccgaacggctacatcaaatcaggcgtcgtcaccaccaaatcaggattcaggagcagataaaatcatgtcgtagagggcagaagagcagaggcatcacgtgtgtacacgtacgttgcgtttgaggtgttcggggctcttgtgctccatgaccgtgaagtcgacgttgacgacctcgtactcggcgccgacctcctccaggcacaacagcaccctcgccacgttcgtcgattgcgccggcccaaacaccttcaccggcgtcatcttctcagctatccgagctcacggccactggtcggctgcgcgagtgagcgtgcgcaaacaaggaggagtctttaattggagcttagctggtgtgtgttgtacgtgcctggtggtagctttagcatgcggtgcgcgaggccggcttttataagctagcggtgatttcttgagagaaaaaattgcagtggttggtgtggtgcgtgggcgttcgaccctgttgggcgcaaagatagatttgcgaccaattcttgtggcgcaaagaagagcataaagcctaacgaaagagcactagtgttaccactggactggagcactagtgtgtggtgtttaccatgttgggcacaacacacacgtgctgttcgtgtggtgcacagagaagagctggagagatcgagttctggatggctcgtctggctagctagctaggtgaaagagccggtacgtaaaaggcggtgataatgagtagtgccttctacgaacaacattaaccttctggaggattctgaaggtgaaaagaaaaggtgctcgtggttggctgcagtcttgcagacgtcagttcaggattcggaaggtgaaggtgttggtggttgccggttggttgcacagacgtcggctccacccgaatacagtaccgaatgtgatccattccattactgcgaatccgtgactggaacggcgaataaaggtgatcttcattcgctggggaagggaagaagaatccagtccagtccaggatggagctgcttgcgtacgcacggtacatttcgctgtaaaacgcccttcaaccacagaaggaatagttcacctgtgctcccttaacttaacttatcgatgaacccgattttcgtccttcaaccgaaaaccagatacaacggtacctttattgctaaaaccggtgcaatataagtcccataacggtttggacgacggttttagctgacgtgacgcctacatggctaaattgactcggtcttcatctgacgtggcaatttgatatggaaaataataaaaattgtgaccccacatgtctgttataccaaaagaatgaattagaaaatggtgggacccaaatggccccacgtatcattctcacccctcctctttttcctcctctctccctatctcccctctctccatctctctccctttcctctttctaggcgccacagcatctcggggaggtccagtggaggcggcgggcgatggcaacgacgacgacatggagggtagggcgtcggcggttggagcgcttgggacgggctccacacgggcatcacccacccagagaagctgctctttgtctttgcccgcggcgttggcgcagaccctg

SEQ ID NO: 64834 - DNA, 597 bp, Oryza sativa
tgggagatgtcttggctgtaaagacagcggccaaatcatcaggaagtctcatcaggattgagggataggaccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttat

SEQ ID NO: 64835 - DNA, 4236 bp, Oryza sativa
  unsure (1)..(4236): unsure at all n locations
tcctgcagcccgattttgtcgatgaggaatcaggaagtgatactgatgaacaagccacagaagatgacttggaaatcatggaaccaaaggaagggatggcatttgccagtgtgaatgatgcttttgtgttctatgagagatatgctcagaagaagggattttctataacaaggagaatctcaagcactttccaatccttcaccttcgcttgcagaagacaagacaacgctcaatgctcctcaaacaatgcatggaagcatcatcagaatgaatgtccagctaagataattgtggatcttgatggtcctgacgacaaattcttcttatcttcagttacgcttgagcacaatcacgatctcagtccaagtgaaacaagtcgaatggaagttttcatatgtaacaaaaaactgattcgtgtgctaaaagaagaagggtgtcaaatgggagagcagacaatcatgccaacaagaagtccagtactccttgcttgcaagctgaaaatcgcccatttggtcaaaaggatcccatgaacaatttgcaattggaaagaaaactgaagctcagtgatgcatataggctttatcattacttcttctgcatgcagttcaagaatcctagctttttctatgctttggactttggcaaggactcctgcctgagaaatgttttctgggcagatgcaagaagtagggcttcatgtaaatatttctcggatgtcgtgacagttgacactacatacttaatgaacaaggagagcatccctcttgttccttttgttggtgtaaatcatcacaggcagccgattttgttgggatgtggactactatcagatgagaccactgtgacctttctatagctgttcaaatcctggctagctatgtcaaataagccaccagaagtcataattactgatcagtgcgatgcgattcaggatgctatcgagaaagtttttccacaaacttgtcatatatggcgtttacagtctgtcatgaagaagatgcctgaaaatctcagtggattctcaggatttcaaagcattgaaaatgctttttcaactgtggtacataattcattgacacaaactgtttttgaaaacaattggagtaagataattgacaagtttggccttcatggcagaagcgcatggcttaatatgctgttctgtaataggcataaatgggtgcccacttatgtgaaaaataacttttgtgctggtatgttttgcacacaaaatagtgaaagcattggtagtttatttcatggatacatcaattctaccacaacgttggacgagtttctggaccaatataataaaacaattgtgggcattgattgtaaggaaactgatgctaactggaaatcctcacatgaggttgtaccatgtgtcacccattatggcattgagaagaaattccagaaggtttatacaaataaaatgtttgaagaatttcaagagcagctaaaaggtaagatgtactgttatccaactcttctgaaacaggaaggttcggtttacatattcaaggtgacgcaagatgttaaaattagggagcaacaatgtagcttggatttcacagtgtggtgggacagagatgattgtgatggaagatgtaaatgcacatgccgtcatttcgaattccggggaatattgtgtagccacatcattaccgtacttgctctactgaaggtcaaaaaagtaccctccaaatatgtattgcagcgatggagaaaggatatgattcggagacacggtaccattactaactggtcctataatgagatggtcgactcaccggttgcacgaaggtttgatttgttatgcaaatccttctatgaagtggcagagaaggcagtggtatcaaatgaactgctcatgttggtgctggatagtgttgaagaattaaaacggaaggttgatgcacatacagcgcaaaattcatgaaattcaggtctctaatccttcacagagcagaccatgaggtgtgatgatcatgaagctccctttctcctgacacgaacaaccgacattttcagcgtccccatgtaagatatctttcttctagctgaaacatttcgaggggtaatgaaactactgatttcaatctgtaatctcggtgattgatatgtgtgaaattattgatgtgaagttacgttctgaaaatgcgttcccttataaacccacctttaaagcatgattattgttttctacatacttatcatggcttagcagtcaactatccagctggttgcaaaagaactactaccagtagtaccaaatggtttggttaatacacgcaaaatacactttggcatctatncttagtttttgctctgaagcatgagttgtttgctacattttggagccatttccagctcattttggggctatttttagcatgggttgtttacagttttaacctcaccaaatttagcttgttcttggattagattctcatatatcagcgagaattcttcactttggacttgcaaatccctcagtttgccggctttggaattccaaagggaaagtcacgatgagatccctcttctacgtgactttcctggccattttgtccataaacgtccattcctctgcatgcttgcgcctcctagctgaaactccattgccggtgatcccaaatggccagccaggagcaccggcgccgccccctccggcgaacattccggtgaacttgccggccaacgtgccaccggagatgccagccaacttgccggccaacgtgccaccggagatgctggccagcttgccggcgaaccttccggccaacgtgccaccggagatggtggccagcttgccggccaacgtgccaccggagacgctgtccaagattccggccaacgtgtcaccggacgtgctagccaacttgccgccggacgtgctggccaagctgccggcgaacgtgtcgccggagatgctggccgacatgccgccggaggtgctggtgaacctcccgccggacgtgcagaagcagctcccggccaacgtcccgccggagaagctggtcgccgagctcgcggcggcggggaagaaccagccggcggtcgccgccgccgcgggcatcccgcagatgcccaagatgccggacttctccggcttgaccgacctgtcgttcccgccgatgccgtcggcgaagatgccgtcgatgccgcacaacatcacgctcttcgggttcgacgtgcagatccccgagttcatcaacaagatggtggatgaagaaaccacttaagcttgatcgagcttggcaatggcgatggcgtcatcattgcctcgagtttttgtgacatggttggtggtgtaagttgcgtgccattgttgtgacctgtacagcttaatttctctgaaaagaagttgtttagatttttggaggaaaattagtatgtgttgtgtgtgggaatatggactatggtttgtggccgtgttgcatctttgctcatttgtgaatctccaaaagtatcaagggattgccatttttctgtatcttactatggttgtgtttagttcaacgcaaagtttggattttggttgaaattggagatgatatgactgaaaagttgtgtgtgtatgacaggttgatgtgatggaaaagaactgaagtttaaatcacagcctataacgacttcttgaattcgttcaagaattttatgacatataatgcgcgctgatgtaataattcgaaatgcaattgcaatagtaatatgaaaaaaaaatcacaaaacgcgcggttccctgtaaataccaatagaagtctatccgtttgaacggcgacacatctaaaatggaagaaaaattacttttatcagcctctggtccatttattttctaaaaaaaaaatctttgttaatcccttatccacttgatgttactgctactcgtcaccagatgtttcataggtccaactaggggaaaaactgtttagatagtttgggacagagatgggatacttgtttcagatgtcttaaaaattactgccagttttgaattttataattaatttataattttttttcattgtttttatattaaaccatggctttcaaatcaggagtaaaactataaaagtattatcttattttttttagaaacataaaataaacgcaagtgctcgcactcacccatacaagcaagttcgaaaaacttagtcggcgagctatgtttacttcgctataattatttgttttcagtcatgtatcttcatcttatacataggagctgga

SEQ ID NO: 64836 - DNA, 1230 bp, Oryza sativa
taatttgttgacttgaccaccctaaactctctctgcaaggaaactgcccaatgcttcactgcctccttcatctcatccttatgagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggtattagttcccaaaaataaccttctgttgcacgactcactacaactgatactgtcattgtgtagacttcttggtctattctaaatcctctcaacaaccaactataaattgactgaaatgttctctccgcaggcctatcgatgcccttagatgtcattacaaaatctgacagataacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaattacatcttacaattaacactactgtctatgtctcaattcatactattatattctatactctggatctacacatatgtgctgtgtgctacagatatgctaaaatatatggaactaaaactaaaacgcaacatatatactcaaacataacatattagtacaaatgtaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttatagggggaggcaaaaatcgccctcccccagggcg

SEQ ID NO: 64837 - DNA, 2753 bp, Oryza sativa
  unsure (1)..(2753): unsure at all n locations
gaagcccctagctaagtatatatattgttgtttgttacaatagatttgccagggtgttgtaggtcacattggttggcattgatttagtacaagcaagcatatatatatgccatgtttgctggtgccctgcaatgtggctaagttttacttgcacattgtttggtgccttaggcaagttatctatgtttccgccatgcatgttatatacccttttcatgatgtcatggatttggttggtcaacctttttttatcacttatgtatttcctgatgtgtagttcatgtattaacagtggtgtcaatgttgaatgtgtgtgctgccaattaatcatggaaaatatttttataaaacacacagaattgcttatgttttgaaacgggttagtagtaatatagctgaatctggaggaaagataggtgtacgtacacaaattaaggagccgtccggccggagcgcacagtggaggtggacggcaacgtacgtagcgcaatgtgtcgatgtgccccctcgctcgctcgaaccaatcaaccaatctgatgaaataaactgtcattctggtaacagtaacataaccttttgcatgtacagataggaattctaagtttgcgtttatatatcgcctccggtgaaacgtgctcgatcagaaagtctacgccaaattaaaggtttagaaaaattganacgatatgacggaaaagttaaaaatttaaagaaaaaaattggaatctaaacagtgccaaggtacagtgattgaaaaaaaattaagcgactcacggttaactgcagcaaccggagtcgcagccgaagccgaagtagcagcaacaactggagccggagaaggatggcacacaatcggcagctagcgttgatcgaccaagcagcgaaatgaatagtgcagcagaacgtcgacacaagaaattgcagcaaattttatagatgcagaagaagagaagggggaaggcaacggtcggtagcagacgtgcagcgaagggcaaagtgtccgattccaacagcacacaccaccgcgcaactttcaccgtttctcgagaatttaccctttgctttgatgaaggggcggagccacgtgtaggatagcttgagcttacacatgacaaaaaagaaaacaaaaacaatgataaaacactaaactttagataaaatttaaacaaaatgaatataaaactacatgggtgatacctactcttgataccttcctgcctccaccttgttcaagtcagtaagaatttaccctgtttttgtcgaaatagtttaggatatgtcctcctcctacgtggctatatccttattctggtatttttcttttctggttccttctttcaggccctttgaatcataggaataaaaaaaatagaggaataagaaaaacgcaggattataataggaagnnaaatataaaacaaaagattgcaaaacacaggaaaaatacaggattgatcgtttgattgggttgtaggaaaaacgcaggaattggatgaaagagatagactcaaaggaattttccaatagattgaatctcgggctaaatttccttcaaaacctacatgcaataagtcattccatgaaaattgtataggatttggaaaactccaatcatttgaattaaagggcgaaataggaaaactttctataggatttcaatcctataaaatttctccccaatattttttaaaaaaaaaaatttttccccccctttttttttttgggaaattttttccaaaaaaacggccccttaaaaaaagggtttttttttttttaaaaaaaaaccctttggaanaaaattcccaggngttntttgaaaaataagtttcntttagggtgcttatttgtaaaatatattttcaaaaggacataaatataaaaaatccaaccctggttactactacagcgacttgttaccatacaccagttgtcagttggatagaaccagtccaggaacgtgtggccccctagcaggcaaataccgggcccacatctcagtcacaagaaggcaccatggcccacctaataattcccctccccaaaaatcggttgctcctttgcctaatcactcaattccagtaactttcctctcatctctcacagaaaaaacattcctctcatctccaatcagcagctatctcccttcctcatcaccagcttgctgtgatcttatcaggcctttttgttgttctgctggtcttgctcggtaattttttgctccaaatccatctcctttctcttcttttctgctgttacccgccgtatctttgctttaccttcttctttttttttcttttttttttttgcgaatccatcttgctttagtttgttgttctgttccgagtaaaaagaatacccttgatggcctagtctgaccaaaaaggagtgtgaagctcttcgaaaggaaaaggtttagacaatacgagcctcagatgctcggttgcttagtcgatccggtggtgaatcgaacaatttaattcactgatgctgttaatctttttctttaaaagaaaattcctttctgttattggtggtattttcttcaacataaacatatatctgaagattcttcagaaatgatctgaagtctgaagatttcagcgtggcgccttagctgatttattgtaactgtgatgaatatagcagcgttgactgggtacagtacaattacttgcacatcctattatgtagaaacaagaaatttgatgaatataacaaggaattcttaatgtttatggccttaaatcagctta

SEQ ID NO: 64838 - DNA, 1012 bp, Oryza sativa
acatgtaagtttcccgatggagggtggcactagtgcctacctgatcgtgggattcccgacatcacggcgaagttggaggcggcagcggacttggtgacgacggcagtcggcggtggtattgggtagagacttcggctagtcctccatccctccctctatcatcgaaaaatgagggttgatagcggtgggggctagccctcccccatgatggtgggccagttcatatgcatggtgactgtggtgaatgattggttcggtgatggcagataaagtcggcgatggtggaggctcttcccggcggtgtcctagggacggcgacactaggcgagctccagcacccgaatctgactatggccaagccaggattgcagaaaggtggttgtaggtgacatggatgattgacaatgtgatgatcatcgactcgcctaatgcagatgaagacaagaacaacagaggctctcagcagtagctgccaagcgagcgttggcgccaatatatgagtgcgggtaggtgtggatggtggtggagcatctctggcaagctcatggcagtaaaggcaggtgcatgtcgtgctgaacggctctgtgtgatgctctaggaacggccgggagtttgaaagtttgcgggaaatgatggtggtgcgacatagcggattcgcggcgcactaggtagtttcaattctccccatcctccctctcatgctgtgacaaaaggagtaagtcatctttgatggttgaagctaagtcttcaagtagctttttttttcttgttttcttctttgtttcttctatgcggggtttagagtctaaataactcgtataagatttgaatgtgtatatggttcatggatatagagaccaaatttaagaaaatccatgatcttaaaaaatgttgcattaaaaatatgaaggtttgaattggaaatacatacttccttcattttaggttataagttgttttgactttggtcaaagtcaaactgtttcaagtttgactaaatttatagacaaat

SEQ ID NO: 64839 - DNA, 3895 bp, Oryza sativa
catgtgttttgcccatgagagaaattgggaaaaaaaataaaaggtgatttgtgattcttttgttgtttctgatatgcaagaacaaagggctggtttggttttgtggcataacttgagcttaccaatttttgtcaatcctaaattttggcaagttttagcatgactaatcttgacaaggaaaagttgtgtttggattgaagtcaaaatagcctaagttaactattgaaatggcctatttttctaggctaagcaaaaatttaacttcaaaccaaatagaaaacactattgaaattgccaaatattagtaaaggctaattcaggccacaaaccaaaccagcccaaagtgtagaaggtggattttggtgacttgaagttgtttccacaggccgctattcagcatgggcctccactcccggatacctgggctgaggcccgtagtggcgaaaaccaaatgggccatggtccatgaattttctgtgggctgggcctccaggcccattagaaggtgtaacagcttcgttccaccatggcgcgcatcggcgcatgcaggaggcgggagggaacgtgcatggcggtgtccctccacgtggatgcaccgtgcgcggcggccgcccgccacgtgggccggtgggccggctcgccacgtcggacgccacccaccgtagcgacgatctcctgctccatgcatataccggacgtgatgatcaactcgatcagttggactaattatctacgtcaaaggcagtcaaagcctgaaaatattcatgaggcagcattatttaatatatattttgttactaattttactttgggtgggtgtttcgttttaggccaccatttaaccattgtttttactttaaatcgggtaattttattttctttaacactttgggtcaccctcaactccttaatttatcaatctaaattcaacttgccatgtgtaaaaaaagatctacaaacagttgaggaagttttattgacgagtataagctgttgtaccattcatatgcttgagaagagagttgagttagtccaaaggctagattacccgatccaaagtgaaaacttgattaaatagtgatccaaagtaaaacaccggcaataaaagatgatccaaagtgaactttactgtggtgtataatatgattcgacaaaatgaagtcaccatgcaattatctaaaagagaacacttgcatgtcgtgaacattcaaaggcacatgtgctatatatatgcttgcgacaactatataattaactatgtgcatatatcttactatattatatatctatacatgcttagacttgcacagacaatccaaagccatgaagccacgtcagagttggacgacacgtgcatcgatccatgtcgtcaagaagaaaaaaacgaaagggagctgctgggtatcaatcaaaaaagaaaaaatcaatgtgctttgatagcttttagctttgcagacactgtacgaaaattccgtagaaaaattcgatcactttgttatcgattcgatcgatcgatccgtcggatctttaaatttccaaccgcacgatgacgatggagaactggagatgattaggtctcctttatactccatttgtttaatactataattcattataacttttttcttgttatacttttttttaatttgattaaatttgtaaaaactagcaacatttataacactaaattagtttcattacactgaatatatttcgataatatgtatgttttttgttagctaaaaatgttactttattttttataaatttggtcaaatctagaaaggttttgctaggaaaaaagtcaaaacaatctataatatgaaatagaggtagtattgacttttacatgatatataattaattttctcttgtaagaatgccatttagggtttgttgttggcgccattgcttttgggaacctttgggagtttattagtggttttttcccaccctccccggcgttaggaggtttacttcttattagctaactttttgtttattttcttgtgttttgatttttttttcttgtccccggtaacggctttctgtttgttgtgttgtgtaactaaacattttctttttttctaatatatcgacgtgtaattgttttgtacattcgccgaaaaaaaacatacgtgagaatgttcactgaaaagaaaaacagatcatgtacgtattgcaagtaccggtttttctcctctaggaacattctcgtcctctcactcccttttaacgtggcatacacgaatgcctctcaaaaataaatcaaaaccaacgatttattttcataaaagaaactaaattaaaaaatcgatcgcagggctccattacttttctcgatcgtcaggcattcgtgtatacgccgtcaattaatagatctccatatatcttcaagaaacaatgcctataaataactagttctacataccacagctcactcaactcgatcgaccatatacatatagaaacactttcttcttcgtcttcctcgatagccaaaatacactgtgcttggagatcatcaatggcgatagcgaagagcgagtgtgagcgccttgcatgggcattgctactggagagcaacctcctcgtcggcaaccgtcgcagcaacggcgacgacgacgacgacgacgtcgatgtggctccagctgcctgatttaattacggatataatatgattattactactgatcatctagactatattatgatgagtataacgatctctacgttaataagttctgcatggtctaagagtactcatctacatgcaaatatgcagcactttcaattagtcctgtaataggtgatcactgtggtgagtgtgcagactgcagaggttttgctgtgtactagctagttagctactcgtactaattattcgatgcatgcctttatctattaattactcctacttacttatgtgatatatatagttggcaataaagaggcatggtatatatgaatatatctggagtgctatatatataatgggaaacttatgtatatatgcgcaataactctaatgtaacacgacgtgtaaacatatggtttgtcaggtatgttaactatatatatatatagagagagagagaaataataatttagacaaaatttcatgctcaactactgtactagctagctagtggagtattatattatacctcttgtgtattaattaaacattagtgtttctgttccgtggaccatatatggtagtgatggattttgggggtttcagtttgttttcttccaatagccttcggaaaaccatatccgagcactttcatggtagatgacctgagtaaaatatatgtactttcttttgccgaattaccctcaattataagtttggaacacatttttttctcccaacaatagcctttggaagacagtatatttccacttgatgtacatgactagaaaatttaaagtgcatgcatgagatgagaggcctttgattgttcagtcatattatttcatttcgcaactgatgagacgatatgatattgacacatgatatgtaattatatatagagctatatctaatagaaaattcattcttaaatcgaagttcctgttcctgtatcaacggtttgctggtttgcaaagatggtatatcaacatgattatatagctatatgttatctaattaatgctacttttaacatatacaagttaataagttatttgtgccataaaatcacacatagaaagctagaatgcctcactacaagtataatattgatcttaagaaaatatatattaggagcctttatgctagacacggttgtacctaataagagaaaacttgtccagccaagctaaattgtcaaataggtcgaatattttgcatcctgcatgaagaaagctgcagaaggggttttcagct

SEQ ID NO: 64840 - DNA, 711 bp, Oryza sativa
tatttctttttatgccacatgtagccaagcctcctcttgctctatacaggttcaaagtacgctaaacacaacacatacgcatatatgctctgacttttcaagctgaagtgttttatatgctagctacgcgttccacttgtcaatctcttttttctactctgaaactgcgcagagatgatcactccaacattttgactgtgtacttgaccatatcaaagtgctagcttagtatattaattccttttgtttggccatcaagttagtaattaattccaagttgatcatgcagcaacaaaaactatctgtcattaattctgaagaattattaatcctttaatttcaagcttgttcagttctgattgattggtttggttgcaggtgagggagggcagccgtgcacgatgctggtgaggaccctgcattgggtggtgccatcctactcaatctggggcttgcccttcttcctcttctactccactcgcttctcccagctcttctacgagaggcccaaccagggcatcttcagatcactcctctgccgcctcatgaccccattggtatgtacatactcactcgatctactcatttcacgtgaacatcttatcagaaattaagttcagaatgtgcatgctcaagactttgacaatattattttgtttgtagtagctagctagcttgtcagcatcataatttaccatgtttttttttggg

SEQ ID NO: 64841 - DNA, 1136 bp, Oryza sativa
gctaatacccttgctttggccaacaaccaatgtcaagtttgtcaactagtaatcaactaatcttgatcagatcctcctataaattgacgagaaacatgcagtattcaaatcatcaagcagctcctggttttgcagctctagctattgcctagcaagctactagccactgctaatcttgccatggcttccaattcggttctcttcgccacggtactcgccatggccgtcgtgctcaccggcagcagcagctgccaagcggctcgcctcctcgccgacgcaacaccgcctgccgtgccggcggtcaccttgccaccgatgccagccattcctgccatcccggcggcgacactgccgccgattccggcggtgccaaccgtgccgaacgccgcgttgccgcccatgccggccgtgcccaaggtggcactgccgccgatgcccgcggtgccggctgtgcccaccgtccccgcggtggcgctgccgccgatgcccgcggtgcccgctgtgccgacggcgacgttgccgccgatgccggccgtgcccgccgtgccgaacgccgtgctaccgcccattccggccgtgccgaaggtgacgctgccgccgatgccgtcgattccggcggtgcccaaggtgacgctgccgccgatgccatccgtgccgatgccgttcttggcacctcctccttcggcataattaaggacgctgccagtgcttgtatatttagtgggtcatttgatttgattaatcttttggttatgtattaatttcccctgcttgatttgttttctgtgtgtaaatgcatgttgtatacttgtatgcgagttaattttttttgtaatttgttcaagctgtacatggagtgcgcggctataagtatttgtatatggcatttgtttatataagttcattttggttggtttaacttctgttcatatttcataatggttgtattttgttgcatatatatgtcttttggtaacttggatcattaattgtatcaaccgagatgtgtgggccggtattctaagacgaagtacaataaaaatggttcaacacaataaagatgactcaacaggctgtatatagaaaactacatatataagtaaaatcctacatagatttgtactatctataaaaaa

SEQ ID NO: 64842 - DNA, 18373 bp, Oryza sativa
gaacctactacctattatgaagcaatggtgggaccagactctgagaaatggcttggagccatgaaatccgaaatagaatctatgcatgtcaatcaagtttggaacttggttgatccacctgatggtgtaaaagccattgagtgcaaatgggtctttaagaaaaagatagatgtagatggaaatgttcacatctacaaggcacgattggtggcgaaaggtttcagacaaattcaatgtgttgattatgatgaaactttctcgccagtcgccatgctaaaatctattcggattgttttagcgattgttgcctatttcgattatgagatatagcaaattgatgtcaaaacaactttcctcaatggaaatctcgatgaggatgtgtacatgacacaacccaagggttttgttgatccacaatcagctaaaaagatatgcaaattgcagaaatctatttatgggttgaagcaagcatctcagagttggaatattcgttttgacaaagtaggcattgggctttgtcaaaaacgaagaagagccttgtgtatacaagaagattagtgggagcgcactcgtgtttctaatcctatatgtagatgacatattattgattgggaatgatattcctatgcttgaatccgttaagacatcgttgaaaaaatagtttttcaatgaaggacttaggggaagcagcatatattctgggcataaggatctatagagatagatcaaagaggctaattggattaagccagagtacatacattgacaaggtgttgaagaggttcaacatggcattaatcttggcaagaatcaatgtcctcaaacgactgatgagcgaaacaagatgagtgtgattccatatgccttggcaatcggatccatcatgtatgctatgctatgtacacgtccagatttttcatatgcacttagtgcaacaagccgataccaatcagatctaggtgagagtcactggatagctataaagaatatcctgaagtacttgagaagaactaaggatatgttcctagtctatggagaacaggaagagctcgttgtaaatggttacactgatccaagcttccaaaccgacaaagatgattttagatcgcagtttggatttgtggtctgcctgaatggaggcgttgtgagttgaaagagttccaagcaagatacagtggctgattctacaacagaagccgaatacattgccgcttctgaagcaacaaaggaggctgtttcgataaagaaatttgtttctcaactaggtgtgatgactagtgcttctagccctttggacctgtattgcgataatagtggtgccattgcgcaagccaaggagcctagatcacatcaaaagtacaaacacattttacggcggtatcacctcattcgcgagatagtgggtagaggaaatgtgaagatatgcaaaatacatacggatttgaatgttgcagatccgttgacaaagccactccctcagcctaagcatgagacacacactagggcaatgggtgtaagatacattcatgattgactctagtgcaagtggaagactgttagtgacatgccctagagacaatcatagagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgtggacacatgatagtgaacatgttgttggatagacccaacatgagacactgcaagagccatatgtgttgtgtcatcagtgatctcatttagtgttggtgttgaatccttagacctgagattatcatggttctcaacatgtgtagtagcttacttaggactgctaaacgctactccgtaattggatagttataaaagtagtttttgggtatgctatgaaacatgtagtgggatatgaataatcaagatgggatttgcgcttcctatggagagatatctctaggcccctcgatgttgtagattatggaaatgcatggccatgccaaaggtgattgaggaatcaatcacaagttatataatctatcaacaggttcgagtggatgattgagctattagaggatggcacatatctagccttgagtttaatcgatatcgtgaggcaaaggggttcgtacaagtatacactagagattcagccgatatgatctttatgtaagcccggtgggtcaatacgttctgctaggggccgttgttgatgcgtggaccaaaaaggagttttcgggttacagcggagtatatatgaacctacagggtcgcatgcttaatgggccggaataaggggattggatagagatgcaatataagcttaattcggatagggatccgaataggagtcctacgggccttggaggcccgagtgatggatcctatatattcgtgaggggtgtgaccggcggaggcattgcatcacgtgagaaaccctagccatcacttccctctccgagcaaaaccctagccgcgcgcgggtgctagcagatctgcgcgtggcgttccgtccctatacgtgtggataccggtagaggcgccgctattttgcggtgctgattggcgtgggagtacggcgaggagaacgcacgaggaggacaaggtcgagccggtgcgatcgactacttcctctacatcgacgcgcgctacttcgcgatagttcctttgacttctcagcgtcttcttccgctggacagcacgtcgagtggtaacgatctatgatctaatacttgcatggttcctggtttacgcgatagaaaattttgatttatgctatcgtagcctacgcgtatcccaacatgaggaggcgcggcccaccactggaagaggcggttgctgcattgcgagggcgttggcggtggcggcaccgggtggtacttgtggagcagcggcgttggtggtgggagcaaggacgacgttatggacaacggaggcggtggcgcagccgcgacaccatcatgtccttcatgtgtcgccgccgcactgtgtagtcctgctccaccttagacgttgtgcaccctatcaacccccgcaaactggtgccactactgccaatgccgacccatgcactacataccgccgacggtgctccccgcatcctcctcccgtgcctcacttgatctacaccgtaactgttgtgggcgtcatcgcacggtgtccctactccgccgctgtcctgactgtccccgttccttcgtcatcgtcgcgcactccacccgctggtcgcgccactgctcgtggcttgcagtgctcactggagaagagagaaaggagggagatagaggatgtgataaggaagaagatctagaggatgaggaacacaaaggatggacaattagtggagtgaagagatttaaaagtaaaaatagaatgggacttctgaaagctgatcagatcaagctttgatctacgtaccttaagtacaaacaggtctatcttctaaatgaagatgtaacatattttcgtatatggttgccatgcaaagaaaggggtctgtgcccaaaccacatattttcctatatagcaaaatatgagtaatattgatctcaatttatttgtttaattacaaattaaataacagttttaaaaattaaaaactggagattttgttcagtacatgatcacttttatacgtacaggagggagggaggtggggatggtcgtacatacgtacaggagtgagggaggtgttggtggaagggatttattttttaaaagatttgatctaataactgaaaatactggatccaccaaattgagtgaaaatcaacgattagatatttttattttcttagaatttttaggatttcctttaatttattagaatgccacttggtgacttaggagcgttcgtaggatgctacgtggtggtgtaggagcgtttgtagaaagtttaatagactaaaaacaattgtttatttatagtagcatcgagaccgctcctgtacatgaacagctagtgattgcacgttcactacccgctaaaactccgtggaaaaacagatctaattatttatggtaacaaattatggtgcatatctttgaactgctttaattaggaaagaaaataagagaatgagggggaggaacgggatagatcgtgcacatggatggagggatttgtacgtacgtacacacgtgtggggccggccaggagagaagggtgaaggggatttagttttgatctaatggttaatattattgggtccacctttttaagtgaaaactgatggttagatgtttttcttttttacagatttttctataaattattagagcgccacatggcggcttaggagcgtttgtagaatgcttcgtggcggtgtaggagcgtttgtaagaagtttaatagacttttagtatataatagaagatagatagatagatagattttgtatatataataaatgaagctcctagtcttgtactaggaaagaggttagagaatatgggttgtgttggggttttatgaagagaaaaggaaagttgggaccattgttgaatcaaagttgattcctttgttcccgagaaggcaaattaattaatcaggttacttgagaagagaacctgattttctacaagaatatcacatggtaagttactttataagataaatcgaagtgtgctaaaatccattatgccttcctgagcagaagaaaagacctgaaatcccatactgatttgtgagttgtgaggaattcattaacgactggatgagaaggcgattctctcattagcatccttaatacatagagcaatgaggttcagaacacacattaacccaaactctgctcacggacacatttcatcacaacattctattgggactttttgccatgtagtctaaaaaatccaagtagctccatggtccttccagatccatccatgccaaatttacaaccacagctcatcaaatatatagcatagtattgttgggggagtgggttcaccctcaaagccaagaggccttatgccccccaccattttcttggtgtgtaggagggagcctccgggaagaatccctttgaaggccttgccacaggtctctctaggtgagctctgggagacctccaggggcaccttcaagaccggtcatccaggctccaggggtgctattggcacaagcaagtagaggagggcagcattgatggcgcattcaaggcaaccaaccacccctgacttcaatggcagtagcaggtgaagcggggccgatgcgcctcggtatcacgcctcgctctcgagccgcacactccgggaatcacaggacccccagcaatgctggtttaatgggtgaaatcccatcctttatcccctaaggttttacctcgctaccctcgagctggaggccacctgccacccttagccaaagggctagctagctccataagggcaccgttgtaatctcccatactgctgtaagggtatataagtataatcctaccccccatgaggggacataatgaatagagaaggatactaccatagactggtggttgaccttaatttgatgaacttggttccaacacatacttaaaattaaattagagtatataagtgccagatggactcaaagcacttaaaccgaaggacaaatccaatagctccaacaacctgtctctaaacaacaagcaaaagcaacaagtagaataatatggaaacaaaagtggtaggtgaagatgaccttgcacatatatagatgccttagagaccactatggcgatggagacaacatgtggtaagacggtcttgccaccaaagagtaaggaacacctgagatagagctagacctagtgctggtggcacttgtactagaaagaccagcgactgtgatgtccgagaaaacacaggagcactagcagccacgttagaattggagatcacttaagcctagctggataatcaactaacttctccagatgaagatagaagcaatcataggaagtatgcccaataacttttggtactgccctgacattgtgagtaatcaataggagtaaatgtagtgtctagggagcaaagacgtgtatcctcagcgattatatatatctacaagaacctctggccatggtaggatgtgcacgtcatccaatcaactggacttgaatggactcaaattgggagggaaattgcatgacaaattggtacagtagattttcctggtcgttctcctctctcgccttgcattgtgcacaacctgaacttggccagacaactgaataaaaccatcataaaattcttcaatggactattcttgttgtttaattaatagccacctatacactcatgaatatttattccataacaggatcaactgcatgttctccatgccttaaccttagttgcatctgttcgatcatcaggaggatcatctgcgagttgacatgcttggccaattaacattcgaagcatataaaccgaaagttcccattcttgaaaatttttaccatttagcttaatgtccatggagagctagcagagatcaacctccaagaaaaggttcgaatgtttccatcaagaaatgcagaggaaaaattgataagttgagtggagtgaagcttggttattgaacttgatgtagtgtctcttggatgaagatgactttgtattgaaaattttgtggagcctctgataagtatatagtatactagtatcattgccagcttaaatcttatgttactataaagttcatgcccactaacatctaaagcttaacacgcaaatatgccacatcaccctcattagcaattattatatagattattttaaatcacatgcaagtgtgccacatcatcacctactaacaattattatctatattattttaaatatcaagcaaacatgacatatcatttacaatttttttatattttaaaacttaatatgaaagcaatgtcaaatcattatttccacatcattttcatattatttaaacatatacattcaccatttctagaatgtatgacatgcatttgacatgcattcatctagacatctcgtagcaaagcgtggggtatcaactagttgattcaaggtgggaatacgaactgaaacgtcaattatatactaacaacgtcggttcacagcgaaccggcagtggtgacccttttggggtagtgatgtttcctaggagatatttaactatttgccactcttacaagtggcaattaagaatttagcactggactcgcatgttatacacacatgaggatccaaatgtcgagtggtaaatccttaattgccacatcttaaaagtggcgaaaagttaaatgccccatttttaaaccctagtattaatgcgcaaacttaatttggtggagcctctaattagttaagataacgaaaaaaataggaaatgctcctgaactaaacatgctgcatcatgttagaataagcgttcactacttaaaagatacacatagaggtcggcactataggtgccggaagtgttaaaattggcacctctagaccttttcccactcagcgggacacctttaagcaactataaatggtggttcaaaagaaaaaccggcccctatactatagaagtttttttaaaaaaaatagaacctttaatatattataggtgtcagttaattaaaaaaacaaaaaaaacaacatctaaaatcgagccgaaccaaacggtgacctcccgtccttatcatctcctcctcctcctcatctatcacgtcattatcctctcatttctcctccaccgcactctcctctctctctctctcgctcttggtccctctctctctctccctcggctctctacccggtgttggcgcgaggaggcaacggcttgcagccgctggaggggaggcggcagcggcaggcagcgacctcgcctccgccaagtcaggctggaagggaggcgacagcggtggcatgcgacggtgggagggaggtggaggcatcgactggtggcgcttcgccagatccgtcgggaggaaaggctgcgacagcagagtgccaccgcgggtgggaggcagaggcagcgacgggcggtggcctctccttcgctagatctattttttagtgattttagtgctcttagtattctagtgttcccatgttcttggatgttcttgattggtttgggtgaaggggagttgctcgatgcttgaattgaatcgagccgatgcatcgagcttgctttttttttattcgtggaacctcaaagtactggttctctagcacctattctcttttcatatcagtgccgacttcaaggtgttggctgaaaaatactgcacctttgtggggttcacaacaatgtcactttctgtagcattggttgtatatactagccctagtttagtacttttcggttacagttggacttgtaattgtaataggtcgtaggagatagagttagagtcggactctataacacggcaaccctttaaataaagagcaaacatcacaatgcaaccatgacaactataatgtagcgtagacacgtatggagaggatgacggcaacgccatggacctgtagcttctaggtgctatattgattgggatgagcgcccataatcaaagccccagagaatatgtttcagctgaacctctcgttaacaaatattgtttgttcaggtgtctccatctgacgtgtcttaggtgatcgatgactgaagtgatcgggaatgttagttgtagttccgctatatcggctaaattttataacacatcattccatctagagcaaactaaatccaaaacgaatgcacatcatatgattcaattgccaaggcaattagcaaagcttggtgcagtgtatgccgagtgaggacagaatggttggaacacgtcacaggaaacaaccatcctactgtactcctctgattctgactcttctattcttcctccaaggctccaccatgacattacagcttgtctaccttccctgaataaccactgtccgaatttctatctacccgaaaccaaatacatagtaggctgcatcatcagtcagtagcttggagcaatgaagatcattgtacacttgtcagttcaactccaactttattttttcctctttaatttgcatcgactttcctgatgcccctcatgccaaaactccaatgcattctctaaccagaacacataatttgtgtttgcaggagttaatatctaaagccgaagtagaacaacaacattggttgttgtaatctcaaagaagttgactgtgatataacttagtgagagcccctgaacacgaagggacataataagataaattgaggcttcaaacttgctatatggatgattacggtttatcaaaagagagagcaatataagtacaaattaagtagttcagcttgttagtttgtattgtacgagtagtttcttttcataatttcaccaaaaatccaatcttgaaataccgaccatatacatgtcctaagatagcatttgtatattcagcctgcttcaactcacctaacgtacattgtttcgttttacatgatttttcattcctattttgtgagcttatgtcggagaaatataataatctcttgtaaaaaaacaatttaattctaaaatgaggaatatgatcatggcaccagtacaaaaccttccatctgtgacggcttctaacatgtctggaattagcgtaccgtcacaaggaagtcatctcaatcgggccaaaaaaaacaccttattgagattggtcgcacagacatgctagatggacgtaaaactaaggcccgtcatggatgacacctatccgtgacgggccataacttagacccgattgagataacattccatatctcaatcggccctcaatttggcacccgccacggatgaccatcatttgtgacgggcaccaacttggagcctgattgagataacaactaggcccgtcacagataactcatccatgacgttctctatactaatgcccgattgagatcacttaatctctatctagttttaactaatatctctatctagttttaactaatgcccgtcaccgatgagtattttttcatttttcatatgacatgtttatatttgtgagttgacttgtagcaaaataattaactgcaatataataatttattttattagtcaataatttttcaggtagtaaataatttcaaatagaaaaattgtcaacaacaaagttgtataacttatcaagatttacaacttttattttggttattttttatataacttttttgaacagtttgaatttgaatttaaaaatatgacaacttcaaacagcattttgaaatactaaatgatttcaaatggaaaaattgttaacaacaaagttctatatcttatcaagatttacaactttcattttggtcagttttctatataaatttttttttgaatagtttgaatttgaacttgaaaatatgacaacttcaaaacaacatttcaaatactaaatgatttcaactaaaaaagttatcaacaacaaagttgtataacccataaaatctgtaactattattttgatcattttctatataacatttttttgaatagtttgaatttgaatttgaaaatatgacgacttcaaacaacatttttaaatactaaatggtttcaaatttacatatctatgttatagtttataaaaccagatgagagatatgtgaattttgtgaacaatgttactatcactttgtcggatgaagaaatgaccaaaataaaagttataggtcttgatgagttatacaactttgttgttgatgacttgcagttgaaatcatttagtatttccaaatgttgtttgaagttgtcatatttttaaattcaaattcaaattgttaaaaaaatgttatatagaaaaatgacaaaaataaaagttatatatcttgataagctatacaactttgttgttgacaatttttccatttgaagtcatttactacccaaaaattatttgaatttcttatattttaaaatttaaattttatatagttcaatcaaactcggatggagaaatgaccaaaataaaattggtagatttcaatgagttctacaactttttcatatgagttaattcggtatcataaaattcaatttgaaattcattttcacctagaagtctgatttgcctcctcttccctctcaaccttatcttctcttctcactcagtcctctctctctctctcaaccttatcttctcttctcactcaatcctgtctctctctctccctctcttcatttgggcgaagagtgggcggtgagccagcgacgcgggcggcgcctcagtgacttcaggcggtggcgccactgccatattctcctcaccgcagccgccgctgccaacgaggaggcgaccagctccatcccccccccccccccgatgtcgatgacaacaaggaggaggcggcatcagcggttgagtgcggctgttctggccatatattttatatttggcttgtcctgaagatcctaccgtaatagatgggttccattggttttctgaaagttcccagctatacttttttcgtaattttctcatttcttacttctactgaaatgagaaaatttaattctagcagcatacatgacggttaagctgatttctctcccatatttgctacaggacatccaaaaaacgtgtaattagagataccgtaaaaatgcgtatttgctgtaggacatcgcaaaaaaatggttattagctcctggacacccgctgcattaatttattatttttggaggaataggagagagaaacggttgtataagtacggttctacccttattcttctctctctcattctttctctctttctctctctgctatttcttcaagtgagcccgagggagagggagagcgctggtgatggcatgggccggtgtagcgccttgactgtggcggcgctgcgcggtcatgcgggagatggtgccagagctagagggcaggttgtgccggcgcagttgggcggcatcggcgcgcaggcaagggcggccgggctcggcggagcgaccacgccaggagctcggctgctccaggccgacttccggaggctggaccggatggcgccggcgccggcgcggcgaggctcaagccgtcgttgcgggcgctcttctcatgtgggatgttcagcacctgcacacacccagcactcagcccaatggcaacgcccaacaacaatgttgtagcggggatgagtgggtctaagggcggatcgagcacgccataaggttggttgtggaggcggcgtcgtcgctggttgtggaggtggcggcagaggtgacggtggatgcagcagcgggcagcggcttcgatgatggtcaacgagcccgacggctgtggtgatggaggcagcggcaagcagcgctgggaagtgggcaacggtgatagtttcgatgacgatcagcgagccggcggcagcggcttcgattgcgacggttggcgagtggcgctgggaagcggctgccagcaatgggggttagatagggctaagggcaattttgtctttttgaaatttctctctcctctttttgataagaaatgataaaatattatctcgggtgtcctatagcaaattatacaaattttgtggtgtccatcaccagcgacacgattttacagtgtctcccagccaattatataatttttggatgtcctagggcaaattttgccttgaaaaaaataggccaaatttgtagtctagcattttggaagacacaaccctccacaacaatttgtgtgtgcatgctttaggggtgtttttgcctcaatatcatatattattaatacgaaggtgcaggtatcatattcgaaaaacataaaagtacaaaagcagcaatccaagaattttcctttggtaaacatggcatttaaaaaccacatcctagcgcataaacaggtgaggtttttacattcaaatttaaattccattaattgacacaaaaatagttcagctgcttccagtattttcagttagaaatatttccacccaaatagcatgagttgtcccaaataccaccgatatatgaaaaatacctggtaattgataacaaatagcatgagttgtccactcttagggaagtactggaagctgaatgtaagaatcttacaagtcagttgaatctagattcagatctgggataatttggatggtcagtcttgagcaattttatggttgttgaggaggtaccaaatttatgatagaaatagtcgtacctcatagtattttctcaaggactttaaaattcctcagcagtcttagctatgattttcctactgatggggcccttactctaaaccgtgtactttgttcacatataattcgctgtcatggaaacttaactagccctgacagccaaaaatcgtcaggaaaatgcataatcacgtaaggaaaatacatcctgacgtggcactgtcagaaaaattccatcagaactgacctatcggctggagcggagctagaacgaaatggagagaagtgacacttgcttaacttactctactttatatcgagtttaagctgatatgggtgcctaaatatatattgagggtgatgcatacaggtgaaaataggtgagttatagctacaaaattttcttaatcgggttcgtgggcaccctcgtcaataccctaactcagctcctgcctatcggcaaaattttaatttgcgtaatgtgtcaccgtcattggtatgttcactgcaaaccattggtgtatttagttcgataagcctagtatgatctttgctttgagttctcaatcgccacaatatttggggctcaaatgtttacttcactatccttcatcactgtgtgccccgttgcatcacctgtgtgtcaattttgtgtttggatgaatattgtacagtagatatacatgattggtttgaatgagaaagcatgtcgtagactagtagttacgttggtttaattgtgtcgattttgtgcaacatttacatccatccaatggaaccaacagcatccacgcgagtttgaactgaaaagcgtcgagttatcccgtttgaatcttctaaggatgaaattaaaagcaaatacgtgaaacgagataaccatttaacgcatgacttaaaaaatagatttatctaatattttaaaacaacttctatatagaatattttcggataaaatacaccgtttagcagtttgaaaaacatgttaacggaaatcgaggaaaaatatgtttctttatgaagtcagaatggggccttagacaaagaactagatagcggactaatttttcattatggacttttctgaggcataagatcagcactacgttttaatttaattagccagctcgacttaattttaaattgtcagtttgaattaactgaaacgtctctcaacttttcatttttaggaatgaagcatttcttgctttgcaccgtgggagattgaattggaccagagtagttcagttttcagaatagtggattggattgaaagcagtatgctagctagatttaactttgcacgctctatgtacatcgtgcagcacgactgtttccctcatttgctaaaatagtacaattctggcaaataattcaaaagccagcaagcaactgattaactaattaaggtttatcaaaggagacgctgaagaagcaacgctaggaaaaatggagcccagagatgacaaattttatcagacaaggagactgatgctgagtagaagagtacaacagattattcgtagaggaagcacgggacaagatgccatagtcaagtgtagtttacttgctttttttttttaaggaatcagcaggagactgtgctatttctttgaatatagaggttaaagaaaatacaacctctgaaggtaaagaaaaaaacatacaaaataataaaggcctatatttagttaggtaaaaactcctgaaacctccttgcacatgctatagcctatgtttttgcctcctcttttattttcgccatcaggctaggtaacacggtctctttgagcctaaaaatatattggttcatttccttccaaatttcccaggcgaaaagtaggattaggattcacagtcctttcttggacgcttcctttatgttggctagtctttcccacccgtcttgaacactgtgacatgggtcccattggttcggattcagtttgtttgagaaactgtcagtgcttcctctgcagcaagcttcttggacaaatcattgatgcagaacgaagcaagacacgagttcaactttccaataggtgaccctcttctgttttgctgattactcccaagccaataccattgggtttatataagaacaaaagaattagtgatctccaaaagtagttttcatatgtacagaaaggtgttgaagaaactagaatcatgggaatgtatatgtgatgctccttttatttttcctacaatgatgtggctatatattcggtatggatgtggacagggctgacaaacaatggaaccatccatgtagcctgcaactttggcactaactataattaatgctaattacttttattatctcttatgaagacatatcacacgaattatttgtagcatttggttaattattctctagctatacacacatattctcatttatacctagaactttatactatgccatccctaattatttgtagtctttgatctcttatgaagccacactatcaaatctatggatggtgtgacctgtgtaaagcagatgaacttatactgtttagtaacaaagtaaatccatttcacacttcatatttactaaaagtccataaaacttcctacaaacgctcctacgctgccatatggcattctacaaatactcctaaaccgcatgtgtcattctacaatccaccgtcgattttcacttaaattggtagatccgttattttagaccgttagattatatccactgggttgtacttcctatcggtactgttcgtttgaaaaaaaaaacaactaacgtacgtatacgatgaaaaaaagctatcaagacaaaaaaaaacattgagatataccgttcacttgaaaaaaaaaggaacctgcccatgtttgctgtaagccccataaaaaaaaactattaaaccctaaaagtaaatatcagtacggtgctaaaaccatcggaaacaaaatagatggcctttttaaattaggattttctatactataacaataaaattcaaatatagtcacgacgcttctacaagccctcttactatttgattggtattcctaggcaattattccttaatcaattatcatatacatttttttctttgccaaattggtttaataacaaattactacagcattaaaaacaacattaatataacatatgcattaaactactcatgatatattttataatttatattttcctatagctaaggaattctaatatgtcgggcatctatctatctatctatcttctatcttctatctatctatctatctattatatactaaaagtccattaaacttcctacgaacgctcctaaaccgccacgtggcgctctacaaacgcccctaagtcgccacatggcactatctaatctcaccgttgattttcacttaaattggtggtcccgttagtctacaccattagattagatctattattaaaaaataataacctcctcatgatctgtacgtatgtgtttgtacgatactactgctgatctttccatacgtacaaacgtaatgtacattatctttcctaatcttgctcgaacccaaaaaaaaacgtacacatgaaaaaaaaagacagaaaaaacatacttccataaaaatcgatggttttaaaaatatgattttagataaaatatattacttcacaaatataaatatatttagttaaataatgatctatataaatatccaatcaatgttctcaaaaccatattctaaatctatctatctatctatctattattatatactaaaagtcaattaaacttcctacaaacgctcctaaaccgccacatggcatgctacaaacgctcataggctgccacttggcattatcaaatctcaccgtcgattttcacttaaattggtggacccgttattttataccattggattatatctattattaaaaaatttcaactttctctgtatatgatttaagagctactactgttgtcatgtacgtacaggtttatacgatgtcttctcccgtacgtacttatgtgcacaaaaacaaaacaatagtttacgtactattcgctggaaagaaaagaaaaaaaccatgcgcatatacataaaaaagacgacaaaaaaatacatcataaaaatcgatgatctttaaataaaatatgattttctaaaatatattacatcacaaatataaatatatatagttaaactaagatctataataataatataaaatatccaaccaatgttccttgaaccatcttctaaattatttttaaattatatatctaatttctgattccgttgttttcctttaattaaattataagttatattgtggtcttaaatatatcacgacacatggggctgatatataatagttagtttttgataatctattatatactaaaaggctattaagcatccttaaaacattctcaaaccgttatatggcattctacaaacactctcatctcaccatgtatcactctagaaaaattatagaaaaaataaaacatctagccatcgattttcactaatatacggtgcacccgtattttctaccctcggatttccttaaagaaaaaaaaaagaaagacccacaccccaccgcttccatccattacgttacgttaggtatatgtacgtagttacgtactccctctgtttcacaatgtaattcattctatcatttctcacattcatattgatgttaatgaatttagacatatatatttatctagattcattaacatcaatatgaatgtgaaaaatgctagaatgacttacattgtgaaacggaggaagtatcatatatccctgccctcaccctaatatataagggcaacatgccctcctattttcaagcattttcttaattaatattggaaaacatactttgtaataaattattttaaacaactatatcatctaaatagctattttttatccgtgcatgggacgagattatttacaataaaatttagaattcaatacctacattaaatatattttaaaagtaaaataaatgtatttctttgggtcatataatgctagagactacctattggtcactcgatatatattaagaaaaatcatatagatttttaaaccatatga

SEQ ID NO: 64843 - DNA, 30367 bp, Oryza sativa
  unsure (1)..(30367): unsure at all n locations
ttacaaattcatcttcattcaataaagtggccgacaggatgagtaaagctatgagtaaagagacttacatttacgagatgagtagcctgattaagcgtttttgcaagcagagatacttcctcgtcttctttctgcttatttattacaatcccttgtggctgcatttcatcgtcccatcatttaaataggataggtgggcgagaatcttcagctgaccggatccgaagagcttcttcttcgtcgccggtcattggacctttacatattcgcggacgatgatgaagcaatcaaataaagtctgtcgagtcaaaatggatttagaagagctgattacctgttatgatttgtagtcaaggacgagcaggtccttgtactttattggatgaactagacttcgggtcggagtcggtatcattttggggagggctgcttgcttgagcctttacttctgggatgtcttcattttgttttgtgcccgactggtttccagtcgggggctcctaatcagcgctggctttagcttcggccgactgatttccagtcagggtatcattgctggcctctacattatcagttgctggttgattactactcgggcgatcttggtcagtcggcccggtttctatcgtaggaccaatctccgtgctagtcagttcaaagtcttttctagaaggatcaatgtcagatggttttctgcagattcaagatatgctatcaacatcatcttaatgatgtgtgtttgacaatatgggagatattgcgagaggacttatacctggatgacttcctgattttgggtattggatgactggatgttttcttcttcgggttggcctgttttggttgtttccagtcgcttctttaccgctagcttttctagcattgtcgccctcatcgtcgctcaagactagtttcctctttcgagagcccgactgttgagtcgactttgggtcgctcggctgagtagtcggctggatctttggtcctccattggcctgaccagtttgtcggcgaggagagcggcgttgagcgagtggaggatcagatttcatcagagaaaattcctatgcaagataatttaagctctcagccgataatacaaaggataaaaggatatcttgagaaaggccggattatttgatacataccggtggaggagggttgaaggcgttatatggtaccactggcagaaggtgtgagtagctaaccacgatagcatttgagaagattttatacattctctccttcataatcctgaactcaagagattctagatcttcacgattagggtcatttttgccatcaaactcgaaggcagtgtgggatctctccttaataggcgccagtcggctcttgatgaagtgtcgagtaatctgttccccttgcagaccttgctcttcgattttagcatgcgttccatcagagtaagcgcttgagcagcttcatctcccattggaagcgagttccaggtttcttgaaatgtcggaggaaggcaggaatactcgggaagcgctggctcaggattttgcacataaaaccaatttgcatgccatcctttgtttgaggttttgaaaggcatggagaagtatttctggcctaaggatccccttaactgaaaacctgccccaccaacgacgcacggcttgctcttgtttggttggggtttcaagaagaagatgcggcggaataaggcaaaatgaggcataatccctagaaaagcttcgcaaacatggataaaattggcaatatggactatggaattggggtttaggtgatgcaagctaatcccgtaaacctccaaaattccccggaagaatcttgaggttgggagagagaaaccaccatagaagaaatgagagaacactacgacctcgtgtgtgtctggggtcggaaatgcttcgccgcatgccggacaccactagatgatctctttcgctggaagaacaccatgcgccaccatctccttcaagttttcctccgttacatcggagggcgcccactgactttcgaagctttctctctcctcagccatgagtgcgagttggatgatgcgatttgatttggaaatggctaggaatggaggggaggttgatgcagtggttgcgcggaagatttttgtgggagatgtgaagttccggcgaggtggattgggatggatttgcgaaccctagctatcgccggtgtggttttgcactgtagcagggaatggggaaagtggcggaggtttcggcggggaagacgaaacggcgctttgctttagcgtatgtttcgctagggtatcaggaggtactaatgggcctgggcctaaacagtactttcagcccaattttattatcagcgtggctggttgtgatccttagggacttaggcatttgtttttgctttggcaacacttgctcacgacagaatagcccgatgctgttaaaatcctttttggcgcagttagataattctttggaattactacaatgcaaataaaaagatgcccaacagaaaagtgttatactaattttgtaggcctttttagactgcaaagctattcgggtcttcttgagatgactgattttaaatgttcattctctcggcatgttatatgcttgctttggtaatggcgtgagtcatggcttaggctattgagactcgtcattcgtcatgctttataccacatttgatggatcttttagagagattttactcggatttttatcatgtgtgttgatttatagacctttagagtgtttctcactcgggttttctttatacttctttggcacattaaagcagtcggtgggaggtttatcagatgccgcatatgcttagccatataatcccttgggagatttggttggaaaaccactcggatggatgtttggatgcactttgacatatgtttagtttttatttaactaatcacatagtcggggctacacctaattaactaatcacctgattttttctatttttcagcccttcacagtctttgattttactactcgggagaccaagactgaggaagctgaagcactcggattgtcgttttggattgcgagagaagattatttcgtcgactgtaaaggtctcaggggctactgtggagattatggataccccagacccacacggcatgtgtatccgactgggtatgggatgccatgtatagatagaatatctttaaagggactcgggttaaattctaaacttgtatgacaaggaaatacccgggatcctagtcgtttacgattgtatccaatctgtaactaccaattccgttagagatatgggctttattttgtaatacggaccccttcccttatataaggaggggtccgggtgcctcaaggggcacgattttgctcccagatcatacgatcaataatacactcgacggatcaatcgttgtacaggagtagggtattacttcttattaagaaggtctgaacctgtataaaatttcttgtctctaaacccatccacttttctagcttgatagccactccttttagtattgccgaaatcttgtttcgacaccgttcaaccttcctaaagatatctgagttgggcagtagcgacgttaatgtcctaggggaaatcgttttgtgcctgtgatatgtaatggaagctagtgtccctagcgcaaacatggatgtttagtttctgctgttatgtgttttttttttctgttttttctgtatcagactatgtttctgttctgggcctgtgtttcagactgggtgagtaaaattacctgctgtcaaaaaaaaaatccatctgcagactccactgaaaacgttaatccacatgttgccagtatcccacacaaatgagttactctgtgttcacagagaggatgtccttatagtgtaatatatggtttggcatgcaaaatatttggtcatgtggacattcagtgggataacatagtatttatgtattgtggtctgtgtagatctttgagtccatgtagctaataagatgctacatcttgttcacaatactttcccatgtgtgtacaacttatgcttgtggcttgtcggctaccaggaaattttaatgcaaaattcactttcttcgaagtattgtgtgtcacctctcgcagtccctgtgtggtatatatgggggatcataaaatttcttatgtcagatctgtggatggaattctttataaggaacaacgatgttagttttgataaagtctctctactaacaactactagcatgtgaatgaagaccggcccttactttcctgcccgggaaaagccattcagaaaagcaagtatctcttctttatgtgcattctttctttagtaccttgtgtaagacactatatacactccttgtacaagtgaaattatattaggttatgggcagtcataatcagttctggtatataagaatctcgagaaaatattttcctagttcatggtcattgtaagcattcctttctctatgcatgagcctcttttcaactttctctttcctaggagatggaatttagggttggaagacatctggaatggaagtaaaaccatatgtggacgaggggatggatggatacatctatattggatcagcaaggggtagtgatggagcatgcctaaaaaaaattggtgggtcaggcatggcgcaacagtcaatggtgttcctaaattcatgctagttggtacaccgtacaccaggtagcacgagtatttctaaatgttttaggctataggtcgtagcatgtgtattcctaattgttttaagctatataattatagtattacttgatattcgaagtactagtatataccttacccccggtaatttttgttataggttcgtcattggtggaagtgtgcagctagcgctaggggctaaattcctcgttgcgatggtgggcggctcagtggttgcgttgatcgttgagctatttgagttggaggctcttgagataggcagagcatctgtagtatatcatgcatgcatcggtactaaaggtgggacccatgtcagatatagcacctcgtgagaactgatgcgatgtataaagttggcaaaggtacttattgtgggtcccacatagattaaaataagataaagaaaacccatcatctctctcatacatgcagaccaaagacacaatttgactgatgcgtgggccctgtcatatgctctttctagtagaatcgggttctatgactagtacccagctcttgcttgagaccggctaaaaaacatatcataatgtgtggatgcggctgtatccttttctctctcttctagtgcctcctctaagtgaaacactgtgtatgctctcaggagcctgtcgatggtatcacactacaacatcaagccattaattcaatgtgatgctcaccaagaactagctaggaagccctctttctctcagatacagggtttcccaaaccgccggggccggggttaccgcgccccggcggtaagcacggttaccgcactgtaaccgtgaaaaccgtacaaaaccgtgcaaaatttatcaaaaattcaaattattttttaaatttatttgaatttaaggaggttaccgcggtatttatattactgtaccccgcggtaagcatggtaagcatggtaaccgcacggttgccggcagtaacgtaaaccctgcacggttgccggcagtaacgtaaaccctgctcagatataggaatttatgtgtagccactgcacaaataccacttaatttgaaacttaattggcaatagtttcagcaagtgattgaatttagctcatgggagatggcatgtctaaggtttcgttaagtatcaataactgatagatcaatgagattaggtgccatgattgaatttcagtaaatcgccaggaaagatgcacgcatgaacagaccatcgttcacttggttatgttgcaactagacaatagagcaaaacacaccggggtggggggttaagaacattacgttcacaacttcacatattgaagcttcatttcacggatgataaattacctttctcaactatttaaattgatgggatgaatcgacaaatgggatatatactaatactttgttctccctgtgattattcactggataaataatttagttggcttttaggaaaatttgtagaaccgcactagtcaatgctagctaaactatgatcttaagaacctttacatttttctaccgattcataagtgggcaccacaacaccagaattacatttatctaaaaacaactatatatactattccccgtgcaaaaaaataaaaaactatactatttatcacagcatcactgcagcacatgatgtggtaggcccaggactaccctagaatttggcctagagaagaccaggtattcatttttcttggcccatgaaaaaagcctggtccaacaaataaaaaaaaccgtaattctctctctcccgtgcactctcccctcccagcctccactccctcccaacagacaagcaacggcgacggcgctcccacgacctgcatggctggcgcgactccggcgctcccgccgtcctgcgaggcccctatgcgcgccgccactcctcccgtccgtccggctcccactaggcgctcgcgcccagccgtggcgcccggcggcgccgctaccttcgcgtgccacactggcgccggcgcggccgcgccctctccacgactccgcgtctccggctcttcgcccctggccagctggccacaccctctctgtcccgcgttcagccgtcacccactcgcccggcctcctgggctcccggctgaccagctcctggcctcccggctcccgcggtctcggtgtccggcccgacaacgctagtgcccagccacccaagccggcaggccccagccgccgtccgcccgtccggccagtgctagtgcactagtgcgccactccctctccggactccggtgaccaattcctcagtccctcactccctctcggcctctcccccttctagaatctagagttctagtagtagtagaccagttgatgacaattttgcatggtttgatggttgtcaggagattgaggcatggagaagtcaagcattgcgttgctttttcagaagcatgaagcaaaaaaagttgcatcttgtgatataccaatcccatatatggatgaagggtcgtctgttcgtgctgtagatgatgctctaattgatgaagacgtaaacgttgttgacgaaaggtcatgtgaagaacaagaacacctccacctccaaatgttcttcatttaggtaagattcaaacttatttgttattttctacttgtattgaaccatttagaattgaaccatttagagttatatactgtaccatttaccacattttatatcgaatcatatcatattgcattcggaattttttttttttgctaggcctaccctgagttcaaatcctgggtccactgagcacatcagtttctttcctatcacgtgagattcatctttgataccctcttaatggcattactgcacaccatagctatctactccctccgtccctaaatatttaacgccgttgatttttctccgtccctaaatatttaacgccgttgtttttcctccgtccctaaatatttaacgccgttgatttttttaaacatgtttgaccgttcgtcttattcaaaaattgttgtgaaatatgtaaaactacatgtatacaatgaatcaaataataggaaaagaatcaataattacttaaattttttaaataagacgaacggtcacatatgttttaaaaagtcaacggcgtcaaatatttagggacggcaggggtatttctttggtccatttatcatcttctttgtacactcatttataatggacaacttgctagcatgaacagtacttgctagcatgatggaaatactgaaaatcggttttaattaatagattgacagctcactccatgacaaacacttgtactatatatagattctcctggagtgagtttggtgtctcggctcgtcttctcttcccttgatactcacgcacctcttttctcgatccacctttttctttcttcacttcatcaccaaactctaaatacgaagggaacacatttttcctggttgctagagttacaattttggactgggagatgtcaggaatagccggatagacactgaagctatattatgtacatcctctggaagccaaatgtcaataggatgatgtgttgtcatctgttctgtaacagtatgtcgaagtgatggaggagattgtgatgtgtccatcactgctcacctagtacatgtgctaggccggaagtggttttcaattgccacgtataccaaaaatttgcccaaaagtcgcatttcagtgtacgaccttcacaaaaaaaatccccaaacatgcacaaacaaatagctctggaggtctttatcttccaaaacatttacactgtataaactgaattttagcttaacttttttggttttttgtaaaactatgaaaaaagcccgtgtacatgcgagagcatattatttaatgttttataattgtaattactccaaatatgtgaatatttaattttgggaaactttttaaatgaaatattgtttaagtctatttcaaacttatcattatgtttgggaatttctgaagtttgttttgattttattataaggatcataataatgcataggctctaaactaaaatttttcgaacctttgaaagctttgttaaatactataatcaaatagataatccacaccaaaggtccgctcatgtatgtcaaaaggccggttggagccggattttcaacaagttaagatggcatgaggtccaatgccataatttatttagcactgaaacaaatacttctttattgaaattacttaaaatagataaaatatataattttttttacgtgcctcaatccttttctgccactgtaacccacccttgtttacttgcatgcttctaattttatatcacaatgctatgatctatatcgtcaatttttttattatttttcactgacatgcaaaagatcaggacatgacctggaataactttttttgatcataagggatatagtgatgtaagtgggtaaaatgatttaaaatttataattgtttaatcgctcccgcccttatcgtcatcgttggccgaggacgctgctctcgtcttcgacgtcggcggtggcccgccgccggatccgctctcccctctggctgcaccgccgccaacacccctcccctccgtcggatctggggagggaaggaaggggagcctccaccaccggggagccgcgggggagggcggccagccgccgcccgctggatcccgcgcctccaccaccgccacgtggaggaggccaacgcgcgccaccatcgggaggagaggagaggagagaggagtaaggagaggaggcaccgcgcggagagacatgagtgaggagaaaaagagatagagaggagacgagagaaagaggggaaaatttaaagtgggtaagagggaaaagagggagtgtgtatttttgcgtgcgactctcttgataagtccgcacgcgataaaatcgaccacacgaaaaaatcgatttttctatgcggtcctcttaaatggtccgcatgcaaaaatgagcctatttttccagacgcgaccaattatggcccatctgcaatctaaatgggtccctgtacaggaaaatcattttttagtagtgtcatttttggatgcaaccaagttcaataattctcctctagcatccattccacgagtgtataaatatatctctagaacaacattggcatacttagaccacaattcatcgaatatgtgccccctgtagaacaaagggcattttgcaaaatctgtttgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccggatgtgtattgatctgacgattaggttgtctcatgccccctagagggcctcctgcccaccttatataggatggggggcaggattacaagatagaaaccttaaccaatacggtatcggtttcctaaatctattttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaactagattactccaaagccgagtgcttcaatcatcttcgccatgatctcccgagtactttttccaagtcagaagactgtggagggctgaaaaataaagtcaggtgcatcgactagatgcacctaataggtgtagccctcgactatgcggttaagtaaacaaaccaagcatatagtcaaggaataaataatccaaccaaccgagtggcttccataattatagttaaccaagcgacttgatattaatatgtagcatatgcggtgtaaatccctgaataacatgatccgagtgatataccgaccgctttgtaaaatatgatgagtgtaacctaaagttggctacattattgaaaattcacatagcaaaacagctataaaaaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaagatgaccacaatatataatcagcctaagccataatattggtcaataaaaatgcacacttacgtggcaaaaagcaacgatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggagaataataattggtccagtctttgagcatagaaaataaactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgtataaccatggaggcgaagaaaccagtcagcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgaatagtcattacttgattgaagatatgtgttgaagatgtccaggtagaaattctgaatattggagagccacttgttgtagtaaaataacatggcattgcatgccgagatgtcgaggttcacaaagacgtcgtggttggtgaagtagcaaaacttgtgaagtagcagcaatagagtttgctggtaccgaagataataaagatgaagtcgctccaccatgatgacaaagttgtgttgtcgtgatgaagtgaacacgagtcggcggcaacagaagcaaaccggtagtgaagacgcgcagttgtgaagataaaagcaccagtcggcggcggcataaccagtcggcaacggaagacgatgatgtccatcagtagtggtagctgtctaaaccagacgtagaggtgagggcactagtcagcagcagatgtagacagcttgcgttgaagatgatgatgcttattagcagtgatggtgatgtagccagccgtgaagaagatagcatcagttggcgtcataacaggccagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggcgaagacgtagacgcccaacaacagcggcataataggccagccgtgcaggcggaaacaccagtcggcggcggtcgaggcggccggtcggtgaagacgtagacgcccaacaacggcggcataataagtcagccgtgcaggcggtgacaccagtcggcggcggacgaggcagccggtcggtgaaagcgtagacgcccaacaacggcagcataataggccagccgtgcaggcggaaacaccagtcggcggcggacgaggcggccggtcggtgaagacgtagacgcccaacaacagcggcataataggccagccgtgcaggcggtaacaccagtcggcggcggacgaggcagccggtcggtgaagacgtagacgcccaacaacagcggcataataggccagccgtgcaggcggaaacaccagtcggcggcggcgaaggcaagccggtcggtgaagacgtagacgcccaacaacggcggcataataagtcagccgtgcaggcggaagcaccagtcggcggcggacgaggcggccggtcggtgaagacgtagacgcccaacaacggcggcataataggccagccgtgcaggcggaaacacctgtcggcggcggtcgaggcggccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgatatgagttcgtcattaatggaacaaagtttcacggattagaatttactactcaggtacttttgcaattattaagagcagaaaataaattatcttatctctatgcttttgatttattccgaataatacttagcaccttgcgttattcggtccatccaacgagcccccgggtgctaggaatcggcccaaaggcaaccatccattggcaaaccgaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggacgaggcggccggtcggtgaagacgtagacgcccaacaacggcagcataataggccagccgtgcaggcggaagcactagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaagcaccagtcggcggcggacgaggcggccggtcggtgaagacatggacgcccaacaacggtggcgtaaaggccagccgtataggcgatgacaccagtcggcggcgacggaggcaggccggcggtgtagatgacgatgcccatcaacggtggtgtgaccaaccgaccgtataggcgaggacaccagtcggcggcgacggaggcgggccggcggtgaagtcgtggacgcccaacagcggcggcataataggccagccgtgtaggcggaggcaccactcggcggcaacgaaggcaggccggtggtgaagtcgtggacgcccaacagcggcggcataataggccagccgtgtaggcggaggcaccagtcggcggcggacgaaggccagccggtcggtgaagacatggacgcccatgaacggtggtgtgaccgaccaaccgtataggcgatgacaccagtcggcggcgacggaggcaggccggcggtgtagatgatgatgcccatcaacggtggtgtgaccaaccgaccgtataggcgaggacgccagtcggcggcgacggaggcaggccggcggtgtagatgacgatgcccatcaacggtggtgtgaccaaccgaccgtataggcgaggacaccagtcggcggcgacggaggcggccggcggtacatgtataaaataatagatcaaataataattagtgatctgtgaattaattctaatttatataagaaaatttagaacgataaaccagatccagatagaatttttggcgacgaagaccctgcccttttgttgagaggatcacggccaaagacaagagtagcaccgatgatgccggcacagagttccatcgcacttctcgacggaaaactcgacgcaacccctacctggcgcgccaactgtcgaaacatgatttcggcaataataaaacggggtagcgcacgagacctaaaagtggatggatgtggagacaaaggatttagacaggttcaggccctctcaatgagaggtaataccctactcctgtttggggatttgaatccgccggatgtgtattgatctgacgattaggttgtctcatgccccctagagggcctcctgcccaccttatataggatggggggcaggattacaagatagaaaccttaaccaatacggtatcggtttcctaaatctattttacaatattatcaaaccaggactttaggctgttccgtaatatataaggaaacataatacccaagtcatgatctgttacatattccatacatataagttatcccctataactagtcggataaccatgccgtgtgggtatggggtacccataatctccacactgtttatcatttatcaacggagcctagcttccatattcaacaggttgattgcttgcatgcatggtacattctttgaagcctcaacttagccaatggaaggtattgggaagattcaggagacattgcgccgtatggtagtttcatggctaaagaacaaagtttctgacgatccatcggcctgctttctgtcataaattcaactatattatggacaggaagtatggaagggcttaccaaaggcatgcaaatatgaaaaaggaagcggcagcgggtggttgcgggtatacattcctagtctttacaatagctatttcctagtttagctttagaccgagttctggtctagtttaactttacactacagaattagcacttttcttgtttaggaattagcctgaccagttttgtactagcagagtcaatcaatcaacaaaatttaaaggcttagcaagacaagtatcctagccaatcaataaagtttgttagagggtgcaaggttctatcgttctctagattcgttttgaccatctgcagccaaatatattaaacaactatatagcatccctgccttaccatgttcgattcagttatcaattttgagtgtgctttagtcagagaaattaagcacatccaagtctcttgcagaagaacattacgttcacaacttcacacattcaagcttcatttcacggatgataaattacctttctcaactatttaaattgatgggatgaatcgacaaatgggatactaatactctggactttcactggataaataatttagtttgcttttaggaaaatttgtagcactgcactggtcagtgctagctaaactatgatcttaagaactttacaatttttctaccgattcataagtgtgcaccacacagcaccagaattacatttgtctaaaaacaactatactattacccgcccccaaaaaaaaactatactatttatcgcagcaccagtgcagcatatatatcagtttctttcctaccacgtctgagatttgttcttgactacagattcatctttgataccctcttaatgttattactgtaccatagctatatatttctttgcttccaatatttatcatcttctttagtccgagtttatttcttataatgtacaacttcctccactacaccggaccaggtcatctgtgacgggtccaaaccctcacttttgacaggtttatcccttggtcacaaattagtggtcactgatgacttaacctcacctgtgaaggttgaaggtccgtcagtggtgagagacacctgtgacgggttacaattagcaaaccattagtggtgagagatatttctaacgagttataattagaacccgtgacagattatgccacctcaaacgagttaaagcagtcaacccgtcacaggtgtgaaaaatcaaccaaaaaaaaacctcgctgcaacaatgatttacagatccacgctgaataatccagaacattttagactacatttctgatccaagaacttacaaggatgatgttacaatgaacataaaaacaaactagtgcaacactgcaaactacttgagaactacaatgtacaccaccttcaagaaaaacaaaacacatcatgtggcttcaacaaacaaatcagtggcaacacatcagtcatccacccctgcgattaatctccagtggcaacacataatgcggcttcaacaagaacacacccggattaaaaacttggcaccgataacttgcaatatctaaaatcaaatcacaagaatacaaaacacatacaaacacatgctcgaagatggaggaggcggcaaggaccggtgctcacaggaggaggtggacactgtagcagccgccgctcggggatgaaggaggcggctagcccttggaggtggctgctcggtgatggaagaggagccggatccggtttcccccgacctggatctggcatcccctaactcgcccttggaggaggcggctagcccttggaggagccggatcaggtgatggaggaggtggctagcccttggaggagccggatctggtgttggagaggctggatttggcatcccctatctcgccgacgttcctgccgggcctcggcttgccgatggacttgacgaggtggctgcagcggccgccggtcctgcctgaactgcctgacgaggtggctgcagtggtcaccggatctcgcccttcctcggccaccggatctcgccacgccgacactcagggatgggacgccgacgcccggccacatctagccacatctggccggcgcccggcggcatctagccgcatcagcgcccgacggcatctggccgcccggccgaggaagaagggagaaagagagaagggcggaagaagaagggagagcacgggtggaggtggaagaagaagggaggcagaagaaaaaaggataagaccaatgggcgtgggttcggagcagggaggaggttatgacggcgatttttttaatcatctttgacgggcagacaaatatttggcccgtcacaggtgactttacctcacctttgacgggttccgcttttggcccgtcacaggtgactagttacctgtgacgggccatatatttctagcccgtcagaggtgactttacctcagttttgacgggttccatttttgacccgtcacaagtgacattacctgtgacgggtcgccgccggatggctcaccgatgatggcatctcatgatggcatctcataggatccgtcaaaggtgaccctcatcactaaccaacacttatgcccgtcacatatgtgccgtcacaagtgtgaggatctggcgtagtgctctctctttaattgacctatgctttcccacagacaaataaacagtacttgctagcatgaggggaatactgaaaatcggttctaattaatagattgatagctaagtgcatggcaaacacttgtatatatagtttctcccggagtttggagtctcgactcgccttctcttccctttatattgatgcacctcttttctcaatccgcgtttttctttcttcactacttcatcaccaaactctaaatacgaaggaaatacatttttcctgcaggttgctagagttacaatttaggactgggagatgtcaggaatagacactgcaggattttgtgtcatgtaacaatatgtcgaaggcattgaaagttgtgatgctttcatgactgctcacctaattcgttggttccattacaagtaagtggcatgttcggctgctttgtaccgtcgttgcgctgccacagccagaagaaacaacacactgttcttgttggctacagcacagcaaaaataagagcagccgaccagagccaagaatgaagatccatgtagaaaaagaagtacaatggcatgctggaacagaaaacgactgtaaccaagcactcataacccaacctaaattaaaaaaaaaattgccgccagaaattcttattagtgctagttctagccacgattcggcaatggtaagtgcctcatgtaacgttccgcttttcgtgagtcgttaaaaactaattcggcaaaatcctatatgtgaaaatttcgttctttgtgtgagagtataagttgtgccaagatctcaattcaaatctccattgttgttccctctcgtcgccatcaaaatcctccacctcaagattccaattccaattcaatttattccaaaggtcaatcgcctcctttgaatcatcgccaaatacttgtcccgattccacaaatatccgagtccaccttaaatccattccttgattcctccctgaaccctcgagttcggatatcgaatttgaatccaaatccaaactccaattctctccaattcaatttctctgccaaagtctgatttatctccctctggctcgttgggccgattcttcctcccttggcccatctcctccctcagcctcgcacatgcgttgcacgcgccgagcggagccgagagagagctctctcgccctcttgtttttctctctctctcccgtctccgttctctctctcttttctctctggcgccgatttcttgctgccgccatccgaacctccaccgccttcgtcactccggcgccaaatcccccgcccatcgccattcaattttcgccgccgcccatcggtttcccccccccccgccccccgcgcgcgcgctcgcgcatggtcagccgctcggtcgccgccgcgtcagccctgacgccgcccgtgaccgcgcgccgcccagccccgtctgcacgcgtgcgtccaagagacgaaggcagagcctcgctctcacgcgctctcccttctctctcagctcgcccaaaatcggcaaggagccgagctcctttctccctccccctttttgctttttcccttccatcgccaccgtcacctcctctgccgcccgtgagcgccagccgcgcccttgacagccagctgcccccttgaccgcctctcccgagtcgattccttcccatcgaagctcctcactcgccacctataaaatccgcactcccctcccatacctctcgctccctctcctccatcacaccatttccgcctcgccgtttgtcgtcgtcctcgccctcctcttccatcgtgcgtgccggggagctagcgagcacgaggagtcgacgaggagctccgcgccgccccatcctcgcgcctccctcactcttctttcccggccgcacgctctcggtgccgcgccgtccctggagcgccgcctccacgaaagccggacacgccccgccgccggctctcccttctcaccaccaccgccaacgccgttttctctcgccggtgatctccccaccgtacccatccctcctaccacacgctgtgccgcacccgccgccgctcgcctaggctcgccggccatcttgctctgtcctggaggccgcctctcgtcgtcgacctctctcggtgtccctccgctccatctgaggttgggaatgcattccctcggtcccggtggtgctcccgccgcccggaatcgagccctcgtcgagcgccgccactttccctctttcctcgccgccgtcgtctcccctcttgtcaattcctcgtgccaccaccctccttgagcctccttgactctccccgaaccgccgccacagccgctggccttctcctttgcttccgcgccgtgctgcctattcctccgccgccgcgcaaagtcgcgtgccgccgtcggccctcctctcattgattcccggcgccgccaccatccccgagccccctcaaacctccctggcgcgctgttgctgccgctcgcctcgccggccgcgcccgcgccgtgccacccatcccgccgtcgcacggccgccgtcgccagccgccgtcgcgccgcctctccatcatccaagctggtggatggaaccgcctcgaccccctctcgcttccagtgtctacgcctcactccggttcgccgccgttcgccggcgcctctcggccgccgcgagccgttggatcccggctccctttcctccatccaacgtggctgcccgcatggcgttgaccgggcccgccccgcccagtcagccggtcagccgcctcctttctctccccagctcatgggctcggcccactagccgtccccccctcggccttttgagacaaagtgagttcatatgttgtccctccttgccgagcctaacacacatgcaacaagtccatatttcctcccaccatcaaatccgctcccctacacaaaagtccatctttcccccttgttggtcccacatgtcaatgagagattaaagaatattcttgggaatattcttatccacaaattcaataaataatttcatatactccaaattccataaatcctttttctttgttccataaatcaattccttattccaaaatttccataaactatttcctttggtcccgcacgtaagtgacggtcaataatattcttgagaatattatttttataaatttcataagccaatttccccttgttccacaaatatcttccttcgcccagaaattccaattaaacttccaaaattcaatatcttctcaaccgttcatctgattgactccgttccgcttccagtaattccataaaattgagatctatttaatggcactattaattagtctaaataggatttttctttgggtccttgtttaggtttttgattgtttgcgtatagtcgcggttaccggattttcgtcaatcgcgggttttctcgaagattcatgaagctcaatgaagaccttgtgcaaggcaagtcacctttgatcatcttgcacctataatttaaatctaagtatctcttttccgcaaatattgcatgaataggattaacacgagtatttcggccacggcttgcgagatagcttgtcggccccaatcctaattgctgcaattaccctccttgaattattgaacacttaaacctcctttgtcgactgttgtgctttgatgcacgggcatcggaacacctcccctcaaatttaaaacatccaacgatgggtaaaacttggggttttgcaaaagacatggaaaacccgacacatgggtcggtgcttgcgaactgaatgaattttccaaaaccgcagaccgggggacgtaccgggagtacagtttcccgctcttgaacttaacgaccatttccttggaatttcattcgaacataaggcaagtgcgacaacatgggtggaatgtgacacccctggctgagtaattagctaatcgggggaaccatgatgccaagagacatgtggattcaacggggtggtgccggggagaacccccgggcttactggcacagtatggtctgggatctaacctgttgtcggtctgggacccctctcattggcatatggtgaacctgtgtcagcttttgaaatgccttgtcgtgaaagccccaagtcaccagacatgtctgatccacacgggctaggtgaccaaggctagtaacgtcgtgtgggtaaagtgtaccctctctgcagagtttattaaactgttcgaacagccgtgcccacggtcatgggcggatgtgaggttattcctagcgtagtattgtttgactactgctttgtgaaattgctgttgtggaatgggatcgatgtttagaaaatctgcagctgatgggatcagctaggcccgggtggccgtttgaaagttgttggccgggtgccaaccttgaatcaattcaaagactgatacattgcacatactccgaccggacgagacgcaccgtctcatccgtgtcgtttaagaagcactcacttagttgttttaagaaggagtttaactaaaatcaattgtgaaaacaagcagcctttcctttgaagcctgcattaaacacttaattcctatggcttgctgagtacgaaagtactcacccttactctatataaatatatatatagttcctctgccctgaaacttaagatgaagtgaagtgaagaatagggtttcgttctggtccccagccgtcgcctgtggtgttggatgttagaccgttggttccgctgctgttgttgttgttggtgtttcctcgtccgtgtcgtctgttgcattctcaggctgtcctgagctgcaacctaagttaagataaataagtcctctatttattttaaggattacaatgattcatgtttgtcaccgtgggtaccagcgctatgtcctgggactggtactgtgatcacggttttgtaggaagcggttcgcgccgtttttcctacgacacactcctatcaggtgctgttgtacggcggtgccagattggggtgtgacacctcaacagtgctagttttttccacgaaccatcactgccaagatcaatcaaatcagtgttggtttgtttcccgaatcaccactaatacttatcattatcccttatagtatttagggacggagcgtgtaccaacttttgccttcccagagcgtgtccagggacgggtggacaggagatcgatcccatcagaaactagctttatcatattcgttttcatatttttttctcagaatcgaaatcggaatcggaaacccggatacgaaaacggaatcgaatattatcgaatacagatacggagcgaatacaaatcgaaacgaatttggtaacgaatattaatcggaacataaaagcccctcaaattgaccttcacaaatcaacgaagaaatataactcgttattttttttaatagaacatatcaacattttcaattttagtgttaataattttgttatatccgattttgtggtcgagggagacgattcaatcaagagtaagacattacgaggctattattgtgttctaaaaacatgttctattgagttattgtgttcttactgctattattttggccatattttcttgtgactttgttttatcaagtaaaattttgattttcaaaaaatagcaacttcaaataatattttgaagcagtaaataatttcaactgaaaaagttatgaatataaaagttgtagaactcatcaagagctaaaacttttattttggtcatttcttcatccgaccaagtgatagtaacattgttcataaaatttgcatatctcttttataacttatgaaaccatatacgagatatgtaaattttgtaaacaatgttactatcgctttgtcggatcaaaaaatgactagaataaaagttatagatcttgataagttatacaactttgttgttgatgactttttgagttgaaatcatttagtatttgaaaatgttgtttgaaggtgtcatattttgaaatccaaattcaaactatttaaacaaagtcatatagaaaaatgacccaaacaaaagttgttgatcctgatgagttatacaaatttgttattgacaatttttccatttaaaatatatttactacccgaaaaattatttgaatttcttatattttaaaattcaaaatttatatagttcaatcaaactcggatgaagaaatgacctaaataaaattggtagatctcaataaattctataactttgtttttgataactttttcacatgagttcatttagtatcataaaatttaattcgaagttgagggaggatatatagacttaatatctaattcttaggcccgttggcccatttagatggagggatatataaacctaatcctagtttctccaacctcccaaactcccacaccttccaatctcctcccagccgccacccgccacccttcctccagctcccgcgactgcgtgcggcggacggcgacggtgacgtcgggggcggggcctcgtgcggcggacggcgacggcgggggctcggcggcgcaaggcgacgacgtgcggcggacggcggcgagtggaaccggccgcgccggcctcggggcggctgggtcatggcgacggcgggaactcggcggtgcgaggcgacggcgtatggcggacggcgacgccggtctcagggcggccggatccagggtcggcggccccgtagccgcgggatccgatgtcgtgaggcgatggcgatggaggggtcttggcggcgtgagtggatgacgtgcggtggatggcgacgagcggatccggcgtgcgacgtgcgacggcgacggcgggaactcggcggcgcgaggcgacggcgtgcagcggacggcgacgagtgattttggatgttgttaatttggattttgctgtttattttgattcggatatccggcaaaaaatgtcggatagtttccggccgaatccgatttccgacaggtaccatcgctattgtattcgaattcgtatccgagaaaaactatccgaattcgtatccgaatccgaaaacatccgaaaaaaatccgaccgcaacaatccgcatccgaaaaacaggattggaactcggaaattatccgtaccactttcatccctaatcccatcagtgttggtttttgtctaaccagcatggataggacaccacatttaaggcttctaggagtatgatagtggtccatgcatagcagtttgtgcggtgtgcgtctactatatgtaataaaaaaaaggtttaggtgccaatgttaaatttttcattcagtaaaaaaatgttaaaaattcttgtggacgaacgagtgaattcacaagagttttccataacaaaatcgaatgaacacagacatgcatgatttaggcttgctctactactcttggaattgttgtagtcaagagctttctgcagcccctctgatcatactgatgcaaagttgcaaaaatatggaacatgcagatatatactgggaatcataaatcattatttgcacgttccatttgcgtgggattcctaattaattactcatgatgtttgtgtcatgtggttttcaaatcttgttaggtaaagtttttcattgccacatcaaaggatgcatatggttatacgagactatgacacgctgtgtgttaaaccgaaattaagtgaagttaagacgaggcaaactgggtagatgagccctagaccatcaaccacatttctcctttcaaatttaattggttttaaaataaagagattttttatttctccaattatatactcacaaagtaggcaatgaacttcagttggatgtaaaagataaacactgtacattaggcgatttaaaggaggctgaatacaccatctaaggacatgttaattgaacaaattttaatcatttatatgggatttgaagattggatatatttggtgcagttaagggaagaaactgttctagacaaaaaaaaaaaactaactagctggtactaatttatcttctcataaaactgctacctatatagcaatgcaagctttaagcctccacttgtgttttgcatgtcactaagtacttcagggctgttgaccactaaggtatatccaactcagctcgttttagatttcaaccaaatatattttaaccaatgtagttcttctagttaggaattttttaaatccacattaactatttctcaacacgacttgtgtgtttagttaggttggagaatgcagttgttcaattttggcatgaggggcatcaggaaagttcatgcaagcaagaaaaagaatgattggagttgaactggctagtggaccaggagcttctccgtgccatgctactgtccgatgatgcacgctactacgtgctacgtttcgtgttgcaggtgattggaacaacggttattcagggaaggtagctagaccagctgtaatgtagtggagccttattagcgacaagttgcgcactctggatcagagcaatatcaaagtaggatgggaggtattaacctggcaattggtgcctagctagcaggatcgtccttgctaattaccttggcaagtgaaccacactactagggaaaagcattatcgcaatcgggcaaaaacggtcttcgcaagcgtggcggccgtccgtccgtaagcaaacgactgtgaagatcggcaggacggccgtccgtctgcgaagataattttcgcaggcggacgttggctagttcggtccgcctgcaaaaatagtaagcggccgcctgcaaaaaaaaaatatccgcctgcgaagataggtagaaaattttganatttaataataatttgcccgtanattttataatattttgcctgttaatagaaattcttgcaagtagattattatgtacatatattgaaagattatcaagcattaggtactgattaatttacatatattgcataactcaaaagtgttgccaaaatatatatattacaatatttttttacattgtcacttcaaatacgccatccagttatattatggcatagcagtgttccactcccgaagatccttgaattcgtcacttgtcactagggcaccctctgggtcgaagaaatctcctttcacatgtcagcattcatggtgtatgaagttgcacagatcacactggacatttgtgatgcctgtatcgttaaagcttgttcgacgttctaatcttggcaactgcatgcattgaagataaacaatatattagtatcataaatatgtgaagctttctagtacatagtatagatacttacatcctctgcgttaaccctgtacctctcattaaccctaaggaattcgcacgcataatacccgcaaaggacagttcctctaagttgcttgtggacacatcatagaaaaaatagttaaattttgcaattagtgaaacaattggaatacattaagtgagtggagtattactggccaataggtatgtactagcagcttctcccttgtttgggtctgttctccacccttgaacttgtagtattggtacgcactgtatggatgtcgtaccgtttcacattaaggaggatatttaattataatattcatataaaaatgtaagagtcacaatcacttactactgtaagattgttagaaattctttgtatgactggtgtctgtaatcgagtgggtctaagactaccacggttccgtctttagggtggatgagtaaacagatataatgatcgctatatattaacaacaacattgtttgttagtaccagctaaaataagacatatgtgtagaagataaatgtaccagacttactcaaaattataagcggccatgacgactctcttattttgaaagtgcaagaaggctcgtccaatgtactgtgcgacaataatcaatttctccttgtgcaagcccttcttgtatttagctatctcttttggagtcttgcccttcagctggtttgaccctggtgctagcctcacggtatgctgtgtttgacagatccgagttggatccaagaagccgataggttcttttttcttcttagcatccatgtattgcatcctacagaagaagtttgttagtaacattcacatggatttgtattgtacatacttttcatgtaattaattaaaactcatactcacatcaccaaacaccgacatagttgacgcccatcttatgccgatgatatatggtgttgagatctgagatatctagccatacgtaaccttcggcaccgaaacaatctgccggtgatcgagctgttatattgcccaagcctttcttgctcgcttccatgtagaaggtatttaaccttctcatctcccatggtccttcgtttagtgcccactccggcaagagtgctttcccatgttcgtacttttccgggcaatcattagttggcaagcatgttggcccggctagtgcagcggccttctgggggtcatcatctctgagtttggcacgttccttaccccctctgaagacggttaccatgaacttctccttgttctcatctttgacttggaatggtggctcctaagcactctaggcacctcagaattggtagtggccttctcagtgacggggtgcttgcacctcggggtatttcgcaggagaagggtcttcaaatatttctggctctgtaccgtcccattccaatcctggtacttcttctatatctgtcccgactgatgccacaaattgcacctctggctctgccactgtaatctccatgtggacatctggcactacaatctccatgggcaccttcggcactgcaatctccggtggcacttccggcactggattgtccttatgcatctcgggttcctccgccttatcagtcaccttcctcttaggttgtctcggaggttttcccaaccccggttttggcactacagattttcgcgtggcgtcggtgcccaattcaaaggatatgtcattcttgtgccaaagaattacaagatcaaccgcatccccaagtatggatacagcatcttgagtagggaagtctatgtcgtaggactcaaacccttcgtggaccacttgcggctgcactttggcatacgcattgcctatgaactcttcattatatgttctcccagtgatagcaatggctatagcggcctcaagagttttcccggcgtgtccaatgggaacgtgcaatctgcagggtgtattctccttgaggtcatcaaaggggtaatcaggctcaggttctttggtttcggggggaggcaaaagcatgtgcttgacgcagaaatccatcatttgcctttcaaaatctgcagccccttcgtctctaagtt

SEQ ID NO: 64844 - DNA, 45971 bp, Oryza sativa
cccccccccccccccccgcatgcgcgtcgccgcgatgcaccgtcgcccgcgtcgccggccgccgtcgtcttctcgccggccgccgccgtcggaggccgcttgccgccgccgccctcgccctaaccggccggccggcttgaagccgagccgagccaggccgccttcctcctttccccgtgagccgccgcccggtgggccccgcctgccagtacccctccctctccccttgtgccgctgaccagtggggcccgcatgtcggcgccgccccaccccttgctgacgtcagccctggggcaatattgcgcaataaatcgattaagggtttttcttttatagtaaaaacacagagaatcttctaaaaatcataactaattcatccgagctccgattaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgttccgtcgatccgcagtttctcgaagacgttgctgaggtctcatcagttcgagagcaaggcaagtcatgcaatacaattgatcatattgtacccaatttacaaatatcccgcatttctattaaatattgcattgttttacaatatcatgtgggatgggtcctattactcagctatatgttgtttcccttatgccattgataacttgggtattaaaatgactagatgttggtttaggagatgcttagccatgcttagttcaactagtgcacaaaaggggaccacattaaagcatagacttgattattggcatagctttggtttagtgccaccgtaatggtgttggttaattaaaatacattacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgtcggtgcacgggaacgtgtcgtggggctgtgtcttgtgggtacagttgtacacctctgatcagagtaaaactattcgaatagccgtgcccgcggttatgggcggtcgaccagattcaccgtgattagtctcacccctagtttagcttaatgaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggtccgtgaatttctgggcgtgacagttgacttgttaaaataaagatgttaacagaaaaaaataaaagaaaaatatttttagaagtgggccaacatgagaaggcccataaacccagcccattagttctcccctaaaacctagagagaggggaaccgaatcccacctcccctcatagtgccgccacccctctccctggccggtgcctccttcctcctctcctcctgtgttcgcatctctcccatctacagcaaattgctctccctagatctccaccttcatagcttggatcaagaagcgaagtagaaaaacggaacgatgaggagaggagtagaaggaggggttagaccggagtctcccctattgtctcctcacaagttctctaaagaaaccctaggtgaggcttatccccttgttgtatcagtttttctagcatggctttagtgcattaattcgtggttagggaaggctagagaaggagtttgggtatttgtggttcggtttgttgaagttctgcatgtgggcagatttgcagtgcttcagtgtttcgatgttttggggctctaaatgttgttttcttcaaaagtgtataactaggaagttgtatatatgttcggatatatcttctgaccaaagggcgcgatttttatctcaagtggtttaggagatataatttttttagtatgactgttgtttttgtgtcataatctggatagtagtagattgaactatttttggaggggctaaacagtagaatcagcccggctgcctatagacaaagttgtagaggtttttcttagctttccatattggtaaagtacaacctgattgggcgcgtagaactccagttatggttgttttagtgtggacagtctgaaattctggacagattctaaagcttgctttcaagcgcaaattagaccatttaaatagcacaataaaaatatgctttctacatgaaagttgtaggtattgctctgtagattttcaaaatttatacattttccgtcatagccttttcatatttcgagatataaaggtttgaagcagcagtcttgtgtataatccaagtggtgttccttgttattgagttttgatgggatggggcagtaggttcacctttttattgttttatacgcatgtttgaatgtgtttgctaaggttttgtttgtgattaggtggtggtccatcagctcgtgcatgataccaatccttcgttgaaggcaagtgtatgacgaactaattgtgtgattcatggattgtttactctatctatttatttctgatatatttcaacgtgataagtaactgcttgtattcatattattgttcatgccatttagatttcaagttgatcttatgtgtacgatcttattcttgttttaatattctggattctgattctgcttaaataattcaaattccctgcttgccatggatgtgtttcaatttggttctttgattccggtttcaattattcaagtaccatgtgtagtcatggtactgcaatttggttctttattcaagttcccgtggataagcgctgatcacgcttactcggctttgccggcaaatgttaggatgtattcactattgtccggaatggaaactactatttcaattcatgtctgcagggatgggaactactatctcctttgacttggtgtttggaaatgtgtttcctatcaaagaaagaaaatcttctgttcatgctttattgtcaatgatgtgtatatgtgttttctagttccatattgtacttgctgattatttttatactcttgtgttttatttggttttaggtacgcattgagaccgacatgcatgggcgggaagtagcacccttatattcacatctacttgcacactatcaaactatattgcttaggtccataatgacacttaaattatatcctggtttggtcttataataatcttttagatttctaatagttttttctccatggattataaggatggatcgtattatgggaatgatattgttattagtttaacttataattgcctgttgtggatgtccgtatttgcaggggtgactctgccgaaatttctaataattttggaagttagtggtttgagtgtttttttggtgtggcactctaggtacgtggttacctggggtgttacacttactctctcccttatcattcccataacaataaagtacactaggtcctcttgtaattcatcttatgctttggtgtgtgtgaatgagggagaggagaggggtatttataggtggagagttgccttgggagagtggagatgctccaagcatcctatgagcatattccttctagcttcatctcctcttgacaagtgtcctctctatgacggtttccaccggtagaaaaggacacaaccgtcattgggatgaggagtacaatcgtcataccgaatatgggctggattgggccagctgcgggttccgccgatccaggggttcggccgaaccctgattggctcccctggcccacatctttcttcaggatgctgacatgtgggccccacttcatgatgctccatgttttggtccaaataattgcacattttatatgttgtagcttaaaaccatgtgagttcatgagagcaaaatatgtttccattctttatgctcattctctcccaactttggtggttgatcacctgcatacaaatatacaccaccactcgtggaaattgttagaaataaatcctaccactatgttggaagtttcacatttgtggttttatacaggtattgacgacgttattttggcacttaacagccgtcaacaggcgccgtggagctccaggcggcgtgtctcccctctttgcgttgtctgccgcgttcatcggcatcagcacttgatgccttgagctgaccaactcagtggctgctggcaggggaagagaggtgaggaagatgatgaatcagtctgacatgtcactggtggagaaatgatttgtgctcccgattggtaaccctctgtaaccccggtttttcaactaggactatgaatccgggactaaagaccactatctttagtcccgattcaaatacccgggactaaagatcgatttttagtcctggtcaaccaggactaaagataaaatcgtctttagcccggattaatgttaccaaccgggagtaagggattttttttcttttttgttttttttgcttccactgctgtttttctatttccatctcgagcacaatcgcacaaaaatcacatgcataaatcatttacaaatcacgcacaacacacctaaatcatccacaaaaatcatttacaaatcatacacaacacatgcccatccacaatccacaaatcatccccaaatcaacaaaaaaatctacacatcaattcacaaaataaaaaaaagctccacaggaccacaaccaccacccgaccacctcccctcccggatccggtggaggagagtccgccgccaccctcgcaccgccctagtgccaccgccgccaccccgccggctagctcgccctgccgcctccccctcccagatctggcggaggggaggccgtcgccccgccgcttccccggccgcctcccctcccagatttggcagaggggaggccgccacccctcgccactttcccggccgctcggctcgccccgccgcctcccctccaggaccggcggaggggaggccgcccccgccgccccgccgcttcccttcccctcccactgccggctgttgctaagagggagggagagggagagggagcggcttgatatcgagagagggagaaaaatctctccgcagagagttgagagaggacaatgcggagagatttttctaagtgttgattatataatctggttggtaacagggcggggagaatgacgcagagagggctgatccggatttttcttttgtcccggttggtattaccaacggggactaaaaatagtataagcatgacaccagcctgacaatttgtcccggttggtaaaaaagtaccccgggctttttgaaccaggactaaagatttagtcccagttcttactcaatccaggagtatagtggattttggctgaccgggcaaagatggtttctccagtagtgagtgggacattaattattttcaaatatattttattgacttagatatgattgacacatcagcgccacattggcgaaaccacaatgtttcaaacttcgaacggttttaaaaattgaggggtgtattatacccggttttgaagtaaggggtgtatttcagacaaatgctatatagttgagggtaaaatggaccgaataaaatatgtttgtccgtcgctaatgacgtgcttaatgaatttacgttgcacaattaacaaaaataatccatataaatcgagggtacatttgcaacatttttttttggttttatttgccttttcagtttttttttttggtgttgccatatttctttgacggttgcactgttctccactttttttttcggtcaaatacgatgcagcgctgcacgcttctctcctgctgggcagacgacgcctgcaggctgacggcttttgtcagcggcccaacggcgtcgtcaccatcaccttgcgtccgtccatccggaacagtgcactagagcagttgaacagtgcggggttcctaaccacacagcctagcgctgcgaaccacaactagcgaactagccttatcatttccgttagatgtttggatcaataatgaccgcaaattcatagctgttactgcagctgaccctggaggcctggacgccccatgtcttggaaaaccgtgcacgctttgtatataatcacatgaagcccccgcgtcctgctagacccttctcacagcgccagattttgaagcttgcagcagatcgagatattcgagttgggtcgccagctaggtgcacttcaccacttccccttttctcatccacagatcgagttcgattaatttatctttattagttttattttgtttcaaagctaggaggaggcgctctccagttaaaatggttagtcttttgttttagttagtttctaacggcaaaacacccaacttatttgtcaaataattttcatttccgctggttatcaaaagagagaaaatacgactatacgagcatttgcgaatttaccacttttttttcaattttgcaagcatgccgctcgaacaacagttcaagttgaattttcgcaatgttctagtgacagtcttgcaataacgattcaaaacagtggcaaatttataattaccccaaaataagatgttgaagattcagcaggtttagtgttggccgaacgacagcgattcctcatagtaagaggaacataggtcatttacatataggccttggtagaatctctattgttagatttttttttctaaaaggtatatggaatttttatattgatagtattgatgtctaattcggaatttttgttgggatgatgattatatcattgttcacgtgaaaaatcatgtacgttgctttcttatggtctagcgagaattgttaagcaattaggagtccgactttcaccccaagttagcatgtgagggttttaaaaggatttcttatatgactccttatgtatttacaaaagtgaacgaacataaaaatagacttaaatacgaacggcatatcaaagtatcacagaaaccatctttaatttttgagcactgctcccgtccagcaaacggtaccccaggtaccggtaaccccaggtacaaaacttaatctgaccattgaattagagcggggcacgatcgggattgaacttaatgtagacccccgtttttataacggaatcactcatattaatagtaccatttccctggatcaagtagtctggtactcacggttacattgttgaattatcaagtgcgcatacaaagattgtttagcgcgaattattacatcataggcccgcgggcagtcttagatcataggactaaacggtccacaatacaaacaataacagaaataggtaaggcagcagattataggcagcggctatgccattgccacaggcaacgaccataactaagacctacagagcgccgtcatcctccgcatcctcctgaagataagcatagggatcctcctcgacttcattgccatccactgattaaattttgtaatagcaagagtgagtaccaaccgtactcagcaagccatcataacaacagtgcatatgatagtgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcgagcaaaggcgcacgacctctctccgagtgtgagcggcgacgacggggagctgaatccacgccgtcgagctcgtactcccccatctcctccgcgcccaagccctaagcagggggaggcgcttgagaaggtcgacaagtccatggcatcaccagtcgcaggtggtgcaggaggacggcaagatggggagcgccgcctcctcgtctacggcgacggcagcacgcctcagggtgcgcttcaggctgctggcgcgctcctacgacatccgcctgtcgtccatgacccggagtctccagcccaacgatggctggaagatgtggccaacttggtcatgacggcacagcagcgcctgggtgctggtggacggtccgccaccaccaagacctccggtgccgctaccaccggctccgtgtcgtcaaggcggagggcgcggcgagcggcggcggctgcacgtcattcggctgctactccctcgtcgacaccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcctccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctgatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccttgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccagttccggagtggcagcttcggccgcccccggatccgccgctcagacagggcggcgtgacaggaggaggaagaagaggtcggaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgatcttaaggtcgcgctcgcttgcatggagcagcgtgccgaccgcctcgctgctgcatccaagcccgagggtggtgacgagaggcctggcccctctgcccccaccgccccgaggcagcggatcgctacatgcgacgaggtcccggtcaaggaggttgccttgggcgacggcccatccaagaccacacggatcggtggtctcctggatggcaaataggaagacgcgctcgtctccttcctgcgggcaaacgctgacgtcttcgcatggagaccagcggacatgcccggggttcccagggaggtgattgagcaccgtctcgccgtgcggccgggcgcgaggccggtccggcagaaagtgcggcggcaggccccggaacgtcaagtcttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctctgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagcagaacatgccctcactcggttaaaggcatatctcagctctcccccggttctagtcgctccagagccaaatgagtccctgctactttacttagcagcgaccccccaagtagttagtgcagcgttggttgtggagcgcgatgaggacaatcctcatttcgtgcacccccattctgtgctaacttggcccgggagcaagcagggaggagaggcccccgagtcaaacggtggcctaaggcccctgacgaccggagacggccctctgcccgctcgtcagacggtgctgggtgcccccgaccctcaggaaggccccgaggccactgcgggaaggccgcacttaacgccctctgaccccgaggctaaccctgtgctgactcgacccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggtacagaagacaagtgcgccccgaaaggccacttgaacgaagaacgccccggggatacggcccctagcagagaggatcggccccaccgaagggtgcagcggcctgtctactttgttagtgaggccctccgggacgccaggacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatagagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccaaacggagacgtcctcagatacttggtccgtctcgactttcgagcgactaacaatatggcagagtacgagggactccttgccggactcagagtggcagctggactggggatccgccgcctcttggtgttaggcgactcccagctagtcgttaaccaggtctgtaaggagtaccggtgctctgacccgcagatggatgcctacgtgcgccaagtacggcgtatggagcgccattttgacgggatagagcttcggcatgtgcccagacgggataatgtgattgccgacgaactctcacggctcgcgtcctcgcgagcccagaccccaccgggcgcctttgaagaaaggcttacccagccgtcggcgcgacccgatcccttaggggagacggatgtgcctgaccggcccccgaggcccgtcggagtccaggcctcgggacccgaagggagcgcttcaagctcccttagattgattgcttggatctctgagatccaaacatacctcacagataagactctacctgaggaccgcgaagggagtgaacgcgtacaacgcatttccaaacgctacgtgctggtagaagggaccctctatcggcgcgcggctaacggaatcctcctgaagtgcattcctcaggaacaaggcgttgagcttcttgcagacatccatgagggcgagtgcggagcccattccgcctcacgtaccctggttggcaaggcctttcgtcaaggattttattggccgacagctctcaatgacgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagaggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggtgtcccccggccgggctcggtacggctggccacgggcgacggcacggagctgccaaacccgtggaacatcgaacaccttcgtcgcttctacccctaaaggggggggggtcgggtgtcagattttggctcgggccaaccccacacccccctcgggtgtgcaggattggccgggggctaccacacatgcacatatattccctttttccttatttcagcatttcaatagaagcagtttcaattttctaaaggttgtgtctgtgccgtttttccttctgaagaatcttaacttgaaataaggtcactcgtgctcaaccttgccctagggggctcagttcggtcagctaaaatcgccaaacggggcccagaaccgagccgtgccccggggcgtggtgaactccgggggggaaccggcaaaaacccacaatcgggtcacccatacccctcggtcaccacgttcccggcctggccagtctcgacatgtggatctccccgggcactggccccgacccgagccattcgaggactgggacttgggcacgagcccttatttcaagctaaggcgcaaaaggaccatggcacagatcatcctcatcgcatatgtatagcaaaataaaactaacacaaaaatttttcatcatttcatttctgattgcagattaagttaatttgtacaaaaaagaggtatgaaggccttagaagaaagaaaaagaaaaaaagattggcgggggcctgggggctcattccaatgcgcccgggtcgccggcctcgtcgccgccgtcatcctcatcgctggcgtcgctctcctcgtcggagctgggggcgaacgcgagcagaggggccgacccctcgaagccgtcgacgatatggtcggcagcatcccggacgcgcgcgcgcgcgtcgtcctcggttccgggagggaactcctccagcgccatccagggagagaagtcggggtcccgggcctggtagctcgccagcacgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacgtctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagttgtcatatctcgtcgaaggtgtagatgttgacgttgagcatgaccatcttgtttccccttgcgcaatcctgccatggttagcagcaaacaagaaacatacacaagaatatacacgctcctatcaactattaggtactggcagctcaaatgtcacacacactcaagcttttaaccaagctcttacaagatcttaccaatgcaagtggaatggtgatgtacaccgactcaaccaagcagcccaatagaggttggatatatcgatgcctcggcaaacacttgctgtacggctgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttctttttttttttctttccttttcttttctgttttttttttggtgcggctttttttttctttttttttgcacctttctgcctttttttcacttttttcttgattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacgtctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgtttcatgatgtgagcaatggtcgtatccatagtagccatggtcacatcacctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaagatgcgctgggctcggggatgtcccccgggcccgtttgatcatgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggtggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggctgctggatcttcggcctcggactggccggacttggggtggcgggaggaatgcgacgggacatcgctgaagcagaagaaaaagccagaagacgaacaaagtgagcaagaaaaaacttctttttggagaaagatggttgcaatgagagtgagacgaacctgcgagggggtcggttgaatgaccaccttggaggggaaatcaggtttccccggcatggttccgtctcccccgtcttacggagccgcttcttcttgcgcaccccctcgggctgcgatgtcggcgcggccccctccgggcgccgactgctggcacgcaccgccccgccccctcggggaggagatggcggaggtgttcctcccagcttcctcttcccctgggcgacggcagggcggctgctccccgagcccccgacgcggggcccagaagcacgaccccctcctggggcaggttgttccccccggcggcgctcgcccgcgccgtcgtggcccttaggggctctctcctctgaggccccgacccccatcataatggttagaatggagacgcggtcgggatcgctgcagagggggaggatctcttgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgtcggcaaggggggtgtagaaccggtcgctcttccagtcgtcccacttcttgcggaggacgcaggggatgtagcggttcaacactggcccccgcggctggaagtagcagccgccaaccgctgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccatcgagcagagcagagccccgtgccatggcggtggaggaagagatgattgggaacgagcgcgtgtggcgaaagtagggcgtagcagagaaagagttagagctcaggcggcaaaggcaagaggaacaatggcgaaaggaagggagcaaatccttttctcgatgcttttatacccttgccatcgctgggcctggctcctcgtttctcgcgcccactacctcgctccctcgtatctcgctatcccgctccctcgtttcctgtgcccacgcttccactaatcccattcgcccgcttacggcgcatgaagtggatatgcggttgtggcaatcgaaacggattgtatcgtgcgcgcgttaattacgctcgccaaccgaagcggcgttaccgtatctccgagcgagacaaatctgctcacccagattcgcgcgctgctcaagtgatgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtctgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcagatagtgatattcaaagtatggccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttagagtctagccaagtgtaatacatgtcctgatgctcaatatccgcgagcacggctattcgaatagattggttttactcacactgcagtggatgtacactttacccgtactccgcgacttgcccaacacatgagcctacgtcccaacgaatgagacttgccaaggcaaaacctttcaataacctcacgttggcagtacccgctccatgaacttgcatcctcatgcactccatgaacttgcatcctcatgcactctaggtgtcatgagtttctagcagtgagaggagttctggcgctcccgggaagggaagactcacacatgcattaagttttagttaaattaaatttacacatggcagtcctaccgatggcggcaccactataggcactcgcccctcgcggccccaccaatggctgtcccatcgtaggccctgactcccacacaccaagaataaccactatgcagggatactgccttcgctcggctacgtactccgctaggtctatacccatacgagaagtacggttgtacgagggtcgtttcatgcttaactttacggctcggtccttaactgaccagggacggcactagccttttctggacaccacccaagtaccccagccgccccggtcgaaaacagtgtttagttttgtttctcttttcacaattcatgttatccttgtcatggcaatgtggtgcccatgcctccacatgccgcatctcaactaccttccttaaggtagttgcccaagcatatagcacttgataaatatgagaatgcatgattctaattagcatgactaagcatttgttcaatatcgactaagtacacacgttagcagggtttacaatggtcatacagataatcaatatcaaggcatggcatatttaacaagtagggcattcatattcacatatgtatagcatgtaattttatttaaatcaacataattttcgcaataggttcaacatgctcaaagattagtgatgacttgccttgatcgcagtcttgctatccctgctcctcaatcgactcaacaattccctcggaatctaaatttacgtgcgaaagatcggatttgaactcaattagaattcaaataaattcaccaaaattcaaacagtacaaagcatattgagaaaatgttatcaccagatagatcttgattttagatgaatttaggttcaagtttcattcaattccgagttaagatgagtgagttatgcttgtttaaagattcaattttgaattaattcaaacaattgtgaaatggcactgtgcagccgagaggggcattattacagtggctgacatgtgggccatccccctattttatttctggtttttatttttttaaaggaaatcctattgtgtcattgacaggtgggtccggccccctgttgaatctcctgtgggacccgcatgtcattgagacattcacttaaaacctaatttaattagatttctaagcatccgggcctacatgtcataggttcataataatatcattagttttagggattactgtacactaatgaagtggggtccacatgtcataatctctccctctctcgtgccttctctctctcccgtcgtcttcttcctcgtgctcgcgacgaagcagaggagcggcgcgcgacggtacgacggcccgagccggaacggctcggcgcacggtggggctagcggcggcgcatcaccggatgcccgccggcggcggcggcgaagcgcggcgaccgtccggcgcacggcgcgacggcgcgcgacggcgccgagatcccaaaatcggcggcggcacgatgaggaccaatgtgagcgcaaccaacaacgattcaaccatctagggtccacatggagtatatagaagcaaaaatctagcctaggttgtattggaacgaagtccccccacggtgagctcggccatggcgcggcggcggccggagtcggcacggttacggcggcgcacaccccaaatcgagggggccgttggtttctaggtgaccaggcgggactacaggcgcgagggcttaccacgaagtggcggaacggcgaagttcgacggcgagtggcgcggtgcggtcgaaacaggggcagacggcggtcggcgacggtcgcaagtgttcgatgctcgtactccctcgcgtagcggctcccggctccctccaacagcagcaacggcaacgggcacacctcctcaacacaccccgccacccacaccggccgagaggccctgcggcggcggcgcaacccccgcccaccaggtgttcgacacccggcggcggcgcgattttgttttctctgggatggagcaagaactccgggaaaggggagacgaatgagggttcgattttggataaggtcgagctaaaggcgagcttataacagcgagagggagggcgattcctattggataagatcactcgatgactcagccatgtttcgatctctcctaggttcgattcaatgccttgggccggcatgattgcctagacgatagggtcccaggagagggatcattagctgtgggaggaaccccccctattatccagcggtctcggtggggtgcgacaggatggcgacgcgacggtgacaagagcgacggcgacggacagagataacgacttggatagggggcgccgggctatgccctagggtgacgcggggttgtcgtggcggccgttatcactccatcccgagggcgacgtgtgaggggacgggatgacgcgggcacccgtggcggcgcagcctttggcgcgggcttttggcggcttggtcggcggcgggcccacgcggcgtggcatgacgcggtgcggcgcacgggcacgactagtgcggcgcacgagtcggaaagcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataaggaaaaaggaagggctaatctgcaaaatggcttggaattgagttgtaactctatctattttggattcaagaattcaaacatttgatttgaatatttatttggttattcattagtccccaaatgaatttgcttcccatcatcccaaatacaaatattttaatttgcatttttatttatttattcatatctctaccaaatgatattactctatattggattattccaaaattaacttaaataattggggggttttgatagtcctaaaattaattaaaatattcaatgggtccattattaatacaatagcacattggttgaacttatttgcataacaaggtattcatgtaaattgtaattattatttagatgcgcgtctttactttgatttttccattgagatgatttatagtttggcaagcaatatcaaccataacatccatcatgatgcaaagttttaaaaagtttaaaattttagtgatttttattatcgaggatttttaggatgttacacttaatctcgcgaggactcagtctcctgccacgcgttgcatccgcatctgaagtctacgccgcgtcaccgccgcaatcctttcgccctactccgacgcggtgtccaagtgccgtcctcttccggcctccgatgcggtgtggcggctcctcctttggccgcagcttttcccctcccctcggtcccctcctcccctacgcctctcggctgcccctgtgcggtgcggcagctcgtcctttgtccatggccacaacttgtcccctcccctccgtcccctatgcatctcggctgctggcacctacgcagtctccggcacaggatcacgataccctgagtttctttatggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaataatagtaaaaaagaagtagatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccagggatagaacgactcccagaagtcggcggcggccagacctggaccggctataggaagggcaagttgggaatgggcaggttggcgacggctggttgcagtgagggaggaagcgaagtccggcgagattggctgcgccgctgctagggatgacggaaggggatcgggaagagacagattaccgggttggggacttgtaccgtctctacaaaaattgactaaccacgcgaaaatccaattctgcccttccaccagttccatacacgtgaacaaagggggaggtaccccgcaccggattcccgtaactcgcggtaccgacaattgtgggtcgtttgatctggctgaatggacggttacgattgcagtaccacgcggtaccaaaaattctgctggacagtaaaaattctcttaatttttataattgtagataagtagagatagagatagagattgaccggtctaacaaaaggtgtagacgtggtacacttgagcgcgtgaaactccatgatgataaggttcgattgttaaaatcctaaggcaaccaagattactatttaatatctattaaaagaaaattacatataaaaattttttgaaaattttatatagatgtagctgtgcaatttctcaattggttagtttctttacagctaatccaggccacccatgttcaagtcctaaacttattagcatttacggctaattattttttcagtcgtagtcctaaacttattagcatttacgggtaattattttttcagtcgtagtggtaggtgatctaccgtcgatagcaagatatccgtggtgacgtcatcaattttaaaatatgttggtccggtatttcggaggtgctcataggggtagggtatatacctgtgtatgtttatagggatgagtatatgtgcctgcatttgtattttgtttcttaaaaacatcatcaatttcgagatatgctggcccgatattttgtagatgctcatgtattcatgcgggtagggtgtatctgtgtatgttcgtatggacgagtatacatatctacgtttttactataccaatcaggttttgccttcaaacctataccaataccaatcagcattggattcgtcagcagatgtgttgatttgcataggtgaccgtctacacggaggagttagcactagtccaataacgaatttcccgtgcggtcgaaagtgattttcgcgtgcggatcttccacccgtctgtaacgaagtgcctgcaaaaattgctatttttgcgtgcgggtggcgcacccgcacacggtggttatgttgcccgcacgtaaaaatgaaaaaccgaaaaaaaatccaaaaaaaaaccctaaccctaaagttgctgccgccaccctcctcgtggtcgtcctcgtcgttgtcgtcatcgctgttgccggatccgccgcctccccaccgtccgagcccgcccacccgccgttaccgccgtgccggccaccactgccgccgcatcctggcaggggacggctaccgccgccagatccgggttgggggcaggtgcctccgccggatccgggcaggggccggtcgctcgccaccgtgcgcacgccatcgagcccgccgctcccggttgcctaccgccaagcccgccgctgccggagccgaaggaggcaaagaggtcggagccagaggagaaggagaaagtggcgctggcgccggtggtgtggcctgcaggatgcgaggtccacgcagccgcgtggtgctagcttagcggaagtgaggagaatattgagcggaggagaggaaagtgtggagaagatggagggggggggagaggagaaaggaaatttgattttttttttgaacaggttcatagggaatgagtatttttccgtgcgggtctattaggaggcccacctgcgaaaattgatttttgcatgtggttttcacacagaaccgcacacaaaaatggaggatgattttcgcagacgcgactagttatctgcaatctaaatgggtccctgtacaagaacattgttttttaagtagtgtagcgaacgtccttctatcaagaagaagtgggaagactataagttacccatctatgctctaaaaatactataagtactccttaatttattacccatcagctaaagatttacgatgttaatagagtcaccaaccatctcgatctagagaactctaaatcaatatggggtttgggataggacaaaggctgtgttcagatgacccttttcccaacccctctccctcattttccacgcgcacgcttttcaaactgctaaccggtgttttttttttacaaaaagtttctatacgaaagttgcttaaaaaatcaaattaatccatttttgtaaaaaaagcaaatacttaattaatcatgcgctaatggattgctctattttccatgatcactgttccggatgggaacttgttctagcgaacacacccaaaatccactaacggagccaatttagagatcagaccaacctctaggtcaatttggattgatttgaagttaaccatctgtctcgtgggcgaatcagaagctttttgagacaaacctatagagcgtatatcacttgtcgacgagctatatctatctatggtatttgtagagtatgaggattgttagtgctagggtatgcacaagattgaggaataagagacagaatatatcgatttttatataggttcggaccccttaactgacaggtaatagctcttctcctgttgaccggagtcattgttgcctttatatattagtctcacacgagtacaacatttgagttgacctaatctagtccctatcgatctagcagcatggagctctcacatgtgatcgacgacttgtgcagtcttattcctcaaacatgaactcgacgaaattgaatatatctctagatccctcatgtccacattgggtttgtctaaatttgtcctcgtgtctctttccttctagggagtcttgtatttatatcattgagtatcctcttatccaagtagaactaggtaactgatacaaacacacccgcaaggggaggctcgatcttcacggtagtaggttttgaaccaaagagcaccggtgtaaaccgtgcacaagaggataactagctttatacctgcaagggttggatgcgaccaagtggtgagggtgagaacgatccgaatcctcttggattccgacccatcaaaccaagcaatcacagaaccataatccaggactaatccacacaagagggggtaagacacttatgcaatcttcaacaatcgtctctcatctatgctttttataaagttaaagcccactaagtataaagctcaacatgcaaacatgctaccttatcattcactagcaacaactaattatcaaatagttcatacaaacatgcaatatcatccatactttatttaattctacaaatcagaatgcaaatagatccaatcatcacctctctcatcatttccataatatttcaacaaatatatccatcattttttataatacttaacatacatacatccatatattctgtatcaaagcgaagatattatttagtttgtttcatgtttactactaataaatcctaacttttcatttctttttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcccagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtggggagcaggacgcccgcgccagcatcgagcgccggcgtaatgaccgaagtgctgcccacgcaacggaaggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaagggacaggcgcggggttggctaatgaacctgccccccgcgtcggtccactcctgggaggatttgtgccaacagttcaccatgaacttccagggcacatatccgcgccccggtgaggaagcggacttgcacgctgtacagcgaagggacgacgagtcacttcgatcgtacattcagcggttctgtcaagtccgtaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggctgcttcggccgcccccggatccgccgctcagacagggcggcgtgacaggaggaggaagaagaggacagtccgttccgacgacgagggtcatgtcctcgctgtcgagggcgcttcgcgggccacccgaaaggggaggcctgtgagcgacaaaaagaaggaggccagtgctcccagcagggagcgccccaccggcaagtggtgcaccgtccacaatacctccctccatgaccttgcggactgtcgcgcagtcaaaaatttggctgagcggacaagaaagtgggaggaggagaggaggcaggagcgccgggaaggcaagtccccggcggttccttccggccatcggcgaagtgaggctaagcagaaggcccccgccgaggacatcgatgatggcgatgatgacctaggtttccaagagcctggggccaccattgccactgtcaatggaggagcgtgtgctcatgtttctcgccggagcctcaaggctatgaagcgagagcttctggccgcggcccctactcataaggcgacgcgccgggcgcggtggtcggaggttgctctcactttcgaccagaccgaccacccaccgtgcgttgcccgaggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacctgccaatttccgcacggagcgggtaaacttcgatgtggcggacctcagtctgccctacaacgtggtcctggggaggcccgcgttggtgaagtttatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggctcatctgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccgtaggaacttattgttatacgacaatgcctttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaattgaaccccgataagtgcgtgtttggtgtacctgcgggcaagcttctcgggttcttggtctctgcccgaggcatcgaggccaaccccaagaagatacgagctatagagcggatgcgcccccccagcaagcttagggatgtgcaatgcgttaccggttgcatggccgccctaagtcgtttcatatcgaggctgggagagaaggcgctacccttatttaaactcctcaaacgctccgggccgtttacttggacggaggaggctgaacgtgctctcactcagttgaaagtgtatctcagctctcccccagttctggtcgccccggagccaaacgagcccctgctgctctacttagcggcgaccccccaagtagttagtgcatcgttggttgtggagcgcgatgaggacaatcctcattccgcgcactctcaccctgtgctgactaggcccgggagtgagcagggaggagaggcccccgagccgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggtggcctaaggcccctgacgaccggagtcggcccttcgcccgcttgtccgacgacgccaggagcccccgacccacaggacggccccgaggccactgtgggaaggccgcccctgtcatcctccgaccccgaggtcatcggcacagaagacgagtgcgccccgagaggccacttggacgaagagcgccccggggatacggcccctagcaaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgagttacggtggttacgtcataccccctcggccaaatcttgcataatcgagagggtacaggacgggtggtaaaatgggcgatcgaactttctgagttcgatttgcattttgaaccacgccacgctatcaagagccaggccctcgccgattttgtggcagagtggaccccggctccagagcctgtctcaatccccgaggtcaactcggacccctcgcagccgccacacaccggccactgggtgatgcagtttgacggctccctgtctcttcagggcgccggtgcgggggtcacgttgacctccccgactggagacgtcctgaaatacctggtccgcctcgactttcgagcgaccaataatatggcagagtacgagggactccttgccggactcagagtggcagctggactggggatccgccgcctcctggtgttaggcgactcccagctagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaaggcgtgctggattgagcaagctctcaccaatgtgggagggtccgtatcgagtgatcggcgtcccccggccgggctccatacggctggccacgggcgacggcactgagttgcctaacccatggaacatcgaacaccttcgtcgcttctacccctgaggggggggtcgggcgtcaggtttcgggctcgggccaaccccgcacccccccctcgggagtgcagggttggccgggggctgccacacatgcacattctcttttctcttatttcagtatttcaataaaagcagtttcaatttcctaagggctgtatctgtgccgttttttcctttttgaagaattttgacttgaaataaaatcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgagggctgggacttgggcacgagtccttaaatcaagctaagacacaaaagaggaccacggcacagatcatcctcatctcatttgcatagcaaaataaaattaacacaaagaaaattttcatcatttttgattgcagattaagttgatctatacaaaaaagaggcctgaaggccttagaagaaagaaaaggaaaaaaactggagattagcgggggcctgggggctcaatccgatgcgcccgggtcgccggcctcgtcgtcacggtcgtcagcaccgctggcgtcgccctcctcgtcggagttgggggcgaacgcgagctgaggggccgacccctcgaaactgtggacgatgtggtcggcggcatccctgacccgcacgcgcgcgtcgtcctcggtcccgggagggaactcatccagcgccatccacggagagaagttggggtccctggcctggtagctggccaggacaagctccaccgctccttgagcgaggtccctcgaggatgacttgatgatcttctcgagctcctcggggagctgctggagagctccggccatctttgagaggtgctgagcgaggcctcccaagttggtggagtacttcatcgtttggcccttccagaggcccgcctgccgaccggcgcgatccagacgggagactgcatcccaaagcatgccgggccctatctcgcccgccaagcggagggcctcggcttccccggcggatgaatctagcgcgcgctgcatgtcggtgacgatgtgttcggcatctgcgaggcgggcggctaagtcgctttcgcccgcagccgccccgccgatgcgtgccctcgcgtccagctccttttcccgcgcctcgaggtcggcagcccgctgctccagcgtggctctctcggcgcggacggattccaagttgcggcgcgcctgctccgtcagcgctgcctcacggagggacaggctgtccgccaaccgttgcgcctcggcctcggcctcttcgagagctcgctctcgctcggtaagcgcgtcctcgcggaggcggagtgcggactcctcttcggcgcaggcagactcgtgcgccgccagcgttgcctcccgggaggtgacggcggcctcgcggtccgccaggtccttctccgcgacgcaggcgcgctcctccagcgccatggcgcgtgcctcgagggcctcttcacgccgccggagcgccgcttcggtctccgttgctcgctgctctcgggcagcggcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacacaggagtagggtgttacgcttctcagcggcccgaacctgtatacatcgcttgtgcttcatgctctttcaataggtcgcgatctttccacatacacagagagcttgggatctcaccctgagcccccggccgaaccggcaaaggggggcccgtgcggtctcccggtgaggagccccacgctccgtcacattggatgattcatcaagggtgtaaattgcacctcttcgcattatctaaattgtttttaggctttggatgatttatcaagggtataaattacatctctccccccccaaaaggcataccatacaacccaattatttataacctatggataactgataaaggtaaaaaaataaacacatgaaaaaatcatatagtagggaaaaaagaaaattttagaactcatatatactatattatcacacaattctcctgcagcaacacgtggggtacccatctagtacatgaggttttaattgaacaaaagttgtctaatggataaagtagagtggtatttatactaggaacatccctcctagcttagtgtgaacataagaaaccacatccaagtaatcaaggctaacataaatgagaatgcaaaaagttttctcgggttcgcgcacagcccttcagctcctgcacagccttaagtaaaattactctaacttcttattggaaaatgatattgtaacccttgagaacgttctcaaggtaacctatccttcttggcgtagtgatgatgccttcagatataaaccatagcaatataaaggtagagcatttaggtagtataaaactctcactaaaatttgggttaagttgagcaaagagtgagttcacctcttgttgtattttcctagcattgaggtagtataatttaaaaacataaaaagataaaaaacataaattacatttatcattaaaaaatacatccgcttcggtctccttccctcttttctccctgaatagatgagatcacaa

SEQ ID NO: 64845 - DNA, 666 bp, Oryza sativa
ggcaacttggagcccaacgaaatcaacggcaaaaactagctaaattcagcaactcttatcaaaatcagatccacaaaaacccccatgcgcgcagaccaagcgcaccaaagcccaattcaatgcatcgacaaatcatctacagcgatctagaaccatcggcgccctcacctcccgcgagatcgacgaaccgataaatccagaggactcccaacccactcgcacacgtacgacacgcccttctagaagctcccactccccccgaccgccacctaccactccggcggcgcaccaccacgcatcagccccctcaagtgtataattctacctggaccgcgcgattccagaagcttctagaaggatcggagatctcacctgcgccttcttcctcctcctcctcctcctctcctctcgcccaaagttttttttctcttctctccttttctgcggcgattttttttagctcgctctctctatcacttcttgttcgctgtgttgactcgtagccttatattattcgtggacgcgataggatcccacgggcgcctcccggccgtccgatcggcccctgcgcgcgcatccggccgtcggtcgccccggctaaagcgtactacctctggagccaaaccgaaccccgcggcggctgacatgtggggcccgcacgtgaaa

SEQ ID NO: 64846 - DNA, 2376 bp, Oryza sativa
ccgtgccgaaggtggcacttccgccaatgcccgcggtgccggctgtgcctaccgtccccgcggtgaccgtgccgccaatgcccgcggtgcccgctgtgccggcggccacgttgccaccgatgcccgcggtgcctgcagtgccggcggcgagcttgccgccgatgccagccatgcccgccgtgccgaacgccgcgttgccgcccatgccggccgtgccgaaggtgacgctgccgccgatgccgtcgatgccggccgtgcccaaggtgacgctgccgccgatgccatccgtgccaatgccgttcttggcacctcctccttcggcataaggacgctgtcgatgcttacacatttattgggtcatttgatttgatatcaagcttttggttatatatttcctctgcttgatttgttttctgtgagtaaatgtatgttgcatgcgagtttttttttttttggaatttttgttctagccgtgtttgtatatggagtatgcttggctataagtacttgtatgtggcatttgtttataaaagtttcattttggttggttaattttacttgtgttcatatttcagaatggttgtattttgttgcatatgtctgttggtaacttggatcattgtcattgtatggtaaattgaatgtggatgttctaaaagcaagtgcaataaatatgacttggcacggtaaagatggtccgatactccgataggctatagggaggaatacacgcaagcacaatcttatatagagcggtgagaaaagaaaaaggggaatatatactgtagaggactttagatttgtagttggttgtagtttgaaaaaagaggagagatataatattttgtgggtttttattgtctagattttagaagataagatagtagtgggcttggttagggtgaataatgactattgtacaagctagctgctatactgcctataggtgatatggaatttggctatagctaccggttagcttattattattgttgttgttgtatgattgacactagatcgagaaaaggtgcgacaaattaaaccattgcagtgagtgtgacagattttcctgaacagtatgggaattgaacttatcgctgtaaacaaattctcgtaaaattcatacaggccagtgtgaaaattctcatttctgatttcttgttcagatcatggttttaccattttcttcctccatgtcgatgccaaaacaatgatagaagccttcttttcccaataaaatctgactggtacaccataaacagttaatgcgtaataatacagcacattttcgatttttttttcccaatacactatatagaactattatgttacacaagaaaccatatgttaccatatatcgattttttttaaaagagaaaatagctctctatatagtgtatatgtggcgacgggccgggcgtctcataaatcagaggtcatcatgtactcaaagttcacataggctgaactcgcatgcttcagaagataaacagtgtttgaaaaatatataagcaccagctagctggagtcccttttttttaaaaaaaaagatagagattttacatggggtcgaaatttaataaaggattagttatatgacggactgtactacataactttttttaaggttttatatggagaaaacctggccaaccaagttataatatttgtcaaacagaggtccagtattttgcatcatgcagattgcagaatggctttcagctgcaagaaggtaagctaaccaactcattgaaaccaattaacctggcagctgatacacgtactcttgctttggccaacaaccaaatgtcaagttgtcaactaatgaattaatctatttgatcaactcctataaattgctgcgaaagatgcacatctttgcatcaccaagcagctccagttttgcagtgttctaactattgccaagctagctagccactgagatctctcagccatggcttccacttcgggtctcctcgccacggtgctcgccatggccgtcttgctcgccggcagcagcagcagctgccaagcggcgcgccatctcgccgacgcaacacctcccgctgctgtgccggtgcctaccgtgcccgctgtcaccttgccaccgatgccggccattcctgccgtcccggcggcgaccctgccgccgatgccggcggtgccaaccgtgccgaacgccgcgttgccgcccatgccggccgtgcccaaggtggcgctgccgccgatgcccgcggtgccggctgtgcctacagtccccgcggtgcccgctgtgccggcggcgagcttgccgcctatgccggccgtgcccgccgtgccgaacgccgtgttgccgccgatgccggccgtgccgaaagtgacgctggcgccgatgcc

SEQ ID NO: 64847 - DNA, 5225 bp, Oryza sativa
gatatcttctggcaccatatatatatatatataccatatatatatatatatatagtactagtacttgccaacgaaatttggtagttacatcttaaaatatagcatgcagttacatatgcgcatgttatcagataaagtattgaacaaatattttagaaatagattttttgttagattatggaaatgtcttcagagaaaaaaaaacatgttgcattattacatattaattgacagaaaaagtatgttgcattattacctattaattaattaactgcgggaaaccatacatattaacaacattaaccataactacaatcctatggagtacatgaggcaaataaaaatcagaggtcattacttttggctgtgtgcactaaattatatatacagagcgtggagatataatcatattccataaactaattaaataataataatcacgcaaatcgtcacagactcacaatccacacaggctagctgaagactgatgcatctgaagatagcagtattaattaatttgcaaaagttataattatctcatgtctagtcaaattttaaattttagtaattaagtagctgcagtcattatggataaaaataacttctagttttactatggatcatactctctccatactcgtaaaaaaagtcgttaggacagtgacacggtttccaaaacacaacattgactttcttatttctacaaaaatatttattaaaaagtaatatatgtatacttttatgaaagtatttttcaagacaaatctatatatatgatttttacattttcaaactcaacaacttgagagttatttatgatttatattctcaaggtttgacttaaacattgttctaaacgacttcctttataagtacagagggagtatatgcaaactttatggagaacactgtagtttactgataccatgctaaaaaaaatagtttaacgaagtacaaccgttcaactgctctcaacctgatgccttgtatgagatcagaaagctagctagcttgtgttgacagctgttctaatgatttgagatatatcaaacttgtcaaaacagtacacttgtgctgatctaatcacatttcaactgtctatctaatcataggtgagctaaccgaggaagaacaatgcaacatattgggccacctctattaccacctgatgatctcttcttcctaaccaataattaacaaatccttgcagatggtttggaaggtcaacaaccagtgtcaagatctgaccatgcaattagctttgtgagctataaatgtatccatacattgctttgcatcaaacaacactgaatttattgcagtagttaattagaacactgaatatattagctgtgctaagtgtagctagctcagtgggcaaagcaagcaatatttcaatggcttccagctcgaacttgctcgcgatggccattgccgtggctgccgtgctcctagcgggcaacggcaacaccggccacgcagcgcggcacctcgccgacacgaccgaggcgccggctgccgccattcctgctgttccggccatgccgaaaccgacgatccccaccatcgtcccggcggtcacgttaccgccgatcccggccgtgccaaaggtgacattgccgccgatgcccgccatcccgaccgtgccggcggtgaccatgccaccgatgcccgccgtgccggccgtgccggcggtgactctgccgccgatgcccgcggtgcccaccgtgccgccgaacactgtcgtcgttcccgccgccgtcgtgccggcgttgccaaaggtggcgctgccgccgatggccgccgtccccaacgttccaatgccattcctcgcgccaccacccaaggcctaaacgtagctcgtttcgccatgtgtgcacgatgagtgtcagtgtgtgtttaatgctattttgttgattgtacgtttttgcatggcgtacagatattttgtcattctttcatgtatgtactgtatactatatatgtgggcttgtacttgattgaattttatggaatcggttgtcgaggtttcttgacaataatctctgaattttactacaattcctgggttgaccgacacataaaaaagaaaattccattcataccataataaagatcgaacaaatttgaagaatacagtgtagaattaatagtactaccttgcaaaattgtggtactacttaaaatagccggctaaacctttctatggatagggttttatgattttctccacataaaaccatattcttttgggctacttttaatattggaatcaaaagaaaacaattataaataggaactagagcatccctatcgcttgccccgtgcatggccccccgtgggctagggatgaaaacggtcggaaataatcggaaacggtacattattttattatttttttcgaaaacgaacggaaacggtctggaaattttcatatttatgaattcatctatttagtgtcaacttcaatgccacgcttacagaaataaaaaaaactaaaatttgaaaacggtaaccaacggtaaaattattattattatattagttttgcggaaacggtatcggtacgatcgggaagtttccataccgttttcacccctaccgtgggctgtgctcggctgggggcacatcggcccccggggtgcgatcccctatgggcggtgcttggggcacatccctcccaccctccctgtggtcggtgcccaagacacctctatcacctcttgggcatatttttttctttttaatccatgtgtgtttttattaagcttgggcctttttccatttttttttctatagcaggccaaatccaacaagatgcacacttggacttcgtaggccacatgcttttttttgttttttccagattgctatttgaatctattttaaaactggatgtacaaagtttataggtataaaattcacatgaacaaaattacataaagtttatatgttcaaagtatttatgcataaaattttcgcatataaattgtttctaggccaaaatgatatgctactaaatttctttcaaattaatatatacaaattttatctatacaaagtttctatatactagtacaaagtttacacgcaacaaaatgtctatttgtataatttatatatacaaatattttgatatacaatctatctataaaaggaaaaaaaaaagaggttagctattggttgtgacccgcataaaacaagaaacataagtgggctctttttctctataagggttcattagcttacctaggaagagaagagggagacctacctgggaagagaagagggaggcaggtagcgctaccacacgaagtagcactgattttatcatgcgatcgcacgtcctaggaggcacatgatcaattgcgaattagacgaagcctttgtaggagaagtaatcttgtgccaacaggtacttctctatgtccacctagactttaggaaagcactaggacttgggaaaccttgcccttcaagcaaataaaaaaagagccagattgaattcatgctaggaatccaccagtcagaccgtctgaacacctacaatcaggccataattcattgtacatttgcactatattaaaataaattttaaggtgtcttaagcatacaagtggactaggaatcaaaaaataaatcacctgtaacgataataagtagatatgcagatgcaaaccgtgctttcattgagtgcatgtaagcaggctacaatgttaccttcttgtagaaagtcagaatataaggctaataccatggtagattgtgagtgtttagtcacttctgcgagaactcatgttctaactctacactcctacgtctgccaagttgtggtatgaatgtgataattttggagcaaagtatttatcgtcatatccaatgtttcattcataaaccaaacatatagaagttgatttctattttttaccagaaatagtatatatcgaaagaagcttttgacaattgagtttattcattcataagattaaattgtagatgttgtcaaaaaaacaaataacaaaagggcagttgaagaacttttatgttcgatctcaatctagaacacggttgagaatattgagaattgagattgagggaggctgttctgtttcgataacctatgtctgcgtgcgtgtgtatctaatgtaatcatatatcatccgtataaccgtgtaggaatcaaattcatagcttatatagtaattttatcatgatgcaaccaccctaagtagcacacgggtgcagtgattgaaatttcgaaaacccctccggcacgcaactatttcgtccaaaattttatccttttttccattttagtcaaattttgatcaaattcaatcaaattttattcaaatttaatacaaaccaaactttgtataatcctcgcctttcaatggcgccatagaattaaacacgctttccatgcatctctattattccacattccctttatttattgatagacattggattaccattaagccagcaaacaaacactaaaccatcaccagtcaaagcactctcaaaacaatattatcatgggaagaaaacgaaattaagcttcaagctttgtcgttgttgtcgttgaccagcagcaggtggtccggcgtgacggcggcccagaactcgccgtcctcctccagcgccgccatgtgctccggcgccagctccacctcggcgtcgatgccgccgccgccgccgccgtcccgccccgggaacagcgacaccttcccgtcgtacttgttccccttgccgctcctcgccgccaccgccttcccccacccgaagtcgcacccgtacatgtcgaaccgcggcgagctgctcacgaacacgccgctcgcgtcgaacagcctgaacgccgacaccgacggcgccgccgccgagcgcgcgcggatgcgctcgtcggtgtgcgcggccaccgcgcggcccacggcggcggccgcccacccgtgcccgcgcgccaggagctccgacgccggcaccgcctccgtcgacgcggggaggatgctgttcccgaagtactccggtggcagcggcgggcggaggcggccgcggctgttgaccgacgcgcggaacaccacctcccggcccggcgccagccgccgcgcgcgggtgacgcaccgccatagcagcgagctcagcgcctggaacctcgtcacggcggccgcgccggctgcgtccccggcggcgaggagctcccaccgcgcgcgctccttgagcgccgc

SEQ ID NO: 64848 - DNA, 1301 bp, Oryza sativa
atacttataattctaaatttaaatttattttttaataaaataaatatattttaaaagtaaattttctagttgattattgtgatttttaatcatagtttatcttaaaatatttatttttaaatacctaagaacatatataaaaaaattatcgttaaattattttttattgctaacacataatcaacaataggtcttgctattgcactacgtgtctacaggtctcatcttttcgtttatgtttatgtttagtagctaaaatttaaatttttaacattaaataaacattaaatttgaagctaattttgagtttttttatcgaaatttatttttcagtctttgtttttagattgctaagaacacatatataaaaattttattcataaattatttttcgtttacaaatatatcgtttggcttattccacgaataagctaacgatgggaccgtactaggggtgaaaacagtacggaatttttccggattccggtcatgttttcggaaacggaatcggccggtcggaattttttcggaatttctcggaatcggaatcgaaaacggaaatattttctcggaaacggaatcgaatatgataaaagcagtttccgtcggaacccggaaacgatcggaaacattccggaaaaattgtcggaatttccgaagttaaaaatcccatagattcaatagtccataatttatccctagcttcccagcccaacccaaatcgcggcggcatctaccctaaccggctaaccctataggagagagaccgtcagactcagaactcagacgcgactcgcgagttggaggctgagcgacggctgcggcgtccagatccctgcatcgcggcgccggcgtgccctcacgcccaccgcccgtggcgcgggcgccccaccgcccaatgctggtcgcctggccgactggcccccgcagtcctcgcccccaccatctagcgccgcccttgctcttcgtcgtttcgccgccggccaccgccaccatctcgcacctccgccggcctgctcggtccccgccatctcaaggcgccgtcccaccgcgtctcgccgtttcaccgtcgccaccaccgccgccgccgacggaacaaccaccacaccgacgaggcgacgacgacaccaccactgcagtctcttcctcactgccaccaacgccgacggctcctcgcctcgcagcagccagcagcccagcggcagcatctgagcaaccagcagcagcaggtgtatatagtgattgactttgcacttttactaatgctctatcattttttttgaaggctatggaacggaaca

SEQ ID NO: 64849 - DNA, 553 bp, Oryza sativa
caccacatctgctttctttactagttattaccctgctatctaaccgaggaccatatgctacactagagaagtgatgaattaagtgcaaaattcatgaaggaatattaactatcacagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgtt

SEQ ID NO: 64850 - DNA, 2520 bp, Oryza sativa
  unsure (1)..(2520): unsure at all n locations
ggagcagccgccgccggggtgcttgtcggtggtgaagcggccggcgacggggtagtacacgtggagcgcgtcggcgagggcggcggcgagatgtttgacgaggtggagagtggcgggcggtggccggaagaggaggcccttctggatgtagtcggcggcgaggagggacacgtcccaggtggtgagcgggatgcgctcccgcggccgtggccgcgatggcttcaccgtgcgcgtcgacaccacgcgcaccggtggcgatggcggcggcgtcggcggcggcggcggcatcctgaggagattgcgagcgttgggtgctcttcttgttcgatcaagtagagaatttccacctctatactaactcacctctccttaattaatcttgtgtttgtgtgtatatataatctaatcttttgatgagttgctagtgaagttcatttaggctgtgtttagtttactaaagtttgaaagtttggttaaaattgatataatatgatagaaaagttgtgtgtatgaaaattttgatgtgatgaaaagttgaaagtttggaaaaaaactttggccttagacttggtactgatacacgacattttgcaagtcgtcacgtctgacatgagcatgcatgcctgctagtacgttcaagtgttcaactaatcctagagtaaaccattggcttagtgccattagcactagggagtactctaatttaaaagcaataacacaagtacacaccatagcccttcttttatacccctaaaataaatcaacttttgtatttaaagactagcaatcccgaaggccaaatcctaaggttcaaaaaaataaacgaaaggatgaagaggaaattcagtggaaggtgcatgtgctcaacccgatcatttactttatatatttactagactagatttcagatattatctttgacttacaggatggcagattaactcaaatctgatgcagaagattacagatcgatagagtccgtcaactaaaactgtgctgctgcttacgaaacaaatatcaactgcaagtgtaatagctcttcttgttgtttaactcgtactccctccgtttttaaatatttggcaccattgactttttttaaatatgcttaaccgttcgtcttatttaaaaaaattaagtaattattaattcttttcatatcatttgattcattgttaaatatacttatatgtgtatatagttttacatatttcacaaaagtttttgaataagacgaacggtcaaacatgtgctaaaaagttaacgttgtcaaatatttcgaaatggggggagtattatatactccgacagtcggcatggcaaatcatcccaaagctaaacagtccatccggtcaaggtctacatattacatatttcatgcaaaatgaggtggtaataacatatgattaattgagttttaattattacaaaattgaaagatggattaatctgatattgtagaacaattttcatatagaaaattttcgcacaaaacacatcatttaacagtttgaaaagtgtgccacgaaaatctttattttcatcttcatcaacttttgttggagaaacgaacgggactgatcagcatcatcaggctacaactacttgttcaattaactaattgtaagaattaaaatgtcggaataagcatattatttcatggaagactgtaaataaaaattgttatcagaaaaaagtgtgaaaaattgtttctggccggtaaataatctcattatcgatttctgataagaagtctataaataaattccgtaaataaataaaaaaattgtaacagatttatattctaaaagctgccaaaagtttgattttattattttactaaaaattattagaagtacatgtctaatttaattttctaaaacttttgatactatttgttaattgatatatattgtaagtttacataggatatgtaatgtgttctaagagtaaacatgagtgctccattaacttttctcactatagtctaatatttttttaatattataatggttacagttaaaatgccatttattttggaaacgagtgtaaataaaataagcaaagtgttggagcccttccgcctcctcgtccgggccgcggacgttggccctcgccgcatcgcggaatggctccccgtcgccgcccgccgcctcgccggagatctgttcttggtgaatagtacgaaagattcggagctcatcgaacaaggtacatttcttgagcttccctgcttcgggagcgccacctcgctctcgctggagctagggttccttggcctcgccgtgccgccgtcctgtgtgnnttcgcccggctttcaccaatctgtccatctgcggtgtcctcttctggcccatgcgagctcggcgacgccgtctcctcgccgtagttcccgtccctgaagaagctcaccgtgctatctgctcacaggatgaacaatttcaacatccactccaattctctcgtggagattgtgctccaggggataggattgcaacagttcaatgtggtggcaccagc

SEQ ID NO: 64851 - DNA, 682 bp, Oryza sativa
agaatcaatccaacatcgtgtgcgctagctggtgcgagaaagctaaacttgctcaatctgtctgcctcttttcccttttcattttccctattaatgcaacaaattgcttaattatttacgactaatgtttttaataagtttgatcatttatatagtttattaaaaacatacgtatgaatgttatttattttattgtgactcgttttatcaattaaaaatattttaaccattacttatactactaacttataacttgtagtatttgttgcacatctaccctaaacttttaaatgagaagaatcatcaaacggtatatccaaaaaccagcaacatcgtctataaaagagaataaagggagtaatttaaaaattattataataaaattccacgcacgttgctaaacacgtgactaatttaatccggcagcatgacgccgacctcacgcggcaacttaattattttctcccctctcccttttttcttctcttctctgcaagttgggctacgagtcgctgtccctgttccccgtttcgatgaaattaagccaaatgtgcgaacacatgaccccgtacaagcaagcagtaaccaccgctccaaattaaattaaattagataagttaacacggcttaatttaccaatcaattaggccggatatgattattgttagtataattaattaga

SEQ ID NO: 64852 - DNA, 4331 bp, Oryza sativa
ttcagctcagagtcaacccgtcgccaacatctcagcacctaagctggagattctcgggtggagtactactaatttagatcagagctctgtcaattttggcaagatgtcgtatctcaaagggctgttcatcgcatatttctatgtgtatggagaagaggatcgcaatcacgattgtctaaggctcttgcagcactttcagtttgatgccatccccagactttccatcctacttacctactttccagtgagttcagttcctctgctttgtgtgacatcatactaacatcgtatatgagagcactatcctctattatgagtatatcatctattcaactttcaatgtaacaaacaaatcatttatggaggctggttcttagattattacacaacagacaatacgcatttgcataatctactgaatattcggtaagacaatttagtacttcaggcatgttttgcattgctcaagcccctgcatcatgtttgagcacaccacttctccattatttcctactctatcttaatatctttctaattgatggcgttacactttccaccttactatgagattatgtgctaggactatgcaatactacactagtttgttatttattgaagcaaacatggtttctgaagagtggagagaatttgaaccggtcaatcatagacattatttctactcttgcactatatattattattgcgaagcttaaattgagacatggcgcatacttatagtgaatgcacagtttctttttatttgctaagcttccatattggctggacatttttaataagtaatccaaatgaaatcattagcttgtaacaatcatgccctgtgcggctaatgaattatccaaaatgatatgtttctgtacttttccaggttctatatatgaccccatgtttcctagatttagaattgccagattctgttgaatcagaattaaaatttttagcttatagcaagcattttccatatgctaataactttcttccaatgagatgtttggatcctctccaactattatatataatcacttattttactttgtacaacagaccataaatggcgatatatacttgatggaagatatgacagtgctccctgacattgtgttcttgaacttaattttcttttcaagtggatattgtattggtcctagcttattccatgttctcaggatgaccactggtgtcagaaggttgaagctagaattacataatcattataaacgagaggtaaaagctgaaactatacttggtttgtttatctgatgcagagttactaaggaagttacgagaagcaatttgtatttacatttcctgtcacactaggcttgatttgctattttgctacttgccctactctatatagtggtttgatactgatatatgtagtaaatgtgtgacatatgcatctcctatcggcaatactttggggcaacacaacaaggatttagaagatgatactaactggctatgcgttattgatattagaatacttaggacgtgcgtaaatttatactccgttttcacagaactttctcataggacagaggttggcttcaaactagtacccaagttgttattcttttgcagacttttttatgctggtttatctcgagttgttcaggcagcctgacagcttgaggcaagcttaatgttgctacactaatataccgctcttttcagttttgtggatcggattgtgtttgtgatcttccaccaaactggacatccgaggaacttgtgttgaactcccttcgtgaagtgcaaatcactaacctgagaggaactgagaacgaatttgctgttgtggagcggctattcagttgggcagcagtgctgaaacagatgacaataaatttccataactcaatcaccgtgagcactgcaagagagttgtgcgagatgttactgagcttctccaggccagagataagcatgaaattttacattaaccagggatcacgtaaggttttgtatgttccagaagactaatgtgcctcatcaggcttgccagttgactagtgaagtagaactcattttgctttcttcctttctctgatggattgatgaaagaattctgtggacttggttctttgatggtgatgaaacacaacttatctgggttcccaatcctggaattgaatggcaagaatcaatctcttggttggaaaaaaaaatgaaacgaatttttttttcatctcatcgttctacatgttgggtaggcttaatgtgtggctccagcctccggacaggaaaactcttctgatctttctgctcagatatgctactgctgctaagctcaatctgcatcacactagactgtagctgaatgctacctggatttgtaagctagcctggatttgtatttcagcttggatttgtatttttggtcggatttatttgggccgtccatgcagatatctcgcagcagcagcagcatctgcacgttactcacgtggcatctccaactctaccgccaaaatttgtattctttttttgaaaaaaaaatcgttggctcccgcgaccgcgacgcctcgtcgcggccttggtggtagagtacaagaaggagccaggcttctcttctcctcgagccagcagcaacacgcacgcacgcaccacacacgtagcagcagagcaatggcggcggccatggcgctgcaggtggtggccggcggcggctgctgttgccagcggccccgttcttggagctggtcggcggcggttgccggcggcgcgtgcggtggcgtcggacgcggcggcggcgaaggtgagcgaggaggaggggaaggtgaggctgggtgggtcggaagtggcggtgagcaagctcggcatcggcgcctggtcgtggggggacaccacctactggaacgactccgagtgggacggtacgcactgcctcattaatcaatccatcgaattgttcaagcttgttttgtttgtgctggaaaagattagttcttgttgctaattgttgcagtcaaatttagctccaggtgattctcagttgtttaggtgttacctgtagtaggtctggttctaagcagctcaaagcagcaggggcagaaagtgtgtgatcaggtcatgcttcccatgcgcacaaggtgcttgttgcattgcctccccgggtgacttgcacttgcacgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatcagacaggagactgcaggaggctaaagcagcatttgacacaagcatagataatgggatgaccttatttgatacagcagaagtttatggtacagcggtaagaaactagaaaaacttcatgattcctcgctcatattttccttgcgtcaaaattctgaaggttcatttaaccttagttgttctgtccttcagctgatgggagcagtaaattctgaaagtttactcggagggtatgccacgttttgctgttcagcactccattttttttattattttttatttttgcgaaagtcacatgtgcagcaatagtcacctgttgttgtctctcttgccgccagtttcatcaaggaaaggcaggagaaagaacagattgatgttgccgtcgcaacaaagtttgctgcacttccatggagatttggccgaggaagtgttctttccgcactgaagaaatcgcttgaccgtcttgggttatcttcagttgagctctaccaacttcattggtcggcttgtctgctctttctctgatacatactttttctgtaaattttgagcattttgatctcagccgcttttgtttctctgttttcaggccagggctatggggaaatgaaggtacacagtccaatgaaaattacccatataaccatttttatgaattattagatagttccttctagcatgacaaaaacttcaacattctgacatcgttgagcattattcagggtatcttgatggacttg

SEQ ID NO: 64853 - DNA, 2963 bp, Oryza sativa
taataaaccatttggcatataattagctcttggccaaccgatggggcccttgttcttgtaatgactcatttccgttgttcaggtgttctgtcaggaaaatacactccagaaaaacctcctaccggtcctcgatcaaacacatatacccctgagttactcaccaaggttatattagtacatattactgaacccttaagctagctagttacatacagcttcagcttggatgcgccatttagtctctgcaactgaacatttttcttatctaaaacctataaacatgtttcatgtgcacagcttcaaccactcatgaacaggatcaaggagattggagaaagctatgggaagaacccaacccaggtgcttcacctcatataatgctcagcaaatccatgcaagaaaaggaattaatatctccaagtaggatgagcagcaacttgcaaggaacagaagtgcagttccactgaaaacagctggtgttttcttttttttgtttcaggtttcactgaactggctgacatgccaaggcaatgtggtgccaatccccggagccaagaacgccggccaggcgcaggagttcgccggcgcgctcggctggagcctcaccggcgacgaggtcgaagagttgcggtctctggcacgcgagatcaagggcatcaagatgcccatcgaggagtcatagacatgtaaaaactgaagaagtttttcatgtatatgataggagatgtgtattgattgtaccatgcaatagtaaacattttacggcgataaaatgtgtagaaggtgtagaaaatgagtcagaaatttctgcctgcatgaatagaaaaggtttatatgactttgagccagccctgcccagtgatgattcaaatgcctgtacaatgtaactttgacgcaaacacgcgtgaaccattacacacttgtatttaaaaaaagaaatagatctcatacgtacgttttatattataagtcgctttaaatttttttctagtcaaacctttttagatttgaccatttcataaaaaaatagtaacatctataaaagtttcccataaaaaaaacatctatacaagttcagagactctttatataaattctataagtaacatacgcctgtagtgactttgtcaatctctagtatagatttgtcggctcagtcctcaaagatgcttataggggtatggtttgtgtgtgttcataggggtgggtgtgcgtgcgttgtgagtgtctgcgttgtactgtgtaatttaaaaaaaaaatgatgatatgaatactataagtttgattgaatcttatcataagcaccagatttaaacaataagattgcaaaatttaattatttaacatcgaaggaggccagaagttcttttttttttctatagaatgattttaccgccaaaaaaaaataaattctctctctctctctctctctttttgagttatttggaagcgatatacccagagcggccagcggcgcgtccacgtgtttacccgccaaacacacttgccagtctactctcgccggcgtcttcctctcctcgcctcgtctcgttcgtggccaaacgaagctcgcgcctcccggccactcgcagtcgaagcccagcaaccgccgccgcgccgaggccgagcaacagtgaggaggtagcttgcctgcaatgatggccgggaccctgcaggtcgccggtggctgcctggcgcccctcctccccagccgacgagcggcggcggcggtacgcccgccacgcgcgtccggggcgtcggcgtcggcggcggcggcggcggcggcggtggaggaggacggcaaggtgaggctgggtgggtcggacgtggcggtgaccaagctcggcatcggcgcctggtcctggggcgacaccacctactggaacgagttccagtgggacggtacgttcgcccaatgcgcatactcatcgatttgcttattaactcttgattatttttgtgttattccacctgcaaacctgcaatcgatcgggattgattgaccagttcttgatttaggatctcagtagagagttggagtccggactccacctaatatgttgattttgggggaattgttgggattgattccactcattgtgttgtagagtttcatgtagctgatgagctagctttcaggttcaaaggggtcatagttttaacctgtactaagggctaagtagtaattaaggctgtctaactgaggtttgtaaacttactaaccttgaactaacagtgtagtactatttgcaattgatttctgtcccaaggtaactgtaagtggtggtatcattaagacatgaacatcctggggcctagtctaagtaaacattgcattgcaattatgacactagactaaacgtcaaatatttatggtcagggggagtatgagttaaggggtcaggtctctaggtgaatctttgatcatgaacatgctcatggatttgttctctctgcttgtcctaatgttgttgcaactcgcaacgttcgaactaattacagattgtggaatttaagcaactcgcattggaatgttttgagtctgatttttgtatagtttggaaggcaccagccatctaaggatgtaggatctgaaagtgtgatatttaacaaagttgtctttcttttttgcattccttttttcctgctacttgttatttgtttgttgggctgaaatcagggtcatacatcccatgtgcttgatgtgcatgttgcattatctgcaagaaaccacgtgccacatgtaatatgctttgcgaaattttaacgaccaaacacatgaaatgtcataaatctctgcaattgttagtgaagtagacaatttgcttaatgtcaatgacaatccaatgacaaagataccagtgacagtcccttaatatgatgaagcactctgaaatttgccagataggaaattgaaggctgctaaaggagcatttgatgcgagtgtcgattgcggaataacc

SEQ ID NO: 64854 - DNA, 63067 bp, Oryza sativa
  unsure (1)..(63067): unsure at all n locations
aagtttcacatttgcgtgtttttggttgcaagtgatttgtcttgaaatctggaaatttggataagtttgaggcatgttctaccaatggattgtttcttggttaccccacacacactcgtggctatcgtgtacttattttggagactaacaaaattgttgtgactagtccaggtactagacccgatattgtaggttcagtgggaggatggtcgtatttttaaagacgagagcgacgatgacgacgaggttggctcggccggtcagactgggcgccaggccggtcagaccgccggcacaccgccgatcagaccgacacaggtgttgcggtcagaccggccaggctcgtcaggtcccggtactgtcgatgctgatcgagatggacctccagagattacaacttcgactagtactgatacagaacgtgaatcaaccaagtgggttttcaaaaataaacaaaatgaggatggtttgattgtgagaaataaagctggactttttgctcaaggttttacccaggtggagggtttggattttgatgaaacttttgctcatgttgctagaattgaggcaattagacttttgttggcttttgctgcttcaaaaggctttaaattgtgtcgaatggatgtgaaaattgcttttctacatgattttatacaggaggaagtttatgtcaaacaaccaccaggttttgaaaatcctgattttcccaaccaagtttttaaattgtctaaagctttgtatggtttgaaacaagcacctagagcatcgtatgataggcttcagaactttttgcttgcgaaaggttttacaatgggaaaggttgacaaaacgctttttgttcttaagcatggtgataatcaaaaaaaacccctttgtttgttgtttgttcggatttatgtggatgatatcatctttggttgttcaactcacgctttggttgtggagtttgttgagactatgcgcagggaatttgagatgagcatgatgggtgagttatcgtactttttgggattgcaaattaagcaaacacctcaaggtacatttgtgcatcaaatgaagtacacaaaggatcttttgagacggttcaaaatggagaattgcaagccaatttcaacacaaattggttatacagctgtgttggatcctgatgaagatggtgaagctgttgatcaaaaggagtatagaagtatgattgaatttttgttgtatctaactgcttctaggtcagacatacaatttgctgtgtgtttgtgtgcgcgctttcaagcttctcctcgtgcttcacatcgtcaagcggtcaagcgaataatgaggtatttgaatcatacacttgagtttggaatttggtattctacatcatcttcaaatatgcttaagtggatattccgatgctgattttgggggttgtagaattgataggaaaagtactagtggaacatgttattttcttggtacatcattgattgcatggttttctaggaaacaatctactgctgaatctaaatatgttgctactgctagatgttgttcacagattctttggcttttatatactttaaaatattatggtcttacttttgagaaagtacctctcttttgtgataatactagtgctattaacattgctaagaatcctgttcaacactcacgcacaaagcacattgatattcgttttcactttttgagggatcatgttgagaagggagatgttgaattgcagtttttggacataaagttgcaacttgctaatattttcactaaacctttggattcataatcattttgcttttcttcatgttgaattgggaataattcatccttttggcatgttttgagggggagtttatacctgatgattttatcaagcaaaaatatggcaatgagaaaattgaaaaagagagctttgtttatacatatggtattttcttgtgcatgctagcaatactttgaaggtttatttgtttttagcatagcttgtatgtattctagtcttttcatgagatttagattttgcttttaacggagatgatgcatgacatttaaattctacacttgaattaagcaaatatgcaatgttgatgctagcatatggtttgttttataaatgctctacatatatgctttattgaattgttattcctcaaatagctttaattgctcactgtgaaaagagaacaaaaatatgaaaaaaatgaataccgaatccttggaaacagtcttgacgacaaggacgtattcgatgtgagcaaaataatgggtgccaaatccctagaaacagtcttgacgacagagacgtacccggaataaaagagaaaaaaatatgagcaaaaaggctcaagaaaaaaaaaagttaaaaattctcttggttgttttgtgctaaaggtaattttagaaagagtgataaatgcaataggtatatgtgtttagtgtttattcttcaacctatgtgcttgttaagatgttgcattataaatcgcatgaaatcatgaattttgattgttgattcaagcttaattgtaaaatctttggttcatggttatactttaatgcatgcttgttatgttttagatgggttcatcttctttttattacaacacatgacttgatatgctatatgtatgctaagctcttgaacattaatgaacataattcttggagaagcaaatgagttgagaagagcatgttgtttttggtccgattgggaatttctttcttttcaaaagtaagagaagttttcttttgtattttcgagcacgatgtgtactttttgtatgaagtgtgctttttaccacatttgttttatttttccaaacaccaaaacatttttgatgggtttgccaatgtgttcatcaagggggagattgtaaaatcaaagatgtttttgattgttattctgtgatgaacaattggcattggagattattagttttgatatttgcaatttatttacgaagtggttttggagatgattggatttacaggtgagtaacaggtgttgttattttatgtgaccggttagaccggacagtgtgtgtcggtcagaccggcgtgtatcgcgcggtcagaccagcgcagcctgcggtctaaccggccaactctgtgtcggtttcggtttcaggttgtttgttcggatatccgtgattgtttcatgattatggcttctaaatggatactatgcgtatgtaatactgttgtttgctaataatgagtcaagttggagatagcttggtctcggaatatggtttctttgtttatttcatgtgtaggtgactcgatgcctcgggagagtatttgcggtaatggatcaggagtcggcttggggataagacgacgtccgtggtggtcagagatcatgcgggatacttaggctagagttgatggacgtggttggtgatgatttcatatggcatacgatagaggtattgtgtgtgtatgggatgcggagtcgaatttggaaggagtccaaatttggtatgagtggttatgtaaagtttgtttcttgtactagagggtttcctaaggtgtttaggacttctagtatgagtttggttcgtggctttaggctgcctaccttgggtataaaaagaggaggagcgtgaggcttcccggtatcgcttttgagatcaattgagagttgagagtttagttagggtttcatgtttagtcgaaatttttgtaaggagtgttgttggtgcactttgtaaacacagagagaatcaataaagtcgtcatccactttaagagttcttcgatttgtgtttcaccgagtttcggcggtctaaccggcggcgcaccggcagttagaccggcggggacacggcggtcagaccggcttcggcaacaggcgacaggagctaatcttggcggtcagaccggagatctaatcttggtcagaccgacggcaaccaggcagtcagaccggcaggacaacttcggtcagaccgcgatccgtcgaattcgaggataacttttatttccactaaaatttttcggtttttgggtataccaactattcacccttttctggttagcttagttcttatgatttaatcctacagttgctgcgtggatcaatgtacccaagtatcctgcatcttgatgagaaccaactaagctgactaactcctaccaaccaagttgcctatatataagagcaccactgcctcatagcaaaggtctatcaattgatcctcaccgcttacacaaagcagttgcaaaaactcccatgaaaaccaaaacaatgtaatatgccattcgacctctcaaatatcgtgggcatgaacatataggcatgcgaagcatcaggagccattctcacgacacattggttggaggtattacactcttggaaggttgttcgagtaatacaacgctgaaccttgtgaggttaacctggtcatgaggatggactctaaaaatatgtccagtcgcctgttatgcgaacagaggaacaagtactggcagcctagcaatgctggcatcttcgttgcttcgcatcacagcggcaggcggcagtggttcctctggtcaaacggggcagatcaaggatttggagccatcggggtcataacgtaatacatactttacggtactagcatttataagactagatgacaccatactttctagctaattatttgtggtttcttctcacaaaaattaagatataccaatgatgtaattgattaatgaaaaaaaagagagtgtaacttatggtatcttctcgagtataaagaaacatttttttttgcaaacttttatacatacataaagctcttattaaaaagacacggccattagggaatgatttaatatcaaataattagaaattagaaggggtgaggctttaaaccctggtcatctagcccaccaccttgtggagctagccggaacaccttgggtgtttctccataaagctcttatttgttctacacctaattattctacattgttaaagtataaactaaataaaaacaaagtaatgtagcatttcatctagctagattattaattgtttaacttgtcaaaactaagtaaatcaacgggctaggttaattccacctatatataaacagaactatactatacgagaagtgaattaagcaactgttgcacgtgcaatactaacaacagcaaaattgttctggctttccctacaacaaaatacggagtatattgtttactagctgttagtgcgtgggctagagtaaattagttagtctgccggggtcagtgagctttaatcgatggtgtcattggctaaaaacacagaggattatgttgtatttgtaagataccatcggtgtcacctgataccgatagatatactgtacatccgccctcagacctgtagttgactatggcttcccttaattacttttctcgcttcccttaattacttaacaacgggagaatgctacagagagaacatgtagcataaacagaaagatcgtgctgtatttgagagcactgtgactccatgcttgtctgactagaatcttcagacgaatccattcatgcgaaatttgatcgagttgtgttgttcctcctgttgttgtttggaccatattcgagagactaatatatatccaaggaatgtttgaaatttgaacgtcatcgagcacgcgtctacgccatcaagctttggggtgccgctgcgttcgcccccctcgggtcgcagtgccgctgcctgtggtccacacctccactggttgttgcagtgctgagaggcgccctcctcagcatttctacatcaccagtggacttcttgccgctacatcgacatggagctgtagctgtgttgtcctctcggaccgtagcttcgccgctttcgtcgtcttcatcgccgttcgcgcatcgacaacctcgtcgtccgcactggtcatcgtcggccgctcagggtcttcttcatcgacttcgagcatcgccgccgcatctccaagctgccactgtcgccactctaggccggtggtccagctacctctacatggctaccgacatcgccgtccaggccattggtcccgctacatcaccttctacttcgtccaacatgattcatcgccagcgtcgccgtatcttcctcgactacacttcgctcttctccagcaactgtgtgctgctccggcaattctccctctacgctgttctcgcgccgcgaccgtctcggaggccttccctgctagtctcctccgacattagcgtatgattcatggtggtctcctgtctcgccgcacggtattggcaacactgttgcgtgcgttcgtcccgagttgtccccgggtctggcaaaccctgtgtgacgtctcgtccttcacggttcgactacatcggctcttcggcgtcatcttcctcaacgactaccgtgattgtgtcaccgtcttcgtctccagtgcgtcctcacgcaccttagtccacgacgcccctcccgtgcgtccacgaccactctgcggcgccccatgcgcgtcctgcggctcgactatctcgacatcagcttcctgacttcggctacattgaccacggctactgtacgcacggctacctcgaccatggctccctcgcaaccttcgctttggctatgtcgactatggcacaaagggttatcatccgtattgagcactcttgccggtttcttctctactccaagtgcccgcactgctcacgcttggactgcggggggatgttagagtatatggtagttagagccacattaggataggattggtttgtttggattcctttcatatctgtaatccttctttatctcttccctatgtactcctatatatatcagccccctgaggctcaatacagtggtccaatattcgcagtatcctctcttcctatactatccaacaacatgcacctcagaggaacagaatgataactaggacttcaacttagctcactcgttctaggaacctatgcaaatggttgtcacattctccggatgtctctcagtcctatgcgtgtctcatactgattattgccataattaacataattacataagctgcttataatttacacgttttaggttcactggagaggcgaaagagcaagtagcctagtggttatagtgacctgagtagcactctaatatcctgagttcaaatctccgtatgagtgaatttcagattaggttgtttccgggctaaattcgggaaagtctcaatgatgcaatttattacataattagatacaaattaattagtagagagagcacttaggccctgtttgattcagcttaggattattataatctggattattaggagtaacctcaaacaaacaagtagattattatgctatattattataatctataagccagattagtataatctaataatcttctctggaagagctttttctagattattgagtggctaaagacccgctactcttagatgcttccaataatccaaagaaacaaacaactgcaacttaggccatgtttgattcagcttaggattattataatcttgcttattaggagtaagcgaaacaaacaagtagattattatagcagattattataatctataaaccatattattataatctaataagcttctctaaagaaacttttttcagattattgagtggctaaagacccactacctctacatacttgagaaaaattacccacctatgccatcaaccgaacagatagctgagggcattatagactttagcctttcaaacccaataatccatgcctccaataatccagacaaacaaacaactcacagcttattttatatcagcttattataatccagcttatagcaatctggtttaataatctagattataataatcataaactgaaacaaacagggccttattctatatcagcgtattataatccagcttagagtgatccgatttaataatctagattacaataatcttaagctgaaacaaacagggccttagtacaaccaagattccaaatttatatatgtaagggaaagtctcaatgatgcaatttatcacatacttagatacaaattaacaagtagagagagcacttggtacaactaagactccaaatttacatatgtacagggaaaacatatcatagatctcgcttccctgttatatgcagggaaagtctcaatgatgtaatttattacatacttacatacaaattaacaaacacatatcattgatctcgctttcctgttatatgtgtgatctatataatactttttgaaaagaaaaacacataatcaacaagcagtcctacaatttaaatttaatagtaacaaatatagcttttcaaccaactaccttagcatggtttatatgcaatatgcggagcaactcataatgccatgctatatgataaatggaacccaatgaggtaatgtgggattagtcctttctaatcatatccaatgagagggtttggcggttgtatgtattctttttacatgtaacacgtaagtacctacgtattagagataagaggagtgattagccggaatgatcaggaggggtgattagcaagatttttcaagtctaatccaatggtcatatatcgatttaactgaaaaatcgagggaaatcactaccagggagcgggaagctaccgtgtgccaataactcttggtaacacagcgaaaaaacacgggaacagagcttcccgagagcagactgtcgggaacagacactcagcagcctcacacctttaccgtgcaatatttcacgtgagactacgcttgtacactcggtatgacaagaaaatttactgggtgaaagcactttcttggtaacaatgtattgaccggcacaggatgggttgcgaaaacggaatgggggtgttaccgagaggtactaactcacgggaaggaataaaatattaccatgtgttgtagtcaaacacacggtaccattagataacttaccgagagctattaacactaggtaacattgaatacttgattctaggaatttcataaattcattgtcgtactacactgaaacgcagcaacaagcaaacatgaaaggcagagcgcaaggatacatcacaggaacatgtcatgtgaacattagctgcaaattctcccagtattaataggaacatcatggtacaataataaaatattaatagatctacaaactggctgcacatgatgcaatagaaatatatgattctcaattcttacaacctctcgcaatgagacaatatatagacaaatgctagtggccgactaaccaaatgtgtgctttgacagcacaaatcaactctttagtgttttgccatgattgttatatgcctgaaattataaaaaaaaaacatgtttagtgccaaataagattacaacacaactagattatttagaggacactacgtacttgtggatagttcacaaaataaattttcatttgggacttgggaggcaggttataataattttgcagtgtgatctccaattaagtgaagtgtgtaccttagaaatattcgtcaaacaagatatttctatggatgaatcagaacagtaggattttgcagtcattgtcatcatgttgaacagatgatccattgagaatcttcaactccttgtcattgcaaatttcttcagtattcctgctagtggcaaccttctcaaaatcattgtcaagttcttgaccaaggcactgtttattatgaaaatattgagtttcggaactaaagttatcaagtaattaattggtttgtattactattctagagtttcagaactgaagctagctagatttcctaatatgatatgaggatatgcatggtctacagccaccagtaggctaagcagtgacatttgtatcgagggacatgattgtgcattgtccgcacttgatcaacaaagtatatggatgtgaaatttaagatttcatcaagaatgtatggttctgatatggatgaaaaataaactattctttttgccgtaataatattttttagtcggaaattatctcagctgcgttcttttgatgactgagaaataataattgagtattaactaagaaataggatgagctagaattcagaacttcacttgtgataattgaagtgcatatgtgcactacagaactagaaatttctaaccataatttctaaacttgctaaccggagaaacactttaccaaagattaagtaatagaaaataaaaaagaggagaagaattatatccttttttgctgttagaaaccagacttgtgcgaatatcactttgctctgctcgttagcacagcggtcacacaacaactccctgagccagccaggggcaagcctcgcaactgcagccgccgcagcatgcctgtgctgcttgttgcgtcgctcagagcatctctcgtgtaaattaaaattgcaggcacatagagaaattagtacaacctgaaaaatgctgcatccctccaggaggaaagtggatgaatggcaccagctgcagcctccaactcgatggggcgcgtcacagcgtcgtaggcctggatgcagcagagtacccattaggatattactatattactagatccaaagagaaaatgatgtgtattttcataaatcaagaaccatattcgcataaagatgcaagaaccactcaacatgcgcataccacacagattgggaggaagcagttgcagcaggcctcaatgcccagctcgatgatgattgagagccttgctgaacggctagacaatggtagacaaatccacagagtggatggacgtggacgtgcagggccacgcttgccggccttgtgaagggatgaggatggggacgcgcggtcgcatggctgggatggctgcctgcgacaaggccagcggagagggaaaagtgaggaggcgatgagaggagagcgaggcggcggcggaggcggagaatgggagaaaattgatattgtgccatcctcaaaagtgggtttcgcccaaatgccacgctgggagtgggcttcgctaaaatgccactttcaatcgaagactacacgctatatataatgcccaaacggacaaaaatacccctgttactaccttcttccacctctgacaagggatgcctcgccggctcgcctctgccgtgcccgcttcatccgcctccacctccgctcccgtttctcgccgcctccaccacacccgccacatccacctccacctccgctccccttcctccccgcctcatcctcctccacctccgcttcccttcctccccgcctccaccgcgcccgactcatcctcctccacctctattccccttcctccccgacaacccttgcctcgtccgcctacacctccgctccccttcctccccgcctcgaccgcaaccaaccgatgaccccgtggtcatgctccatgccatctacgccgccgacgccgacgtcggcggtctccatctttcgtgccaacccgccgtccaagccgctcccgttcttccaggcagcgaaggcgcgcccgcacggtggagtcgttggtgggcatggccatggcgaaggcgcggcacggtggtcatcggaggtggaggcgatggcggcggcggtcgggataggtgcgggggcccgcggaggtggggctgggatgggggcgatgggaggaggcacggggaggggagccatgggaggggtccccgcaggggcctgtggtctgtggttctccatggaggagagctcacgcgaaggcggatggtggccgccagcgagagctgatggtgatggagggaggaagaagatgagaggagggtaatttggcccaagatagtattttagcgtgtaaccatttgttgatagtggcattttatcgaattcattttgcagagtggcacaatgtcaattttctcggagaatggagaagagaagggggagcggttcatgggtagggttttgcggtgctatttgggccaactttctactgggccagtctgttcccgatggtgaatagacacaaacactcgaaaatttactgtgcagccaaaaatcgtggcacatcatccgcctgcgccaacggaaatcgtcaggcgccaaagaaattccgcgtgccgtccaccccgccaacggaaatttcgcgcgccgtccaccccgccaacggaaatttcgcgtgccgtccacccgccaacggaaattttgcgcgccaagccaaaatagtccgcccgtgccacggtaaaaatggtgggtcccatggttaccaagtttattaggtaggtactcggtattttttgttagcttcccgagtttttctcgaatacactcggtattcttgtttttttaccgagttccaacaaaaactcacggtaacttactgtggcactcgatagcttcacactctctggtagtgaatgtgtgttttttctcaaaatctttgtgatttcgaggctttgtttatttaaaagatagttgtgatggtttaatactgatttaagtaaaaatcggtggacaaatatttttattaaaattagtctaaaataatgtgtacacaatataaaataatgggtatcaactttgtttttaaatattgtagagccaatttatttgcatctgtttgtaaagagtgatatgataatatattaaatgtttgtaaagtaactattttataaaaaatattatcactaataataattattattattattgtctcaactatatacgtggaaaaagaaaaaaggaaggtcaatgtttcaatatttgtacgttttcctactgaagggaaggaaagactatataagagttttggtcgatttgttttaagaaatctaatctaactatttatagtattggaactaccgatttaagtgaaaatcgaaagatatatgtttttttctctgattttctaggtttttctttaatttattagagcgctaactgacggcttaagagcgttttgaggaagtttaatagatttttagtatataatagatggtgtttattttgagtgtgtgcttcttcttaatggtacagaattaactttttctataaatttattaaatatcaacccatgccaagaacagtccatttaatcaggatgtaaataataatgtgttatcaacaataatgcgaagccacaagtccattctcttgctgctctatattttaatatgaagcaaataaactaactagtttgtaccaactatacattcgttcaatcaagaagaactgcccatatatgtaagagagagcctcagtctcataggtcacaaagttctatcaagtgaccccctccacttgcacaaaccaaaaactcccataaaaacctaaacagtgcatatgccattcaatctctcaaatatcagctgcatgagcataggcatatgaagcatcaggagccactatcaggatacatcaataggagatactgcacccgagatgtgcagcatgcgaacagcacacggctgaagcttgcgaggttcaccatgttctgaggatgggctgagtgtggaagtatactcacctattatgcaaactgaatagatttcctctatagcctagcgattgtggcctcttcttctgctttgcatcgcagtggcagtgaacttcgccttgtttgcatccggtgatggatggtcctctgatcagccctccaatcgaatggccgtcctctttcttgtcacagcgaggaacagcagaagagcgtagggagaacgtggaacatgaacagcaagactctgttgcataagtgcatgtttgttgaactggaactgtatacgaaggcattcgtatgaaatttgattgagttgtgctcctccaaaacagttcaaacaatattctgctagagattaacatccagggaacgttgaattcatatattattagtctttccatgcaaatcagagactctggtgttcagtccagtggctcgaaatgccaatcaactacagatcaccatgctcctatatgtttctagagaagcatgatacactgatagaaaccaaatacatgacacaagtttgttctgctggattcaaagactttttatctgccatttgctatttctgtcatgtttgatagttccaatgtcttgtggttgaattaataagccagttatggatcaggcaactgcaactgcaagaatgagaattgatggatgaatgtcccatacacaattaacacattaactgagacaccaactctcagaaccttttgaagtctgccttcaggttttaatgatccttgagaaggtagtactacaataccacacatgtttaaattgtggtgccatcctagttcaaaatctcaaatattcatatactctctccgtttcagattataagacgttttaactttcgtcaaagtcaagctgtttaaagtttgaccgattttgtagaaaaaagtagtaacattttcaacctatgacaaatttattatgaaaatatattcaattattgatttgatgaaaccaatttagtagataaatatcactgtatttgtctataaacttagtcaaactttaagcaatttgactttgaccaaagttaaaacgtcttgtaaccagaaacagagggagtatataccaaataatgttggaaagcgtaatacctgcccacaccacatcgaggatgtaaaaaaaaaactcttccatttgttattattaattcaatcaatcgggtgcattttttatgtattagcaagctagtttgttaaaaggaaaaaatatctaaggtaattatcatgaatatacaatgtgtgtctatgcttatataagagcggcaaaggtgaatacgctcaaggctcaaactcacgtgaggtagtgatctatcccactgtaccataaacagagcagatgtcccttgttccagcatagagatgtttgctatatatcgtttatacatgtctaatgcatattagactgtgtagtatcaggagtaattggtacaaaggcttcctcaacatttttcttgattaaatatatggttgaagcatcatgtgagagcagtgttaaggcactccggattgtaggcacatcaagccatggccaacgcaggccgtagccccgtttgctaagtgggctaaggctacacaagggaccttatttctccaatgaagacaatacccacaggtgtgtcctgttcaatgaaaagctgcacaaccgagaggcctcaagctgcacaacgtgagccacggctcgaaccctagccttagatcggcgcctcgcacagggggcgtggcgtatgtaggaggttcgcgcgctttttgacctcgcgtccaacgtgggaggctagaggtacatgccacgtcttcgcgttggctatggcgtaaagaaaaaagagtgccagcagactgacgtcgtgtacctatagaccatcaattgatctagaaatgcttgggtatgctaggtgaaaatattctacttcatatagttattcgacaactgttgatagaacaatatggaatatagtattatttaaatatatatatataatagaattttagtatttggggagtcatttttcttaatgtacttaggagaaggatatgtagctatttacattgccatggaaggctccaatgtcgcaaacatccaggaaattaatatccaaggaatgttggattcattgaaaatttcccttgcaaactagatccgctcgatgttcagtccattgactcaaattgtcaatcatctatagagatcactgagctctcctctaccttaatttctacagatgcatggcactgacacaaactaggaattttcatactaaatttgaatatagtccgacctgcctgctttctcagaatttaagtgagctgacatgttacaaatttgcatgcgagattctaccatagtaccatactcaccatcagttaaataaatgtttgagctaggtttccaagcaaaatcccattaaatatgaattaacaatgttttttcatttgttactgaggaggagagacatgcaggcctgtgtgtgtatgagcagacgccctttgggccatgaggactttcaggtccagaagttgcggcccagatttacttgagcgacggccactaatttgcaatatggcagggataactcctgcacaatctgcgtggcacatcgttgatcggacggcgtacgatgatctctcccaatcacttgcaacatttcaagactgggtataagtaaaccatgcaacaaacagttctgcatccacagatcatgtaagcttgctgtgatggttaaaagaacatgcacaattgggtgggtgttctaccgtacggtggttttttttgtttgttgatcctgtaaacaattgtaggattgtgaggtaccgggagagttccgctcaccatatttacacgccaacgttataaatgggcatttgggtgcaagctgctcaacagattccattcatgtgtataaattcagcagtagaaacttcatggcatattggtattaccaagcgaatgagcatatgcaaacgtttcacaccgataccacacaaatcgggtgcatgagcaaacgggaaagcatcaatggaagcaagaaaattactaggatttgagggaccaagaaggatctccaggcccaaaactgctaactcacaaggcaagaactcctgcgcaatctgcaccacaaatcatcgatcggatggcggatggtgatctgtcccattcacttgaaacatttcaagactggatataagtaaaccaagaaatagagtaacaaacagctatctctccaagcacagagatcttgtaagctcgcttcgagattcacagaaagcatgcacaactgggtgggcgacctacatactcctcgagtaaagcaaatttgcttgtccttgataaaaccctttgaaggggaatattgcttttcatttgtttataccggaggcgggtataggattgtgaggcatcaggatcattcagtccaccaagtttacatgcctacatcagaaataggcatttcggtgcaagttgatcgcgagaggatgttcatgtgtaaatttggcaagggcaacttccacttgtactacaaaccctcttatctcagaagatatataagattgatctcccacaccacaccacagcactagactcgagcaccgcaaagcgtgcatcctactactcatcgtcctagatgagactcccctgatgttgtgcagtttacaattgtgccactgacatggggcccacatgtcagtcgcacaactgcaggctgcacaaagtcggaggatctgtttcccatcatctttgtggttaagcaacgccgtgctcatcattgttgtcaaggacctctgccacatcttcggctattaagctacatctcattactgccctgttgtgggtggtacaaccaatttatattgtcagaagaaaatgcattatataggtttgcaccatttgatcaagtgcatcgtacattaagccagcaatatacatcaactaaatgaagaacaagttgcatataagtaaaccacagagaagagtcactactagaaaaaacatttttcccgacgttacagtacaacgaatctagatatggatttattgtactatgtaatttctcatctttgttaggttggttttttattttttttattgttttttttacggagggagtaaataatatcttgtatgggagttgtaaataatagccaaacctaaccttggagaattagttaaatttggcccttttgactttggagtgccacattccgcctgaaccccacacccggattccgccgtcagccaaaaccctcgccgccgccgccggctgcatgcgtggtacctcggcaccggagaactcccctgtcctcctggccgtccgcgcgtagcctccgctctccgacgcagcgcccgcccgcccgcccgcccgcccgagcaccggcggcccttcgtttctccggcacctccgccgccgcgcgacgtcggttggtattccggaaacggcatctttacttcccaatcttaatttttatctcaaagagatctctcctcccgttgccgtgtaaatctcttgctcgcagtgttgcgatcttattgagtttttgtttttgttttctttaggagggatcgcaacaggaggccagaacacaagaattctgctggattaggtatttgtttttttttccccaaatcggattgcacgcttttgcagattatgcgtgtcgatttttgttatgataatgtaggtgttttttcttgctgctgtttgatacatatttgtcccagtaggcaaaataatgtggttaaattgtgcaattaaccaatctatatgtccatttatattcccaacttggcagatgacatgcatgtattttcccccaatctgcaggttattctcattgtggtctatgtacatctcaggttttgtttgggagaatattactttgtaagaccgtcagagagtgaataatggacctttgattcctctgtttttttttgagtgactgaaccatccatgtcatgtttttatggtaactgttttcttttatacgacatttgtttatatgacattgtggcctgtaggacagactattaggaagctccttcaaacaggtcgcactaaagttttggatgttgtgtggctaattaattgttatgtttggcataaaaccgataaatagtcaatattgagttgagtgatagcatcatgcacctcctgctttgttgaacagccagtgctttttcttcttgtatcacatcttattagttttcatgtttagttaattgagttgtggagatggattgctactttctaaaataacttgaccttcctcttctcccttgatttgtcttgtttttagaactgatgtttctatccagtctcttactctggtcctaccacaatatatgccacacttgaactgggaaaaataatttaggaggtgattatttctagttcatgttctgtttagcatgtcctttatgaaagatgaggtaattagttttccttaatattttgacattaaatttgcacaagtgagctagatcttatcattgtaaagaacaggtttatgttcttctatgattaacgagaatgtcatgtagaaattgtgcaagaacttcttgttacaaatggcatagcctttttttttccagaagccttactgtgaaaagaactgaaaaccagtatcaagactccaacagcgtctactttggtttgagagtgacgtttccggtgtaattgatcttgcatcaagttctatatttatatttaacgctgattcctttcaataaaatgtcacagttagcttttgaaaagaagaaatagcagattctgttccatataattgtaccttttggtctactttttatctgacaaatcttttccctgaatctgttgtctggagttacttaagacccatatgcatttgttccaagtgcatcacatttgttttccaccactggaatcagactaaattcattttgaccttactgttcaagttcgcatgttttgctagtgtaacaaaaaaaattgctgagatcattcttttttccaaaaaaaacggggtgtgagttggcagaggggaggggtgcatcacaggttttaatcaacagtaggcagatagttttttgccaactcagtgggcagttttatgcttgcctcgactgattcttgacttctcgatgggagcagcattttggtcactctccatggcccttgtggaaatgggaaatgattctttagtttgccctttcagctctagaaaatagatcctaactcaatacaattcaacgccaaaggaattaataagttatttgaactatttcattagtactgtattacaatttcttatcatttgtagtactacctccgtttcaggttataagactttctaccattgtccacattcatatagatgttaatgaatctagtacacatatatgtctagattcattaacgtatatatgaatgtgggcattgctagtaagtgtaataatatgaaacggacgaagtaaatctgattgtttacatgatttgaaatcttatttttacaacatatgtttctgcagggttgttgctctcctccaagtggcatccaacggaacagtaaatgaaattagagctgaacaagatatctcttgggtgtattcttatttatctgttgggaacttcaaccaaataggttctcagaattggcttcaaagttcaaacccatgtgctttctgctcgtttgacatacccactatatacatttcacaccattccactcatttgcaatggggcctcacccacctagtagttattcagataaaaaaacttgccaaaatgtcccaccagaaaaacccagctccacgagtttctgccatccacaatttccgcagcacttactttcacatccagcatatgcaatgaatttccctttcccgccgtttcctcactatcctccatactcgcaaaatttccaatatgctgttccaccacaatatgctccatactcattaccgccacctgatggagctatgccatcaccatatgtaccagctacagttatgccatccaaggcaccctctgatcaaggcaccccacattcagtaactggtccaggacaacaagatgatgacgatgctgaacctgagaggactgctaggcgactagcatggacagaagaggaagacattagattggtaagcattcctcttcctttttctatttctaatttttggacattgcaaatggtatcctaacatctccgtgctggaactacagataagcacttggttgattaactacaagactgacaagtactgggataaggttgcagcagaatacaacagtgcaacccccggagctcggagaagggaagtgaagcatttgaagaaccgctggcagaggatgatcaataaggtggcacatttcaatgattgttggtgccgggtcatggcaaaatatcctagtggccagtcagagggcatgcaacagatggacaaaacttggctgatgtataataaggaagcacatgtgatgtatctcgaagaagcgaagcataagttcacctttggccattgctggaacgctgtttgggaccaacccaagtggaaagaatacatctcttctttctccgcaaaaagagtgatgcgatctgagtccggtggttacgtgtcatcttcggaagactctgaagatatgcaagaaggaaaatgcttagtggatcctctggacatgcttcccaagaaccatgaagatatgacagaagtccagccgtctgtctcaaatcaaaagaagcaattagaactattgacagctgatgcgtcgtggcctattgaatttcagcttgggaggcaccaattgatgactggaacatcaaaattgaacgaacatcagcagggggtggcagtgagggatgaaatgcttgaaaaagaatcgggcccacaagattttgaggtgctagacaatgagagagtggcaagggaagatgaacctaaaaaagaaacacagcctcatcaaggtttcaaggcgcgaaaggtcaatcggaaacgtaaaggcaaggcatcatcttcttcatgtgaggtgcaggaagacatcaaacatgcattatatcttcagaccatgcttaacaatgatcgtgagaaaatgtcagaggtacagctccgcctctcgaaagagcagcttgaattggccagaataaagcaggatgaagcgaatgtaaagaaagaaacagcactttacatgaaatacacagagctgttgctggcagacacttcaaggtttgatgagtttcagaaggcagagtatgagaaagcattgaagcatataggagggatactatttagcaaggatgtcaattagtgccctcgcaacaatttatcttaagcatgcatttctgtgcaaatatcatcccaacaactagtaatagatcgttttgttctacttaactgaaggattgcctccactaacacctgtgtctgtgttaggtttaatcatctctagcaagatttaacagagattagtactgattgaatcgtggaagtgatggatcaatatgtatttagctattagtggcttatctaatttgcaactgacctgtgcaaagaatgaactagtggcttgtcttggagtgatggttgaaggcaaattgcaaatacttgaaagttaacccaagcaggtcttacattgttctctgccaccgaaaactcgcacgccctacattgctgtgttggagttatcacttgctagaacatattgggatgcaatcacccgtcaattgttcagtcatcgcctcaaatggatgcttctctacactctatcacacagtttttcccgttgcatctcatgccaacagcagaaaaaaattgcttctcgactgcacaaaagcaataggtctgacagcttttatcttatttcagataatgttttatggtggcttgattaattctgtggttctacacctatgtgactattgtgctatttattttagggtatgcatatgaaatatatgtaggtgtcacatcgttagaaggattggattctgtggttctacaactgtgactattgtgctatttattttagggtatgtatatgaaatatatgtaggtcagtaggtgtcacttcgtttttttttttttttttttagaaaatggtgtcacttcgttagaaggattggtttgaatgaatacaaagtagctaggtggtttaatgtgttaattttgacgaacatttacacccatccagtgccatcagtagcatctgaagtccagtagatgagctctgcctgaagcccctaaaaagagtcattttgaagttttgaagggaggtttttcctatacactatccaacccacaaagagcaaaacacattttccttcgagtacataatgaattaagcgaaccaaatttcctacgagaataccgcttcacaacttgttcaagcagataaatctctgaatgctgaaatccattatgcattgttcagccggaaaaagaacaataatgagattactcctgtacagtctcttgcatataaacctctattattttaatacactgtagtaggagcctcttctgctgtttctcgtaaaaaaataatcagatgtactgctcaataacaagagaaattgccttcttacagttttttggccctaatgatggagtcatgaagtcgtcaacttctggtgcatagaggaccattcatacatagcctcatttgattgtctagcatcctttggaacacaggatttttttttttaattttcaaacaaggaatagaaaaatgcaggattgaggtgccatgacttgttgaatgccatacgaattgtacagaatgctgtttgtatgcctcacggaaaaaaaatacaggaaatttaataagatttatatgttgatttattagagagagaagggagtaagatagagaagaagtgcattggagttctcgaggggatttgtaaggcaagaccatatgttagaattcctccaaactgtggaggaatttttactatccttaaaaattattttgaaccaatttcacaatatttattgatctctcctaggaatttctcgtttggatcgaattcctctagttttccaatggagtcccttcaatccaaagtagcccttagccattcttgtataaactgtgatctcctgatgtctcccaagtcgaaaacaacaactacatgtatataagtattgcagagctgtaattcttgagataaatcttttggattcacatcgttttaagctgaaagagtgggaaaataacactccaacttgattttagagagagcacaagatgccaaaatggcagattggggatgcaaatagtgtaaataatagagaatgatggaattcgttgaactgatatattgagtgtctcaagataggtatatatagagggtaattttaccatccttaagaaggtaccatgaggttctgtaaaatttagtaccgcgagatacaaaaatttagtgtaaaatttaactaactcccgccagccgctctcctttcccccgccgggattctcaatgagttccccaccggctacctgtcattgttgtgcgtgttgtcaccgacccatctgatttggattcggagtcatcaccaactctccatttggttaaggtaatgtggcagatggttagggtaaactttaggaaggctagcaagattatttatttccctaatcgattaattaccgtcctagcttaaggttttaaggatgtgctatagctagctgccatagaatagagaaagacatgtctgaagtttatgttatttgctatcgattagagaaacacatgattgtttgaatggtatttgatctttgctatcgactacaacaataaagtttgctatcgaagacataaaaacaataatcagctttcttgagtataacctggagttttggcaactattaatcagctactaatggcatgagcacactgtctccaaatttagtctctttagattgttcagactaacaagtgaacataatgacaatatgttctgattttgatttgtcgctaccttatggtgtgagcagttagaagcaaaataattggttttgtcatatagttaagcttcaaattgtgcatataagaataattagatctgattactcgtagcaatatatgaagcatggcgtgatgggctggattggtgtgcaaatggagattctgtaattcaggctattgatgaattgaataggcaaaggaaaagaatatcagttcgagtactataatgtattcatatgtggagtgtctaaatgcaatactgtaactgaaacctgttgtcatgtcagttttgggctctccatcttgatccaatatgcacaatagtgtccagatactgtgtacccatctgtgcaaggaaaacgttagggagtcttcttctttagctagattttctattttccctaatagattatgtacctagtttaaggatttgctaatttctatcaattagagaaagaaaggatgtctcgtggagagaatgcgtgcaggtgatctaactcctatataattgttgtatttagcaccattatatatcttgaatgtattatgaagagatgagtttgtctaccttaagaaagttttgtttttaccttgttctttcaaatattcagttaggagtgcatcctgatgtaattcatttttaatcacattttctcaacctgcagaatctgaagattagaacctcatcaccatttgccataatccattcaagcagagcagttgctatgaagtcgatacttggacatgctgtcctgaattttgttgttctatgatggcttccagaaattgcaagagcacattattgatttttggttttttttagatctgtaagcaagtggtattgggatatggtgttttgtttggtataattgagttggtactttcaagttccttatagctgcactttgagcatgcccttaaactgtcatttactgtatactcttgccatcaccaatctgaattggtcagcaagcttgtgagtggggctgtgcaatcagcatgcaaacagattaattgattaattttgagccctttgctccgactggctgtcatttttttatttttgttccatgatagtgttcaatgattttttctgaaatgttataatattttaaaatttgtggcatcaagtgctgatcttaacatactttgcagctagttaagatggaggacacaatcattagatgtgctgccagatgatctagtttagtattttgtatgtttgatcaggagttggaacagaacaaagaacatattttttatcccaacttcataatgtactaactgatataaatgacaggtatatatacttgatataaatagtaggattgttgtgtgattgaaatcatgcaatcttttaacaagaacaaagatgcagaaattgtttatggttagagctgttgacactaaggatcagaagttgtattaccacacatttcagattcataatcagcagatgtatctaatgtctagccattacatatggtgaataataagatatgtcattgaactatattgcaacaatgaaccaatgggcattaccattcttatggtcaggtttagctgaacaggactcctcaacacaagaaatgatcacttcctaacttttattgctattcattcctcctcacattactagaggcgcaccattggtgcacctcatcttctagtggtatttgatacatcataaaacatattgttactataataaaaacctcatatagaggcactttcgttgagacgttttctaaattgcttctaagatcagaagttttatagtgtagagacactttataaattgcctagaaaatttttactctagagacattttcagctcagtttattggattttatctcgtagaggcattctttcggtactgtaaaatgcgcctgatatgtaaaggtattttcttgtgacattttaaactatgtaaagatactttttaaaatgacaatgtgtactaaacgactgaatataaataactaaagacacaaacatgcaactaatgacatggaattgagttggttagtgcattgaggataaaaaaaatgatttgtccaggagatcttgagttcaaggtttgacagaagcaatgagactattttattctcctcttttggactagtttcatatgtttgtggtacaatttaatgtctcaagaaaatgcctataccatcttatagttaccataagacacttattagacattttttaaaatgcatctcctcttttggactagtttcatatgtttgtggtacaatttaatgtctcaagaaaatgcctataccatcttatagttaccataaaacacttattagacattttttaaaatgcctctacagtattgtaaaggcatttgaaaaatgtctctacagtacttagaaaaatatctctataaagcatttttcttgtagtaatgactcaaaatatttcctcggatttcaagaaatgttccatgcagcatagcacaacaaacttaaatgatagaaaaacaacaccgaaagtcctcttttggactggtttcatatgtttgtggtataatttaatgtctctagaaaatgcctctaccatcttatagttaccataagacacttattagacattttttaaaatgcctctacactattgtaaaagcatttgaaaaatttctctacagtactagaaaaatgtctctacaaagtatttttcttgtagtaatgactcaaaatatttcctcagatttcaagaaatgttccatacagcagatcataacaaacttaaatgatagaaaaacaacactgacagtttttaacagtactgttaatgagtacaagcttgacttagtaaagttcgttacataagttttgcttttcacggcatccaaaatttattaaatgcataacactatcaaccataaagtactagacaacacaagatggttagatcaaaccatatcaatgagatcggactcgaaagatccaagcaatcgaatcctgagcttcaggactggccattcaccaataagcttagtgagaatgggcaacaaaactgacacaacgcaaattgcaatggccaaccatggaaggtgaggggccaaaactgtatataaaccagttgcgaatgcggtagtggttgcaaaatatgcaaaccacatgagcttcttagtaaaagatctgtagtaaagcaagaactgaagatcctcccaccttgctatgatgcatacgaaggcaacagtaagtgacgtgcacattgcctaggtgtcagatatcaagaatgcctgaaatgcaagctttctacccatgttaggaagcccctcacttccagcattattactgtgtcctccaggcaaggtaaaagcagcggcgaaggtgattgttgcaaggaggattgctactaaagaagtgttgcttgtgtatgtttgagtcaatgtccttatatccttccttgctttctcagttacttgatctttgattgtttttataagattatagatttcacctttgtcttccgggtcagctttcaacatacgcatggagacttcactctgcattaatttattacaaagttatgtatggccatggtagtaatatgattgatagtcatggaactatacacacaattttggtgcttgcccacttcccttgacctttgtgtttcaatttatgtctgccacaaatgtttgcaaatttaaaataaaactaaacaatttgaagtgtccttgaattactgatgatcgatgtaattcctataccatgttgaatataacagaactagttttagaatccagaaatgaactaaagccagaagctggaaaacatatctttttccaaattctcagaaactagcaaccaaccagctgcttctagtattaagctccttaaacagacctaagtcgatggctctacctgtggtttgagagtgtgctacgtgttagcagcagttgcctgctcatttggtgagtgataacgcaccattttggtaattaatgtcaatatagttaatgagtagtaatgtctgctagttaagaaaagggaattgtgctcatacataatggtgggtggggtgtgtaaatagggacaataacttgtaaatctgttgtcccggtgcagcaacttgtccattcaaatccggtgcacaacaaatccatacgagcaaaggccaactcaaaccccgatgcgcacaaccccctgttttttttttcgaaatatacaatctcttgtttttaagagattctatacccgtcatcgaaaacttatcattattgtggtcagtgacgggttataactcccgtcagatgaactcatatcagcgtatgatcactaattaagtcttctacagcttatccctggtaagtaattttatcaaacgggttacttttcaggacatgtttaggttgtagccaaaataaactttaccaagtttttagcaatgctaaaattttagcaagatgataatattagtaaaattttggcaggatttcttatgtattgactatggcaacaaattaaacgtatctatttttttaagtaactttgtaaaaaaaatggtatgattgaaaatgtcattaaagtgaacaggcccttaatcaatgagagaagtcacctatgatggatgacctgtcacgaaggctcatttctgtaacagtgagtgtatttttctccacttgtgaataaatttctctcataatattcttctatatatatttggtcagttatttctctacttcctgcacataagctaattaagtcttctacggtggtgctcggcatgatatactgacatgttgtactacagaaaacgtttttctggaccagactcccagtaggttccaaacggcccgtaagtgccagcttatgcaaaaatcgatttctccagacggatcttttaaggggaccgtaagcaaaaaaaaaaaaaagatttttttttatacggtcctcttaaggagtaacatgcaaaaatctattttttttctcttatgctctctctttccctcctcaccacttcaaaatttttcacccctctcctctctccctctcctgatatttctctcctctcctctcctcgtgttctaactcctctcctcctccaaatcagcgtgggcggtagcaggcggcgacgccgatggggaggccggccattaggtgtggcggcgggtgatggcgagggtgcgacagcgggcggctgcgcggcctccatgacagcgggcggcgccctcgggagggccggatccaccgccctcaggtgcggctacggccttcgcgacggcgggcggtgacggtggacggcgagggtggcggatccggtggtttcgccttcgagaagagggggggggaggatctgccacccttgggtgcggctgtgaccttggcgatggtgggcggcgacggtggatgatgacggcagcggcgctcttggggaggggggggtgggggtgggggggttctgtcacaccttgttgcggctacgacccccgcgactgcggccggtgagggcggctgatccggcggtgccaacatcggcgatggcggccgctcccaccccccacgcacgacggcggatctagcaccggtgacggtgggagcggcggcggagatggcgatggctatggcggctgcaggcttgacggccagaggtcgcggatcgacgacggctgtgagcgacggcggctgcggggaacgacggcggcctaggcagcatggatctggcatggccagtggcgggcggctgtggtggcaggatctggcgtggcaggcggtgtgcggctagggtttctgcctttttttgaatttatatttttttggcgaaaatatttttgcatacggctggcttaggtgcctgcatgcaaaaatcctattttggcaagcggttgcctaacccgcatgggaaaataacgattttggcaaaccttttcacgcatacgggtcggccaaccgcatgcgaacatcgaagaaaaagtaggtttagtcactgctaaatgatgattatacctctccgcatctattttcttagacaataatacccattcatgtttatagtactgctaactgggatggttgtataaatagatctgcacctttcgatcaaatgagatcaacggttaagattgctttatagtactggtaggtaggaatgtagtgggactcttttctctttaacgactgaaaattataccttgcaaattgcttaaataggagatatttttcaacattatagcatcgtttactattttttaatatattagaatagaaatcgatgacatatatatagacgctatatatgttgtggagagcatatgcgtacgtacccagttgagcgtcttagcatggtcggcggcatcatttggtacccagattggggggttaccgttgctgtcgagcactgtgacatcctgggctttacattgcagtaaaagagcgacgatcttcggatggcacttccggattgcataatgaagggcagtttcaccgtttctgtctcgcatgttaatgagtttccgcagctcctttgactgcaaaacaaattccacaaactttatgtgacctttttgtacagctatgtggagacatgtggtgccatcgttttcaactagaaatggagcatctggacaatgtttaagaatctccatagcaacaccaacatggccctggtatgcggcactaccaagaagagggataccacttgtgctgattatatatcctaaagagaaatcatgttccaacaatacttttagcacgtcaatcttgttctcaagcacaccaaattgcattggattaacccgtgcgctgttctcttctcttgccaatttaggacgagtctcaataatctttttggcgatatctgagaaaaaaatgtgaaggcatggataatattaatggttaacaagcacatatagctagatcgatacatatagctagatcgatgagggtctcaccagtattgttatttctaaaggcagcatgcagagcattgtatccggaggttccaccgtgagcagaatcaggaacctccaacagtttatcgaacacatcggtgaaattcctcatcaccgcgatgaacatgggcgattcatcgtgtttgttaacagctttcgtcaaggcaggctctttttctatcagctcgaatgcaagcttcctgtgtcccctgcggatggtgtggtgcagcgcgttgcatccttgcttgtcttgcctcaccatcgcctccctcgtatcaagatcgtcatggcggcggcagtagtaactgagaagaaaagaagctaaagcgacattgccgctttttacggtggcgagcaacggcgtctcgccatccgcgtttacagtgcagaggagggacgggttcagcatcaagatatccttgcagaattcctcgtggccatgggccgatgctatgtggaggcaggtgttcccctgcactgtccttccaagcagaaggcttgggtcatgcagagccggcttcacacccgatgtggctgctttcagcagacctctgtccatcactggcgaatctgcggttgctttgctgtctggaatctgcatgcaagtaataaatgaatatgatgctttcctgttaacgacaaaatttggtaggcccatgagagaattatcacatcgtcaacagtcggattactgctatattcggttaaggaaattaatctattaaaggaagcttatgcagaagtagttcaagaggatgcgacatgacaaattatctattaattaggaataatttgttcattaccttttatctttagaaaagtgtgttcagtgtcctataaggattttatattttccttttattttttaggaaagtttttttcttgtcctacaaaggactagtatctccctgttgtcgaagcgacaaccgcgtacgtcgaaggacgtggttactcaacagtgttggaaaaagtaaatgtagtattttgagatttttctttgggatccccacttcacatgtccctacggggctatttataatcctattacaggttcccccattagggtttaggctttacaggggaatttacatggctgcccttatgaaagggacgtttgattgggtatacagtgtaatttggatacatgggcctctaatgggccaattggcgaacaggcctaagcggctgggatggccccttgggcctcttcaaagttgggcttgttatggcgaagcccccatccttcagcatacacccttcgcccaatgatgcatttggtcttgccagataccaacgcgattcttcagccttcgccatctctacttcatagtcttcgccatgggacttcgcccagatgatcttatcgtcatgggcctgaatcctcacaggttgcatggtttcggtaggtctggtcgaagggtctcatgacataccaccaacaagcccctcacgggcaagggtgagttatgagcttcggccgagaccgtgcaaaccatgtggtatggcatgaggcgccccctttcgaccgacgctcctgccgaaacctatactggagtcctgcaagaaatgtgtatactttgtgcatatgtacttttacggttagtaaattttcctatctttcgccttttgcaaacagcgaagccgttctctttttgtgggccgcaatgaacagtgacgggcttccctcatgggcttagcactgtgcggctcaatgaatgggaatttaccatttcgcaaagagagaatccattatttaccactgactttatcacacgtctacgatttgccactgactttatcatgttctacaatatgccatcgacttttgcttaacttctacaatttaccatcgccgtccggttagtctccgttagtactgtacaaatttttcaaaatgaccaaaatacccctgggagaaaaggtttcaaaatttggataaaaattatgaaatatcatatttcaagtttttggtcaaattttggatgtttacaatcttatgtttataatataatattttgataattttatccaaattttggaagtttttgtcataggggtattttggtcatttcgacaaatttgtacagtactaacggtggctaaccgaacggtgatggtaaatcgtagaagttaagcaaaagtcgatggcatattgtagaacgtgacaaagtcagtggcaaatcgtagacgtgcgacaaagtcagtggcatataatggattatctctttcgcgaacccttgtgacacgtggcggcttacaattgggtgggaaggcgaaccgacgcctgggtgggttatatatccccccaccctttttcaccgccacgcccctgtcattttcaccgcgagcattctctttctccgctctctcacttcacggcgttcttgagtcactaggcctttcgaccgttcctttttttttctccacaagcggcagatttcgccaccgctcgcacttttcgccatggcccctcgcaacccgaacccatcttacgtgacgggccctgatctcggcaggatcgatgatgacgccaccgcctatctcggggtttcgcttgtagacgaggatgagttgatgaagctggtcacctccggcgtgctggcggagaagcaggccttcgccttaggaaaggctgtggtgccgaagcccggcgacaaccggacggtggtcttcgctgtgttcttcgaagcgggccttcggtttccgtgcaacgtgttgttgcctgagattcttcgcttttttcaggtggagctcccccaactgagcccatcggctctcgtccggattgccatcttcgactaggcgtgccggcccgctggtttcgaatcgagcgccgggctcttcggtgctattttttacgccaccataaactcgaagacggtggtcactcccccagggacgaaaaagacggcgttcgagatcatgaacttcaatgttcgccccgagcgctctgatctatgcccgatcaacggcaccatgtccaagtgggatcgccactggatatcgaagtggttttaccaatccatccccttcgaggctgggtccgagtcggcgaaagctctccgatggcgtcgcagggcgatcgcgccgaataggaagcccaaggtcactgtcgatggtgccatggaagcccggttcgccctgcttcgcaaaatctgctcccgccttagctgccgtgacctggtggaagagttctgtatgcttcggatcttccctctctcccagacgtggcaagtcgaggtgagcccagacgaggaggtcgatggcttgccgaagctcgtcatgccagagggggcaaacagtgagtttttgctttcctatatgtgtctgtattttgctctttcctcctattcggcgcctaataagataacacgtttcgtttttgcagtgttaactcttgctcaggccgacaccgaagctcggaagatgatcggtgatgtgtcggtcaccgaatacagccagctacttacacggcaggcggccgaccgggcgaaccgagtgtacgatggcaatcttcctccccgggcgaagccgtataaggccaacggtgatgaagggacttccatgaagcggacacgcaggcaagttaaactggctccccggagcgaagggcccctgccactaccaacttcgacgccgatgatgaggacactgtcgatgaccatgacggcgaagaggaaggggaagaggacgagacggaggttgcggacgagcccgccgacaaccgcaccgagacgcgtgggtacaccccaactccaagcctcgaccatgtcaaaactgggtggagtcgaacagctcccccctccgccgaaaggatttggagggggcgaaggcgctggtttcgtttgtggcgggcaaggtggcgaagaggggtttggttaaaaagacctctaaaaaaatggggctcgtcgatgtcgctcgcgttttcagcgacgacgacgagtcttcggacgagacccctacttcgcctgctggtcagagcctgggttttcgaccgctcctggtgctgcggtcggtgttggcggggtgggagggagtgttgcccttgggacttcagcatctgctgaccgggtcgtgaaggttgcggccaggctcttcggaagccctgtgcgcaaaccggtggcctcgccgctcgccgtccagaagtggaaaaagacggttgccgaaacatcggcttcagagtattcccttgcggcgccacacttcgcccccggtgacttcgagactcgggcggaccttatccccttcgtcaagggggtaagtaatctcgtttctctggctgggagcccgagcctattcttcgagctgaacgagttcgacgagggctgttccgccatcaagagtttagctgttcgggtatgctattcatatttctttccttttagctgttgtttcgggtatgccattcatcttcgccctctttctctttgtcgaaatagattcttgcggctcattgttcgaccgaacgaaccgtgcgggctcgtcttgacggttttaaaggccgttttcgagctaaggacgacgaactgggtcgcaagagccttgaaatggagagcctcgccaacaccctcaaggaggcgaaggctgaaaacaagcggctccaagctgagcttgagaaagggagcgaggcaaaggccgagatcgagcgtctcaaggccgaggttaagaaggagcaagctcattccgccccctgaccgactactataatctcaccgagccgaagatggaggctctttgccaagaggtcagcaaggcagaggaaaccgcttcaacggaggcgcagcggttcacgcaggatatgtcgaaagccactgaatctgccaagaccgtgtgccgtacgcttcgccttgcccttactgacatgggggcgagggtgcgaggagtccctggcgaagatgcttctgccttcaccttctcggagtggacacaacaggctggtggtgcggtctccgattgcgccactgcgtacggcgattgttgtgcgcgtgtgtcggcggcctttacaatgggcctgttgcagtagaacggtagcgaacacatcgtcgagctccccaagtttgtgaagggggattgggaggtcaactctcaggacatttcgctcacacttcgtggctggcgcaaatagttctggcaaaaagaacgccgatccaccgccaaggtgcgcctgctcgaacacttggcaaaggcagaggaggcggagcagggcgaagagccagcggccgaagaaggcggaatggatgtgggcggtggggcggacgtcagccaaaatcaccccgaggtgtgaggctctccacccgttctttagattttttgtagatttctcttggcgcttgccgcggtgggcgaatgatgtaaatttggccggtggccctacccctttcgtattgtagccgaaaatggccctttttaatatatgagatagatgaaccaagtcttagtaaattatcatgtttcttcggctttgatatgtatgctttcattattctgcgcacaaaaaagagacgacgtttttcgcccactttatgtgctccgcctcgtcttaaccatgtgctttgccattggccttcttatgttttcttagcagggttttcgccgaaaggtgtatgttcggcctccttttggggattggcggaacaagaatgtgagaaattcgtcacggttaaaaacctgccgaagattaagtattcctgtcgcgagatgataataaacgccaaaagcgggcacaccccgggtgaaccctggacgactacgatcatgtccatgtggaacgtcaggaggacatggcccgcttttggcgaaatcaccgaaggactgatcgctaggaagcgatcgcccagcgccactatggcttagtttgtgtttcgcccccttctcctcttagggtagtgtataatattagtagtgatgacgaaccaagttcgccaaatcacacctttgggagtggagggtgttttgggggcgaagatataattttcttgtaagctaggctgtaaagcccgttactttctttcacctatagcatgttgtatggcatgtattctttgatattttttgaagttaataaagatgtgtttcatttccttttcgctattgttcgcatagtcacctttcgtgctttcgttaggtcgaaacatgtcggcccccttgcgtatattagcgaaataggtctgctgactttttagctttcgacttccgctttcgatctgtggtattccgcgctaaaagaagcgcttgtgttttcacataactcgagtattgcggtgttcggttacttatttcccgaaacaagctgtcgcggtttcaacgttcggtgagcgatgcttcggccgatttctttcgccccccggtgctttcgctgatcaggcgtttgccttagggtttttccacgatttatcattcacataagtaaaaaggcgaaagacacaaggattttatactggttcaggcctccaggttggataatagccctacatccattttttttgtcattttcctctttttttggtatttttgtgccgaagggcttacataacgagagttgccgaaaggcctatacaatagtatgtacatttttacaagttggcgaatggggtgccaccctttctagatatagaaacgcttaagagaagcagtgttccaggagtggtcgaactcttcgccttccagcatcgccaagcgaaaggagcccgtcctggacctgtgtttgatgaggtatggcccctcccacttcgattcaagctttccgaccaccactgggttcgccttcttccttaggacgagatggccaggcaaaagctgcatcggtcgaactttcttgttgtaagttgccaaggtgcttgtagcgtacttgcacatgtgttctattgcttcgactcttatcccttcaaggagttcgagcaacaactcgtgcgcatcttcgcctccaaagaacatcacccttggcgaattagctcctagttctattagggtcattgcttcgtcgccatagagaagcatgaacgggctgaacttggttggcctagtgggggtcatccgaagggcccagagaacagatagcatttcgtctagccatttaccctttgccgccccctcaagccttttcttgagcgccatttgcacgttcggccgccccatttgactgtgggtgcgcgaccgaagcgaacctgatttccaggtttatcccctcgcacatctctctgaacttgtcagagtcgaattgcttgccattgtcagtgatgaattccttcggcactccgaaatgacaaacaatgttcttccatacaaatttctgtactgctaccaaagtgatcgcaccaagtggttcggcttcgatccaacgggagaaatattcgattgctacaattgcaaacttgtacccatttcgcgctaccgggaaagggccgattatgtttagcccccatatggcggaaggctagaccggagcgataggttgcagctcatactggggtgctgcctggcttcggctatgccgctgacagctttcgcacttcttggcttgctcaacacagactttcagcacagtgggccaatacaccccctggcgaaacactttggaggcgaccgttcttgcggcctggtgcgcaccgcacagcccctggtgtattttcttcgccatttcctcgccttcaacgaaggagatgcagcgaagaaagggttggagcacccctgagcgatacaattgccctgagatcagcttgtatcttgtggctctgagctgtaggagcttcgcttctgcttcgtcctctggagccaaccgttcttaaggtacttcacgaacggtgttcgccagtcctttgggtcctcgcccagttctgcctggtcgattgccatgatgtccaggctctcagtaggcacacttggtgcgtacaaagacctcaaaaaagatgcccggtgaatgtgggcctccacaagcaacagacttcgccagggcgtctgcttcctcgttctggcctctaggtaagtgttcgaccgttatgccggtgaaacacttttccatagatcgacttgcctccagatacctcttcattccttcttcttttgcctcaaaagatttgtcaacgtggcttgccactagtttggagtctattcggatgagcaagcgccgaaccccaatgctnctcacctttcttaggcccagcagtacgacgtctgccgtgttgttggtcgtgttgaactacagccttatggcataccgaatcggcacgccccttggcaaaatgagtactgccgcggcacccgcccccttttgtgaccacgaaccgtcggagtacattacccaaggttgttcgacaggcttgggttcaggggtgaatgccggcgtccattcggccacgaagtcagctaggacttgggacttgatagcagtgcgggcgacaaaatgcagatcgaagggagataactccgccgcccacttgctgagccgggggaagtcgtctttcgggcacaccttgttgaggtctgtgaaatcaacgcacatgcgctatttgccgtttgacttccgcaccagtaccaggttcgccaactactcagggtggtcgatctcccggatcaccccggccttgagcagcttttgcacttcggcttttgctacttcttggcgatcggcggacatcttgcgcaacttctgtttccttggtttggtgttcggcttgaccgccagatgatgcatgatgagatctgtcgaaacacctcccaccttatcgggtcccaaggcaaagatgtcaatgtttttcttgagcacctccaggatgttttcaacttccctttcgcccatatcgcccccaagcgaaacaaatcttgtgtgattggcatcgtcgatctgcaccttgatcaccttgccatgaggggcgggtgctttgtacggtcatgcggttcggcctgtacattgtgcactgccctgctaattgcggccaaatcgccctatgatgtagccgaaggctgaagcccctgaccacgatgacgcctgccggactaggcatcttgagcttgagatagttgtggtttgagatggctttgaacttgttcaaggttgcacggccgaagatggcgttgtagttgtatgggatgtcgacgacgtcgaagagtatttgctcttcgcgcttgttctcgttcgtgccgaacgccaccgccagttgtacttgtcccaggacttgaactgcttcaccaccgaaaccacgaagccaggctgctgcttgagtgagggctagggtgggcaagcccattatggcgtaagcttcggcgaaaataacatcggccgagcttcctccgtcaaccagaatttgccggacttcgaagcccgctacttcggccaagatcaccaaggggtcttgatgcgggaacaacactccttcggcatcttccggcccgaaagagatttgctgattcaagtaccgtggagccccttcgtcggccgaagcaatgttgtgcaccattcgcagctacatcttcttctgcagttttgacggctaagctggcgagtcagcccttgtaatcacttggattactctgcgcttcatgtcttggcgctattcggccgggggtacttgttcttgagcagcctcgcgaggtgcttcgacagctgctccttgttgaggccttggatcttgagcgttgccacgctgtcgaatgtttcagcattgctcgatggtgtacgaagaacgtccatggtaagcgcagtagaggtcttttccgaccttcttgcgaacaggctgttgatggctgcccgcttgttgggcgtcgaactccttgcggagggcttagacttcttcgacagccatcacggtcttgcctgcgcggtcagttctgaatttcctccaagtcatgggggcttgacttggcctcggcggctgtccttggttcatcagctgaggttggcgaacggtgagaggagccggttcggcgacctgtgcttgtacttgggcttgagcagcagcgatggaggccttatcgtactcggcttggattgcttgccatcgcttagaatcctcttcgccccttgcgtacccatcaatgatacgaagcaggtgctcaagtgtctgcggctccttgttggcgatttttcttttgagttcgccttcgagcagcccggccgaagcagcgttgatgacagacgcttcggttatgtcctgaacttagcatcgggcttacgagaaacaacgcatgtactcccttatcgattcccccggcctctggcgaatgccgagtagatgttgctgcgtcttcggctcctcataggtgccttgaaagttaataacaaaaacatcgcgcaattgctcccatgagtaaatgctattggctggtaaattaaagtaccaagaacgggcgatgccatctagagcgagatggattacctttgccttggtgttttcgtcgccgtgagcggcttcgattgcggactcatagatggacagaaattccttcgggtccgttttgcccgagtaccgcggaacaggtgggaacttaaactggggtgggattggatgaatcttgattcccctgctcagcggtagccccttctcaccccctggcttgttcggcaccagctgcggatatggtgtggtgaagggtgaagtcatgacttgcgcatgaggttgggccatcgtgttcggttgcccggtcccgaacggcgacgcttggggaaccgccatggataggtcgaacgtacgctgtgtccaagccatggcgacctggttcggcgcttgattggttccgaagcttggtgccgtcgcctgtggttggacggtcggtgcttgaatggcagtgttggggtcgaactgcggtccttggctccaaggcgaagcccctggaccaggctggttcgacggtagccaactgggtgcaccctgacttgcattcccttccggtcagatcgaaggggttgtacttgaaatattgtggggttagttgagctggtgaaggaaagcttgaaactgcgcttgccaggctgaaaccccttccaccatcgcctgtgatgtctgtgccagtagcggaggatgcacttgggcagcaaccggccgaacttgtgcttgtacgtgaggggatgggtgtatggttacggctgaaggctgtcaggcgaagcacgctggcgcttgcatgacttgcagcggaaagacctggatcggcgcttgcggatagacttgaggtgggttatagcctgccgagtactagagaatgggtgctgatgcagccttagcttgtcgggccgcttcgtacgcctgctgctgcccttccatctgacgaagcatgtcctgaagtcgtgccatgttctgacgcatggcctccatgtcagcttcggcctgcgcgtcgaggttggggttgacttgtgcagcggcgagcgcggtcgaagtcggagcctgctgtggcgaagcagcttggggcgccacctgttggctcgttgaaaggatctccgccctggtctggagcacccttgctgttgcagccgtgttcggcgcctgccccgtcgaagcggcaggagccgaaggtggtggttgcagcgcaggtgccgaagccgatggtgccacgccagcttcaacgtcgggcgccgaaggctctactacctcttcggcggccatctcgcctcttgcttcacactccattcgcctagcaaccttctcctttgcgacattcttcggtggcattcgctcttagtggtttcactcagaggtccccatggtcggcgccagctgttgtcgaagcgacaaccgcgtacatcgaaggacgtggttactcaacagtgttggaaaaagtacatgtattattttgagatctttctttgggttccccacttcacatgtccctaggggctatttataatcctattaaaggttcccccattaggatttaggctttacaggggaatttacatggctgcccttatgaaagggacgtttgattgggtatacattgtaatttggatacatgggcctctaatgggccaattggcgaacaggcctgagcggctgggatggcccctttggcctcttcaaagttgggcttgttatggcgaagaccccatccttcggcatacacccttcgcccaatgatgcatttggtcttgccggataccagcgcgattcttcggccttcgcgatttctacttcatagtcttcgccatgggacttcgcccaaatgatcttagcgtcctgggcctgaatcctcgctggttgcatggtttcggtaggtctggtcgaagggactcatgacataccgcgaacactccccatgggtataaatatgtacacccaggtcattgtaaattatctccacgatcaataatactactctaagcgcatcgccaccctctttaccgaggtttttacttatcctccagtggaatttggcacctgacacggggctgcattagttcagttcgatctctagcgaagggataagtccaacgttccaccggcctaggcaattgtctcgtctacgtcggcatcgttcaaggctgcatcagtacattcgacctcttgaattgctctagtttggatgatatatttgcctacctatttatcagatgtctctgttaatctagtcttagcatatcaatttagctctattggctgcttctcgttttagggtttctgccggcatcggctaaattgtgttgctagattagattaacttagacatctaccacccttaaaatcagccataggcttgattgtccagatattatgtttcttttcatatttagtgttgcatcaactaaatttgatctattaagtcatgcttagaatcgtaatatctagcatgcttgttgactgccaataagggtttcatcggggctttagccgatgaggtatctggacgttgtatcggcttacaaggattacatacaatttggatttagccgattgcaataaagatttcactgttcaatctaatcttatggattttatgacatcggacctctagccgatgtatgctttatcctttggatcagtacttatcctatcatatcattattagccgattggtttctattggattatatgactgttatactgtattatcatcagccgattgcattatatcattatttactcaagtatcattatctacattggacatatagccgacatctcaaaactctatcgctatcggctagtatcggcatcggctggaatcactccatcggcttgtcaaccgatcagctcattgatcttcaatttgtatgttttgtcagttgcagggtcaaactgactatcacgcccgtatctcaccaagatttagacctgcactagagctaagcagatcttccatacctatattttttcgtgtcaacagtaccatctgggatggctcgtttttccgttccaatccaattcgtatcagtctgggtatcctgaacttttttacacgtactattttgctaaaaagacaaactctgaacacattagatttttttagcaaagtagtactactcaatcacttgtaataattacaagttaaacacttgtaaagttaaaaaatctaatcttaaggatggacgggtatttttttttaccagctgaagttaggattagttttttttttatggaggggtatttttttttttacttcagtttcatgggatggagcggtaggtaggagaaggttttaagagctacttcctccgttaaaaaaaccaacgttttaacatagtgatgggacattatacagtaccatgaatctgggtattctcatgtctagattcattatactgtattatgtcccatcgctacctacgttgggtttttttggacggaggggtataaggcaaggtgataaatgatactccctccatattttaatatatccctccatattttaatatatgacgccgttgactttttgaccaacgtttgaccattcgttttattcaaaatttttatgaaaatctgaaaatatttatgtcatgcttagtgaatatttgatgataaatcaagtcacaataaaataaattataataatgtaaattttttaataaaacgaatggtcaaacgttagacaaaacgttaaaatatggagttagtataaggcaaggtgacaaatgatgagatagctgatcagaagtggcaacgcgagcagtttttttttgtcaggagaggtttggtcgttgtctagccagtcgggtcaagcgcaatgaatgagcacgattgcacgaacgatggatgcgaacgtgcaggaggttggatgtggattagcggtacatgtcagctgggaaaactctaaacttttgtttgggtgtcattaattggttaccactctccccgactaaaaatataagcatttttatatttttgatacagtctttgagatgctacttggactaacaatatttacaagtaagatgttttaaacaatatttttttttgctttgattcctagtttactataatttcaccgtagtgttacagtcagaagtgcagtaatgtcctatatgttttacagtagcgtgacgtgttactgtacttttacgataattatacttcacgaatatagtaaaatgttatgagtttcctaataatatatatgttttgttttatggtggtagtgaaagagattagaatcgatcactatattcctttctcacaaagtaagataaaaaaacaaacaataatccttaaaacaaatatcatcattggatgtattggtaagaataacttggtatatactgtgagatcatagttcaaatcttgaattcactaatttatttttttaattttctataaaagagaaaaaaagaaaaaagggagagggaggaggaagggcatgggagagcagagggaggcgcacaccaggaggagagggggtatatataaactattataaaaatattataaaaattgaagatgtttctgctaaaattttagtacgtcatccgcattttagttgattttctaatatttatctttatctctaatctatcttaatacctaatacctaataaaaaaataagcaaggattccatgcatttgatttcatatgtcgtctctacgtgtctaaaccattgtcgtgtgcctccagccgccgccgtgccgcccgagccgaaccctaacacagccgccacatcgatctacctccacatgcattttctcctctaattaattaaaaaaatggattctccactcctcaatcatcctttcccccatgatttccccctttcaatttggctttaattcactagatttcaactcagtttaatggtagtgaatgatgctcggccggtgatttttccccggttgtttttatcctctgagttttgtggattcgctgcgtttttaggaaaaattgaaagaagagatcaagttgatcaaaagccctcaatcaatttgggagaccgagaaaggaagatcggcttcggcactgtacaggcacgaaactttcttccggaagttaagacaggcagacagagcgaagaggggtaggaggcagcgcggtttcaattataatatatagcgatactaattcttagtaactattgtatcactggaaaaaaacacatttacccgttgtaacacacgaacatttttttagtgtctatacacatatatacacatatgtatatgtatatatatgtgtgtctatgtgtgtgtatgtatatatatatatgtatatatatatatatatatatattaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatgtatatatatgtgtgtgtaagtataagcatttttagcatagtaacaagtcaaacatttttaactttgactatgttaacgaccaaatttggtaagatatgaattaggttcgacgttggaatcgaagcggattcggcggattcggcaaagagttagatttgaagaacagcgtatgcgtcggctgtgaaggcatcggctggagtctgaatcggctgagatggatcggacagaggataaccgatacagccgatagagttggtatagccgattctgataaagatggcttcgaggctattcctagaatcaattaacgtgcttcataaggattgccacgatggagaaaaagcttttagaaagtcaattgtagctattaataaggatatctcatgtaaattctttagagatatgtttgggcaaaagtctgccgcaaagacttatggtatcttagagtttgttagagataagaatcgtgtccggcaaggacatatcttgtaatctcggatataaatatgacccgagcctatgtaatcaaataacacacattcaataacactttcggcgcatcgccacccttttattctatttcgacgagttcttgctttcgggttgagctgcattgattcgatcttcaactagaggtaaacttgtcaaggcggtttgcgttctcgggattagtgcttccatctttatgacactctaatcttgtttatgtaattcgtcgagttatcatatatactttacaatctttgttagttgtgctatataacttgtcatcggctagttcttgctgttaagaagtaaccgatagggctatgttttgttgttaacttggattgtatcgggtatctaccatctcttagaagttttcatcatcttgtttagatcctacagttatctttatgcttaatgctgcatcggttaagtttgagttcgatctattaagttctatctataattgtgatatctagcctgttttataataattaatagagatagtatcggggtttcagccgatcttacctgatttagctactttatatcctatatgttcgattgatatgctaaatctgccatttatattaagatcttattgcattaaggtatattaggcttcttgtttgatatattctgcttgttctaatatcttagtatagagtggtatcggagtattagctggtacatgctagatctttttgatcggctatgctataaacatctatataattaatactttagtatatatttcgacttaagtgatttatactgtctcggcacagcgaccgatctatcccaatcacttagtttaaatatgtatcgaagtagagattatatgttattaatatctatagccgatcgagtagatttagtcttatttcattcattaatgactgccgatcgattcagatatgacatcggctcagagataaatgatatatcatcggcaactagccgatcagctatcgtctatagatttaaccgtgtttttcttatctttctttcttattgattgcaagatcaaatcaactggcacgcttacgaatctaaaggcgagattttgaacctgcacaggagttaaacagatcttccaggccagtgtatgtttttcgcatcaacagactattaatagaaaaaaaataaaaaaggtcaatcatataaaattgatgtttctagatttatcattagacaagctatcataatatgcaaatctttttatttaaaatattttatttttattgatatagttggtcaaagtagcatatcgaagatcgtgtcagagtccaaaagttgttatattttgagacagagggagtatataataccgcttataataaataatgtatagttagatgtaggatggtggttataggcagaatgtggagaaatttgaattcgaagtggttgatatgacaagtagcactatcatagtgataactattttactataacttttaaatactataaagatactaacaattataggatggtggaagtacatacccagatgtggtcgatgtcatcgtcctttctgctagctaaagcttcagttaaaaccgaggtggccgtctgaccgtcattgttaagcagtgtgacgtctatgccttggtgaagcaataaagcagaaattatcctcgaattaagcttctctgctgcgagatgcagagcagttcgtccgtatttatcttggatgttaacgagatgccgtagttgttctgaccccagaacaaaccgaacaaactctatgcgatcagagtatgcagctgcgtgaagacacgtccagcctgtttcgctgcagtatggagtatctggacaatgcttaagaagctctcgagcaacagcaacatggccgttacgtccggcggtacaaagaagactactgccttctctgttcattagataccctacagaaatagttttagttgatcccattcactttttttcactatgtgattggtatccctcttattttaatactaacgcatggtattttctctcatagaataacatacatgttttctcaatgtattattcaaatatattaaaatgacaacataattttaaattttgtactaactttacgaaactactaatgtgtaatatttatattgtattttacatacatgttagttattaattatttttaatattaaattttagttatttgtaaattatattcctatatggactctagattcgtctttcaatatttctttgttttaattctgaatttttgttatctgtaaattgtatttctatatactccctcttttccacaaagagacaaattctagcatcccaatgcatcactaaaggagaggataaatgtccaaactaccccttaatattagtaaattagtattggtgggtaggtaggtaaggggtattaaaggaataaaattttttgatttgtgaaccgagagtagataagaaggtagaggtagatttattttcggacaaagtttgaattgtagaagttgatttattttgggacgtagggagttgactctaggctcttcttccaataatatttttttaattctgaatttttattatttctaattatatttctatgtggacttaaactcatctttcaatattcattaatttttaatttcgaattttacttctaaattgtattgctatattactttatactcttcttcccatgtttcttttcaattttgaattttatttatttgtaaattgtatttttatacgaactctaaactctacttttaattttattatgtttattccgaattttagttacttttaaattcctatatggactctatgctctgcttctgttattccttatttttaattccgaatttctattattccttaattgtatttctatatgaactctgtactctacttataatattccttatttttaatttcgaatttctattatttcttaattgtatttctatatggactctattatcctcttccaatatttcttattttttaattccgaatttcaactctttctaaattgtatttctatatgggctctgtttttctttctctcctattaatatgagaatttctaggataagccaacaagaagatcaaaacattcaaatgaactgtttattatgcagtcgcatcacatataattaaatagttttacttgatcccattcacttttttcactgtgtgattggtatccctcttattttaatactaattctcttatatacagcgtttgttagaaaaactaggaatgactcacgcaacacgtgggcattcatattattaaaacaagatattatagtttgttcaaaaatcatatctcatagggcaaactataggtcgggtgaatctaaaaacaattcatcgacttacaagatagatcaagctcatatgacttttgaaccaacctttggatcgagaatgcaattatcatgcataccattcaatattgtcaaaaggaaaaattaggacggtaaggaactcaaggtatgatttaggccatgtttgatttagcttaggattattataatctaaattattaggagtatataagctaaaacaaataagtagattattatgatagattattataatctataagccagattagtataatctaatatactaatctataagccaaattagtataatataatagattagtataatctataagccagattaatataatatgaaaattatggttggattttttttccgttcgtacaagtttaaaattttcatattttttctccataattctaatgaatttttaaggcgttttatgttaggaaacaattcacctacacaattagttggcttgtagtccaaaatatcaacaatagtttgcagctaatttctttcttttttgtatgtttgtttgtttttgttcaaaacaatatttatttgaaataagagtaaaaatatattagtatgtgtagtgtgcctataaattttgaaatgtttttaataaagtttatgggcgattgtgatcaacttagctacttcaggtagagcactaggtcatatgcccactaggcaaggacacaatgtgcaacgtgcaaagactggaaagagatctttagaggcttttttagaacaaaagatagacctgatggtctattatcatagcaaaatattttttattaaaaatagttcaaaatagtgggttataaattagtttatatagatcataaattgctaatttaatggtacaaaataaaaggtgcacctaactaagaattataattgttaatataatgggtaaaataatatgattttataaattttcttttttaaacattgtggagctaatttagttacgtatatatgataatatatacaatctatgtttataaagtcaacttaaaattattttcactaataataattgtgatctcatctattcagggagaaaagagggaaggagaccgaagcggatgtattttttaatgataaatgtaatttatgttttttatctttttatgtttttaaattatactacctcaatgctaggaaaatacaacaagaggtgaactcactctttgctcaacttaacccaaattttagtgagagttttatactacctaaatgctctacctttatattgctatggtttatatctgaaggcatcatcactacgccaagaaggataggttaccttgagaacgttctcaagggttacaatatcattttccaataagaagttagagtaattttacttaaggctgtgcaggagctgaagggctgtgcgcgaacccgagaaaactttttgcattctcatttatgttagccttgattacttggatgtggtttcttatgttcacactaagctaggagggatgttcctagtataaataccactctactttatccattagacaacttttgttcaattaaaacctcatgtactagatgggtaccccacgtgttgctgcaggagaattgtgtgataatatagtatatatgagttctaaaattttcttttttccctactatatgattttttcatgtgtttatttttttacctttatcagttatccataggttataaataattgggttgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatggacggagatttgcacgggtgtcctccgaacatccttctgacgggacgggacacacctacctccacttctgccggaggcaggcgcgtcgtgggaacgtggctgtgtgctgacgacatgagcagtgtcagaccgatcacaaatcggtcattcttgtccaccacgcgtcagcttagcaacgggcatgtttgcccttcttcacacaacatcttgcctgtaatggttaggataaagcctggcatatatcgaccggggctaacgtgccatctttgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgtatttcgtgcggcgtgacacgtttagccgagccgcaataaatgcggttaggtgagccctgctgtgctcacctaacccatgcacgcggagtagaacccgcgaggggtcggggcgcctcggccctcgggggcgaggcaggagtggtccgacccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcgcatcggtaatggtaacttggctgtcaataatgggcggtctcttcaagactgtcacctcacctgagcagcgcccaaatctgggcgagccgatttgcttcgcctggagatatggtaacgtcgcttcggtcggcgagcgtaattaacgcgcgcacgatacgatctatctcggctgccacaaccgcaagccgctcgggaggaggccgcccgggctcgccaagccgaagaagccgctcgggaggaggccgcccgggctcgccaggctgaggcgatggcgacttccgaggcagctcgcgatgaggccgcgggcgcgtcgcttgggcccacctcctcgggcgatgcccaggcgacagcttctaggatggctcgcgacgaggccgcgggcgcatcgcttgggcccactccttcgggcgacgcccaggaccaaacaggtccgggggacatccccgaggccggcacgtccattggcgggccgagccgcgcggcatcttctccaaggcagctcttccccacgccttccgtcgccccgctgagcgcagagccccttctgcaggccttagccgccgccaacaccgcggtgttggatggattaagcgcccaggtggaggccctgcaggcggagcgtgcggagctcgacgccgcatgggcgcgtgtcgaggaggggcggcgctcggtggaggccatggtggaagcaggccgcaaagcacaccgccggcacgtctcagatcttgaagcccgtaagacggcgctggcggagatcgcccgagaggtggaggaggagcggggggctgccctcatcgccaccactgtgatgaacgaggcgcaggactccctccgccttcaacacgggagctgggaggcggagctaaagaaaaagctcgacgccgcccaggaggtccttgatgccgccgctgcccgagagcagcgagcaacggagaccgaagcggcgctccggcggcgtgaagaggccctcgaggcacgcgccatggcgctggaggagcgcgcctgcgtcgcggagaaggacctggcggaccgcgaggccgccgtcacctcccgggaggcaacgctggcggcgcacgagtctgcctgcgccgaagaggagtccgcactccgcctccgcgaggacgcgcttaccgagcgagagcgagctctcgaagaggccgaggccgaggcgcaacggttggcggacagcctgtccctccgtgaggcagcgctgacggagcaggcgcgccgcaacttggaatccgtccgcgccgagagagccacgctggagcagcgggctgccgacctcgaggcgcgggaaaaggagctggacgcgagggcacgcatcggcggggcggctgcgggcgaaagcgacttagccgcccgcctcgcagatgccgaacacatcgtcaccgacatgcagcgcgcgctagattcatccgccggggaagccgaggccctccgcttggcgggcgagatagggcccggcatgctttgggatgcagtctcccgtctggatcgcgccggtcggcaggcgggcctctggaagggccaaacgatgaagtactccaccaacttgggaggcctcgctcagcacctctcaaagatggccggagctctccagcagctccccgaggagctcgagaagatcatcaagtcatcctcgagggacctcgctcaaggagcggtggagcttgtcctggccagctaccaggccagggaccccaacttctctccgtggatggcgctggatgagttccctcccgggaccgaggacgacgcgcgcgtgcgggtcagggatgccgccgaccacatcgtccacagtttcgaggggtcggcccctcagctcgcgttcgcccccaactccgacgaggagggcgacgccagcggtgctgacgaccgtgacgacgaggccggcgacccgggcgcatcggattgagcccccaggcccccgctaatctccagtttttttccttttctttcttctaaggccttcaggcctcttttttgtatagatcaacttaatctgcaatcaaaaatgatgaaaattttctttgtgttaattttattttgctatgcaaatgagatgaggatgatctgtgccgtggtcctcttttgtgtcttagcttgatttaaggactcgtgcccaagtcccagccctcgaaaggcgcgggtcggggctagtgcctggggagatccacatgtcgaggctggccaggccgggaacgtggtgaccgagggttatgggtgacccgattgtgggtttttgccgattcccccccggagttcaccacgccccagggcacggctcggttctgggccccgtttggcgattttagctgaccgaaccgagcccccgagggcaaggttgagcacgagtgattttatttcaagtcaaaattcttcaaaaaggaaaaaacggcacagatacagcccttaggaaattgaaactgcttttattgaaatactgaaataagagaaaagagaatgtgcatgtgtggcagcccccggccaaccctgcactcccgaggggggggtgcggggttggcccgagcccgaaacctgacgcccgacccccccctcaggggtagaagcgacgaaggtgttcgatgttccatgggttaggcaactcagtgccgtcgcccgtggccagccgtatggagcccggccgggggacgccgatcactcgatacggaccctcccacattggtgagagcttgctcaatccagcacgcctttggacgcggcgtaagacgaggtcgtcgacgcagagtgatcgggcccgaacgtggcgctgatggtagcgccgcaggctctgctggtagcgtgcggctcggagggccgcacgccgccttcgttcttccaagtagccgaggtcatctctgcgaagctgatcttgatcagcctcgcagtacatggtggcccgaggagacctcagggtgagctcggatgggagaaccgcttctgcgccgtagacgaggaaaaaaggcgtctctccggttgctcggcttggtgtggttcggttcgcccagagcaccgctggcaactcctcgatccatgaatcgccgtgcttcttgagaatattgaaggtcttggttttaaggcctttgaggatttctgcattggcgcgctccacttgaccattgcttctggggtgggcaggtgaggcgaagcagagcttgatgcccatgtcttcgcagtagtcgccgaagagttcactagtgaattgggtgccgttatccgtaataatacggttaggcactccaaaccgggccgtgatgcccttaatgaatttaagtgcggagtgcttatcgatcttgatgaccggataagcctcgggccacttagtgaacttgtcgatcgcgacatacaggtactcaaacccgcccggggcccgcctaaacggtcccaggatatcgagcccccagacagcaaatggccatgaaagtggtatgatctgcagggcctgggccggctgatggatttgcttggcgtggaactgacacgctctgcatcgccggaccaggtcgaccgcgtcattgagagctgtcggccaatagaatccttgacgaaaggccttgccaaccaaggtgcgcgaggcggaatgggctccgcactcgccttcatggatatcagcaagaagctcaacgccttgttcccgtggaatgcacttcaggaggattccattagccgcgcgccgatagagggtcccttctaccagcacgtagcgtttggatatgcgatggacgcgttcactcccttcgcggtcctcgggtagagtcttatctgtgaggtatgcttggatctcagcgatccaagcaatcaatctaagggagcttgaagcgctcccttcgggtcccgaggcctggactccgacgggcctcgggggccggtcaggcacatccgtctcccctaagggatcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcatccatctgcgggtcagagcaccggtactccttacagacctggttaacgactagctgggagtcgcctaacaccaagaagcggcggatccccagtccagctgccactctgagtccggcaaggagtccctcgtactctgccatattgttagtcgctcgaaagtcgagacggaccaagtatctgaggacgtctccgtttggagaggtcaacgtgacccctgcaccggcgccctgaagagacagagaaccgtcgaattgcatcacccagtgggcggcgtgaggcagctgtgaggggttcgtgctggcctcgggcattgagacggtctctggagccggggtccactctgccacaaaatcggcgagggcctggctcttgatagcgtggcgtggttcaaagtgcagatcgaactcagaaagctctattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcctggcgtcccggagggcctcactaacaaagtagacaggccgctgcacccttcggtggggccgatcctctctgctaggggccgtatccccggggcgttcttcgttcaagtggcctttcggggcgcacttgtcttctgtaccgatgaccttggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgataggtgcggccttcccgcagtggcctcggggccttcctgagggtcgggggcacccagcaccgtctgacgagcgggcagagcgccgactccggtcgttaggggccttaggccactattcgactcgggggcctctcctccctgctcactcccgggcctagtcagcacagggtgagagtgcgcggaatgaggattgtcctcatcgcgctccacaaccaacgatgcactaactacttggggggtcgccgctaagtagagcagcaggggctcgtttggctccggggcgaccagaactgggggagagctgagatacactttcaactgagtgagagcacgttcagcctcctccgtccaagtaaacggcccggagcgtttgaggagtttaaataagggtagcgccttctctcccagcctcgatatgaaacgacttagggcggccatgcaaccggtaacgcattgcacatccctaagcttgctgggggggcgcatccgctctatagctcgtatcttcttggggttggcctcgatgcctcgggcagagaccaagaacccgagaagcttgcccgcaggtacaccaaacacgcacttatcggggttcaattttatgcgggcggagcggaggctctcaaaagtttccgctaaatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaaaggcattgtcgtataacaataagttcctacgggggtaatgaacgcagttttttcctcatcctccctagccatgcgaatctgatggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccgggtggatgacctcacggatgaatccggcctccagaagtcgcgccacctcctcgcggatgaagacttgacgttccggggcctgccgccgcactttctgccggaccggccttgcgcccggccgcacggcgagacggtgctcaatcacctccctggggaccccgagcatatccgccggtctatatgcgaagacgtcagcgtttgcccgcaggaaggagacgagcgcgtcttcctatttgccatccaggagaccaccgatccgtgtggtcttggatgggccgtcgcccaaggcaacctccttgaccgggacctcgtcgcatgtagcgatccgctgcctcggggcggtgggggcagatgggccaggcctctcgtcaccaccctcgggcttggatgcagcagcgaggcggtcggcacgctgctccatgcaagcgagcgcgaccttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataatcggctgggacggtcggagcaccatccccggggccttgatggcatcaaaagccgcgggggaaaggatgttgagggccgctcctccatcgatgaggacacgtcccaacttcacgttgcagatggtgggggaaaccaccatcgcaacctgccctccccgggcaatgcacggtgggtggtcggtctggtcgaaagtgagagcaacctccgaccaccgcgcccgacgcgtcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcatcgccggaacggtccgacctcttcttcctcctcctgtcacgccgccctgtctgagcggcggatccgggggcggccgaagctgccactccggaactggaggagttccatgtccacgcttcctctttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcaaggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcatcagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctattacgccggcgctcgatgttgaggcgggcatccggctccccatgctgatcctcccgagtcgaaggtgtcgacgagggagtagcagccgaatgacgtgcagccgccgccgctcgccgcgccctccgccttgacgacacggagccggtggtagcggcaccggaggtcttggtggtggcggaccgtccaccagcacccaggcgctgctgtgccgtcatgaccaagttggccacatcttccagccatcgttgggctggagactccgggtcatggacgacaggcggatgtcgtaggagcgcgccagcagcctgaagcgcaccctgaggcgtgctgccgtcgccgtagacgaggaggcggcgctccccatcttgccgtcctcctgcaccacctgcgactggtgatgccatggacttgtcgaccttctcaagcgcctccccctgcttagggcttgggcgcggaggagatgggggagtacgagctcgacggcgtggattcagctccccgtcgtcgccgctcacactcggagagaggtcgtgcgcctttgctcgctcggccattaggctgaacaagggaaacttggcgcccacggaagagtctgagagctcagaaaacacacgctgagccccctacctggcgcgccagatgacggagctcgtggctcctcacc

SEQ ID NO: 64855 - DNA, 1380 bp, Oryza sativa
ttctattactcacgttttatttccatttcagaaattaaacaaaaagctcaagatttatcgtacaattagatgaattaaaacggtttttcagatctctagcataacacctgttgctaggataagatagataggaaatattttgacattcataagttggagtacttacttgttttttttttggataatgggaatggcttctacaccaacgggggtgtatatatatacaaccattggagtacttagttgttgggctctcatatgtttagccattatcggctaaccgatttactaattatcttggtatccacatcacttgcaacgagtttcacgaaatatttgcttgaatttgacttagcaacggtggtaggctccaatgatatggctcctgttcaaagtttctcctcttagttgtatccacaatatattgttgacgtacaaagttaaaggtaactatttacacgtacgcaacattaattaatcatggaaaaaaaagaggaaatatgcattgtattggaattaagtagatgttctgagtgtctaaatacacatataatgcccataattatatttttttatctattgaaccttttaaatttttattttttaaaataaactatataccaaaacttccaaaactaatcttttggccacaacagctaggctagaataacaaaacaacatgcctaattttgtttcatcatgccgacttgactgacgtgacaagggttttgtgacttttgtcataattaaggcgtggcaaaacaccgggggcgtaccatattgttgtttcaccgcttgacaatcaaaagcaaaagcaaatagcttgattctgaaagcagattcgtagaaacgaggcatggtttctaataaaaaccaaaagttagcaatgaagctgcttttgtggggtgatgatgttgatctaaaactatcactagaagtattatataaattgcacatttcgcatgtttcaaaatctgaattcacaatcagattttaagaatccaactcctgaaaaatcacaatccagagacaagattgtgacaataaaaaacaaaaataaacggaataatgtaagtaatgggtttgcaagatgatgtgttcggttatgtgcgtaaattaattatggaacggtcgttcagtgcatgcatctcccacagccaaaaattaaattttaaaacatggtattagagttcattttaaagttttttcatcttagttcattttcagtattgacttttaaattactaagaaacacatatgtaaaaggtgtactcataaattatttttagttacttttcttttacggtttatctccatacagtaaacgatgagaagcttagctgcttgccttttcagaggccaaaacgactaattaaactg

SEQ ID NO: 64856 - DNA, 686 bp, Oryza sativa
tatgatggatagaatccttataaaattgatatgtgattgtagaattaaatagtgtggttttgtgaaacttaatcatgatacgtgaagttctatgccatatgccaaaatctatgaagttttgtgtaatttggaccataatacgtgtggtttgtaaaatttactctaaactaccattttgaaatgattattgggtgaatttcagttgaattgttgaactaaaatttctttgttttgcttaggttggggagagtggggtgcagttgtcaggtgggcagaagcagaggatcgcgatcgcgcgggcgatcgtgaagcaggcgaggatactgctgctggacgaggcgagcagcgcgctggacctggagtccgagcggcacgtgcaggaggccctgaggagggcctcgcggcgcgccacggcgatcaccgtggcgcaccgcctctccaccgtgcgcgacgccgaccgcatcgccgtcgtcagcgccggcagggtcgtcgagttcggcggccatgacgccctcctcgccggccacggcgaaggcctctacggtgccatggtgaagtcggagactgaggcacaagcgttcaagtaaaaaaaaaaaaaaggttatctcgttgctgggggatttgcaattataacactgcaaatattaatctttgttataatgatactagacccatatttcatagat

SEQ ID NO: 64857 - DNA, 1580 bp, Oryza sativa
actataattctgttccacgacgtactccctcactctatccattaatataagcatatgtttggtaattctcagcacacgttactgtgtcaccataccgtttgaaaaccgttggccgctgataaaatttggtcaagttctgttataactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagtaaagagtagttccgtccaaaaaatacagggactagtgaagttttttttttacaagaagtacgagagtggtaaaattaaaaggggatatttattcttttacctgataaatgacctatgtttaatattgttgagagaataataagaaagtaggtagagaaattgaggtaagaaaatatacggagaagttctatatttacaccatattagtagcggtgttatggtatactcacctacccgataagagggagaccaccatctatcttatggaccatcactgttaacctaaattctactgcagtgagaatctatttgctttatgtgtattttttagtgtttatcctactatcatcattaatcagagggtgacaatttagttttcatcagtttacctaatataattagaatccgctatgatgtataggtattttgttagttgtatgataaattttgaatgcaaccaggagtactccctccatcacattttaaatatagctgtaagtttctagattcaatatttaatcgttcatcttatttaaaacttttttatggttgtatttttattataaataatattttatacatgacttatatttttattttttttcgaaagaaaatcaaataaaacgaatggtgaaacgttgaatacgaaaacccatgttgacagcagcggatccacctcccgggcaagtcgggcagccgcgcgggctccgctattaccgtcaccactattgatagctattgacacccataaaaattaatcgatcaccgaaaaatactatgggcttaatgatgatgctggctccaccactgtacgttgaatacgaaacccacaactactcttgaaatgagacggagggagggtttttttttttttgggaacagtactccttttcaag

SEQ ID NO: 64858 - DNA, 2488 bp, Oryza sativa
gctcatccaactagaactgaacgagaactgaactttttagaccggttcgagaacacaaaccagtcatcaattatggcaaaattgcatgaccattctaattatcatcttagttttgagatttcaccttataacctattttattgcaagaactcacccacccaacgttatccagtcgaaattgtttcctttgcgcatatgagaagttaatttgtcggcccactttaacgctcggtcgctccgccttcgggggcgacgcgggcagcgaaacaggccgcgccgctcccgaccccctcctcccctcccccacctcgccgctgcccgagccaccgccggcaaagccaggcggctgcaaggacggcggcggcggggctctcttccctcgctcgcagtcaagctggttagggcgccggcaagacggagctcagggcaaggcgccggcgccgaggagaaaccgacggcggcgtccagatccggcgctgggatgcatggatccgaccccccccccccatggctggatttgttgctccgggcggcggactgccggggacggcgagtgggcggcgcggaggtggcagtgtcggtggctggagtggcggcgtggcggaggaggcagcggcatggccatgtctgcagtggcaggcggtggccgtggccagatctgatcggtcggctggcgctggaggtggctgcggtggcggcggcggctgcggtgccggcggcgtctgcggtggctggtgacgacggcgacagctgaggcagctgctacggcggttggcgacggcgacgactgcgctggctggtggcgacggtgacggctgaggcagctgctgcggtggttggcgaagacagcgacggtcgaggcagccgcggcagggaccatgcggcagcggctcaagcagccgcacctgtcgtggcggctgcacgcggtgtcggcctgctgcggcgggagaccggatcccctccgttgaactgctgtggcggttggcgacgaggcggcggcttgcggcgacaacggctggctacggacagttggagacggcggctggctcgtagctgccgcggctgtggaggcagcgtctggcggccggggacattggcggatgcgacaacgtctggcggcgtcgtatagatgatcgacggcggcagcaagtggaggcgtgacggtgggaggcatggcggtcttcgacggctagccaggggcgtggaagacgagcgcacctggacggcgcagcagcgatcggaggagggtcgggggtcagcttggcacagagagtcgcagccgatgacaggagaccggattggcgcgagaggcgcgtccggtggaggaggccggcacggcgcgagaggcgctgccgacggcgacggaggacggcttggcgcgagaggcgcggccgatggagggaggccggattggcgcgagaggtgcatccggtggaggaggccggcttggcgcgagaggcgtagccgacggtgggggaggtgacctcggtgtgaggaggagctgccggtgggtgtggtgcggtcttcgacgcaccaaggctgaccggcgagggacgccggtgcaggggtcccacatgtcggcagagcttgagtgatggtggagcatcggtgcgtcagccgtggattcgcaggtggtgagcggcaggtgaaaacccagctcggctgtagctgaaccgacaatgatggttcattccccctcctgagggcgttgtcgtgctgtctcacccctcaagggcggttgtctggcaaaagcccagtcttgacttctttgagccctgacggatggcggcggcggttcttccgtcgcttctcttcctgaagacatcattttggcatcctctagggggcgatctcgtctatgttcctttgttggtctagcggcggtcggtcacgcttagcggcggccggttcggtgctagccttctcccgggtgtgtgtgtgtgttggcgctgtcggtgtgtgggcggtggtattttttttctttttgctggttatgatcctccagggttgtaatcttgtaattttttcctgctctatcaatagaacttcgcaccgtctcgtgcgagtcgttcaaaaaagaagttaatttgtcccatttcttttgacgtagattcgcagcgggtcatatcacctaggttaggcccgtccagtgtgcctataaggtgagcccgactcgagagagctcttaggctattttttttgactcgatattaggtgaaggacttgcttgctatgagttgtaagcaacatcattcttaggtgatgacaagttctagttggactcatcacataaccacgctggacaagcttgacctgcctgatatggccctcgtggatcgacattagaagaaactagtaatcgcaatgcacgtttcccacattagctatagtgataatataaaacacttaaatttttttgcacttttcatgtaatatatgtcacacaaaatatacaaacatactaaaagttattatagtaacttaacat

SEQ ID NO: 64859 - DNA, 889 bp, Oryza sativa
tccctgacgaacacaccttccatccatgggaagtacttgggattttggaacaggcgaacgctggcagcagtctgaccttggggcaacgggttgtacagcagataactgtgcagaatctcatgtaatcgtggctatgtgacgggctgtgatcgccagagtttttatcacgcttattgtattgtttccgcaaccgctagcagtagatgcggcagccagttgtctggccggctacccaacgcttcaagccgaagacggtggcctgaacctccctcggggaccgatggcagccggaagatggcaggaaatacgacgacgagacgcatctcgtgcccgcgatcaattggatgccggaacgcgtgttcgcgaccacagctgggtctctccaagtccacgggaaccatggggggctagcttatagctctcgagtcacgagtccagactcgatcatccacaaccgagtatggaatagtaggtagcagagctgtccagaaaaacgggagcacatgaacgtcgacgcctcctgtttgggcctcacaagtcgcgtcacgttcgttgggctctcaggtttttggtaagacgggacaaacgttccgcgagacacacagctaggtacacacgtactacgtacgtagcgtcgtcacacgcagcacggctcctatttatgtacgtaccagccgcacggccgtacaatacggatcacaggatgtttgcctcgtactaatgtactccgtactgttcttcggaggtgctaccgttcataaggaaaaaaaatggagaaaaaattatgcaacttgcggtagaacccagtcagtgtctcatactttccctcgcgaagagggaaatgagaaccgtactcatttgcgaattgcgatgcggattcaactagctg

SEQ ID NO: 64860 - DNA, 661 bp, Oryza sativa
ttagttctccaattttttttccctaaaacataacatcgaatctttgaacacatgcatggagcattaaatataaattacaaaaactaattgcacagttaggggggaaatcacgagacgaatcttttgagcctaattagtccataattagccatatgtgctacagtaatccacatgtgctaatgacagattaattaggctcaaaagatttgtctcgcggtttccaaacgagttatgaaattattttttcattcgtatccgaaaaccccttcgacatccggtgaaatatctgatatgacatataaaaaatttcttttcacgaaaccgcgttatgaaattagttttttcattcgtatctgaaaacctctttcgacatccggtaaaatatctgatgtgacatataaaaattttcttttcacgaactaaacaggcccttatatgctacacatcactaagttttggaaaacagtttgttggctaccattattttgttggagtcttgaatgcaagttaggaggcacctttggttgggccccagtccttggaagtgaatgggcagggcagggtcgaagttatgacgagctggtaggatgctttcggttatggccaggccagccggtgactcgatcagtcgatcgctctcacttgctcgtgtcatcaaata

SEQ ID NO: 64861 - DNA, 1212 bp, Oryza sativa
ctgaatttcagtgaagttttggagttgagtggacactgacagcatgaatctcagcataatatcagatattcacctgaatttctggcagcattgcatccccaaatgagaatgctattgtgcccagtgcattgaaggctctgaagatctttgatgcagcgcttccttgcagactgtaatcaacttccttccgatcaatccgatgccctgcattaggaaattcattctgttcattcttccacatcttcaatttccagaaatcttcagtctgaaaagtgaagatatgaccagattttaccatcataaatggtgacaccaatggctgtccctgcaaatccaatggtgctagcggtgcaggcagcattgacccaccggagtgagtggatgtcaggaagctgggagagtaacagctcgaatgcgccgaagagaatgatgaactgttgcagggtcatggcgccatcatcagtggtgtggtagtgcttgtacacagccttgaggctgctcccagctgcaatctggattgcaatgttgtttccaattgatgccacttgctggaagaacgacacataccagtaaccccagggaccttcagacaaaagcacagatttttaccatcacttgaggtaaatttgcaacaatttctgcactgctaagtatattactgttacaagtagatcatcaaaagtaaatatttatggtgaagaatctgtaatcccatttactatcgtttggcaactcttttcctgctaggctgctactcagaaatcttcttgtgacacagtacagtaagatcaaaagtacaattttgtcgtgacaaaaaaaatggtgatgagtactaaccaaagatgctctttgcaagaagcttgtagctggtgtgcttgtctccattccactgccacagtgaggcaacaaccaggctagaacaccatgtaactagtgttcctgtgaccaagctacaaacacctgtgctcaaacaacagttagctaattacaaattactcaaatcaaacagaagaaaaaatcatgcatgcatatgaactgagaaactttctgttcatggcatttcaggcaacagagcaggagaagctcaaatatcagagaatccatggagaggatgaaacaggatgagtaaagaagcaccaaccaagaggccagccaagggaggcaagagcaaacgggaggggagcataggccgccggcgtggcgatcgtcgtc

SEQ ID NO: 64862 - DNA, 7869 bp, Oryza sativa
gggcgcacgaacggcagctgcgagaacgactagatgcccgcggccgccggcacgtctccgacgtgtttcgcgtcgtgctcgctcatcgccggccagccggccaccgcctagctcgccggcaaggtagctagggcaagctagctagatagctactgaactacaggagattagctcgctagctaggtaggttcaaggtgatctgatggccatgtgtgttggcaatggtggtggtggctctagctaagaacaaatgggttgggttaagttcggagtgggggagtggaacgaacgggaccagtttggggatggtagggttgacaacgagtgtgtttaatgcagtgtgtgcaatttctcttggctcttataatcttgatgcgttttaagctttgcattttgtgctctatatgtgtttggtgcatctgtcatggtacgatcaggaaacaatgttaagttttgttgggtgcaggtctctctcttgaatgttggcaaatagatggttgtgttatggagaacgggaacaaaaggtcaaaaaaaaaaaaacaatgaaaacgcggttgtagtcacattcgcatggtcggggtcaaactaaaacttttatcgagatcaaaactattatcgtaaccacttgaaccgcatgcaaaataagaattgtgatatagcgtatttgctattgggacaacacatgacatcaactgtacacaatcaacaccgtccacttttcaactcagtagtgtaaatcggccgctaccttgttatgtatgccttttcctattggaaccaagtacaataattttgttacaacgccaagaaaaatctcggtgttccattttaaatcttgtaatggtagtgagacaactagtacttaatttgttagcacactagccgccacacaataattggattcgtaataggacacatacatactccttgggatttcaacatataaatatgtaacatgttgctaaccccgggttttggattctttataatttgctattcttatggagaatgtaattttcgctctcatgacatataagatcatctgagtcatcactaaatataggttagaatggtaaattatatgccgctcatatgttaaggatatataacatattatcaaatgtcccgtgggtttctgatcctaacacaaaaggtgcaaacccgctacataatatcataatgtgcacattgctcatgtcctgaagacacgaaagccaattcaactatgttttcaaaagaaatgcaattagtattatattcttctgatggtgatgtttggaaaacttcaacacaaaatttggattttgacacaacgaaaagctacttgtttggacttatgaattagtggtgggacaaaataagaaattaagaaaagaatagggacttgatttccacatatcagtgctgatggacaataatcttgagttcttaattttgattgaacataacgagaatgaaggctaggatttggccgataaccagggaagctagagcctagctcatgtgaactaacttaagattttggtccaaaacctattgtattctcaatccagtggactcactgagagaaaactgaagaactatgtgcaaattaagtgaaaaccgaatccatattctgcagttttgtgatgcgtacggatcaattacatcaaaagagaaccaactcaactacactagctaccagtgctgttcaactagatgttgttagttcttcaactgaaaacgaactagcatgccggcatgttattgttagtggttgtggcacaagacatgcatgccgggcatgttagtagttgtggcacaagagagatctaaagccaagataaatgtggctatctatctatcagggcagcatatatgggatccgtaccatttaaattaaaacctcttggtatatgcgattatcaggctattaaataccgttcgcgaactgttgcatcacacagccggacgatcgtacgtctagctagcagtgcaggcattagctactctcaccagccggccgcgaaggcaacagcctgattgacgacgacgatggatcgaacgcgaaaagcacactttcccatttaaatggcgacctgctttaaattccatcacgaaaaatggccacagaccacaaaaagaactgaagcttttcgcagttttgccgctgttattttcgtggcataaatagatagacaacgtagttaaaggtagctacattttattttacctttattttgtgatggagaagaacgaggtagttcttgaaatggcatacatgtagcggaaaccatcctaaactctcgaggagacattccctcgttgttcacgaaatagttatgacaaactgtttgatggtattttggcgattatatgtgtacacaagacttactcatgatggacaaagcaaacaagcagtttgtaagttggctagcttatcatttctacgcaatgcccggccatgtatatacacgcaaatacatgcatgcacaggcagctgggaatatatatacttggattagtatatatgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatttagttagttacttcgcgcgagcgctggtgaggcgcttatcaccagaccgtggcccagcagcagagaaacaaagcaaattacaaatcagatatttgacgccaggagaagctaagagataaaatcaaataaggatatgaacaaataacaaactgatcgatcaagccttatctgcaacgaacttgacgcggaggaaacggcgcgcggacgcggcgagcaccgaccccagacccctatataaggcgtcgacccctcggcagccaggggcattcacgaactcatccacacattcattcaccaatgcatctagcatccacaagccacctatcatcaatgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgcgcacggtgatccgatcatcagcaagcgcaggagaggagcttgatggctagtccaggtaaaagctagcaagattgttttgttttctttcatatacagcacgcacacatccatgcatagggatccatctgcacgtatcgtcgtcgccggggaagtcgcggtggccgattcatctacgcatcacagaagcctcatcgatgccggtgtctgttcaagccgacgtagtgctacttgtccctggactcgacgctgctaattcaagccgttggtgatgcatctacccgaagctgcgacctcgccgagataccagacatccttgatttgcaagcttcaccgcactagagcgggctaaccatggaggaggtcatcgggaagccgccctgccggagcgcgccgaggatcaccggagctgccgccgactgccaagacttctatcagttctcatgccggaggtcaagcatcacgcatggcgtcgaaaccagcggatgacgatggaggcaagtatggctgcagtacagaggaaggacgacgggaggatggcgagccagtgctgttggatggcaacaagctagctaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccgccgtctacatcaaccatcttcaataactcctccctaattcttctctaatataatctcgacgcaactgttgtgacgtcaagtcgttcaagctatgcaactccatgcatgtcttcaccaacaatctacatcgacacgttattcaagaccgacgaggctagacgacggagggtgggcgaccaacacaggcgcacggaccgacgaggccatggatcgctgtcggcgctcacacacacacacacacacacacacacacacacacatctatatcatcatcacaaccatgcatgaagaacgcgaagcgaagacgacgagacgaccacaagcagcttaatcggaggttctcttgcaggcctagacctgcggaggtaattaactgggagcttctcgaggccccaggaaccaggagaccacatcgcacaagtcagatctgtccaatgacagattatggagcgcgcatacatatatattacattgggaatttgtatttatgatcttttaagattaataaagagcatgttccctatgttttgtttacattgtgtatttaggtacactggcacgcccgcacatatatgtatctctaaacaaacgagatcttagatgttattttccaccctaaacaaattggcacgcccagtgggacctggttctcctcccatcttcgctatgctgtggtcgtcaagctcgtcttcgctgttcatccaaccaacaccaacatgctgcatgatgatcttcaacgtggagtgtacctgaccaaggctccttcttgcagggggactttccatcatcgagaacaccctgacgccctttgtgattcagtttggatcactaccaccggtgacattcttcgagtatggctccaaggtctacatgcaacaagctcaagatgtgacccaattccaggaggcccagtctaagaagcaatgcaagcgtgcttctgccaagacgaagaaggagcggcgaaccctcatgcttgaagcccggaccctcttgaaggagtccgttgtagctgagattaagggagacatccaagctgcacagaagctgcgtgtcaaagcttccaataggcgctcaagtactgcatccctgcgtgcccctgatccagccgctactccaaagcggcctaccccaactgtgcaacacacagaggtggagctgcttgaggctctagaagctgtctccgacaatcttcgtcgacacatttcgcatgctcgacgggcaaacagtcctcatcccctgcgcaactataggaggaagtatcgcaaggtgcagcgtctacaccaactcgttagctcgcgcatcgcccagagctccgtcccagaggaagactggtctcttgacacatctgtcctcatcaagaaggtgttcaagttcccaagcattctagagccaccttacgacttgttccctgacgaatgggcatgtgagccaactaagatcaaggagaaagtcagacgagccatcatgaaggagtattggaagcggcgtgatagggagcacctcgtccttccaggctcaactatctccttcgactacaacacgtacacccctcgccagcagagcacgtgggagtcatgcctccacctatttgcggtaggagggtcgtctgactacaacaacaacaggttcgctgtcctgcggtctgaggcacccgctcctcgaggcgaagacttacgacaagaacttcgtaagctgcaagaccgaatggcccaacttggaagacgactctaggatcatgaagcaccacaatcatcatcaacacaagctgggggcagatcaagacgataccagccaagttatcgtcctcaacatgatcgccgcacgctggctcctcgacgtacgcttccatcaactcaagtgatgcaccagagacaaacagcgttgcctccacgctggaaccggtggtcaagacgccaagattatcccacatcttcacatcccgctcaagaatggtgagttcgagaagctccatcttctcaagtgccgcctcatgttccatcttctccaagacgagaggtctatacacaaaggcaacatgaaaccaacgcacctaccccagctacacggcaggtggcaccacttcttctcccgacgccgtcaattccgccaagacgtcagcatgcacctactgagaatcaacgcaagcgagagcgacgtcgtaacaaccgctacgctctctacagagagcttgaagacctagtgctaaaacacactcaagttcgtgttcgtctagatggagaagtgcatcaagaagatgaaaggatcgtgttccgtatctcccccagtttggagagggatgcgaggtataactaccttatagctcgtctaactccaaaaccccggagaacacaagacgttgctgacaagaatagggagcagacgttaactcaatctcgccacgtaaccatcctgcagcgagggaaggggcaagttcaagctaccttgggcacgtcgccatcaacattagtaagacagtccaagaagaaccaatctactccgatggagggagtcgagcagacaccagtagagcaagtcgacaaggcgtctcgacaagaagaagctatcattaaccctatggttgatgttctaccttagcaggaatcatcctctatgcctccagccagagttgaacaggtggcgggaagcaagaacatagaagatccaaaggaaagcattgtcatgtgcagcgcactagccgcacaccacgaaaccaagcccaatgccgcatgggttcccccgccgattactcacgacttcacctacccttctgatgaagagatcgtgccaaatccaagggcaaatttttccaagacgttcctcccttagttggatcaagtccacccacgattcagctcggagggttcaagacgaagcacatcttgctctcaagaagcaactagagcttcggccccttgtcttcctatcggtacaggagaaggatcgttatttgataggggcaaagcactccagtcagatgtctcccctcgtcgctacatcgacattacgacacgcctaccccatgaccaaagcgagctactttaggttgcaagtcgacctggtgctaacactcgcatgaaggctatcgctatcaagaatgttgagacaactccttctcaagcaagaaaagacctggaagaacatgttgaagttgaagatcttgatgagttagagtctacctcatcgtcatcgctggaagtgaatctcgatctccctcgctataatgaactcaacccatccctgccttcagacggagagggttatcctaataactttgatagtgcacctgcccatgtgacagcagaaatcgatcgtaggcaacatgctagacaacacgctccacgtggtgagaatccgtccattgggaacatagcaagtacatcaagataacctctaagtttagaggaacaagtccaagaacaaagacaagtggtagaccaattagcagcaaagcttgatcgcttcattgatatcatgacgggtcctgatccgaaccagaaccaaaaccatgatgctctggtcatcgaggatccacagattgaagaagtggaagccatagcacatcacccaacgcaaacccatgatgttcagcgacggtcgacgtcaagcgttcgccctcaattccttaacattcctattgcctctgctccacttcccaccacattgaaagactatcatgacatggttgaagacctggtgaacaagcggctgaagcaaatctccatcgagcaaacaccccgaccaatggagagtgagcttgagaagctatatgaagcttggcacgatttagtacctttcccggcagggtggcacccacccaagttccgtcaattcgatggaaccggagatgca

SEQ ID NO: 64863 - DNA, 12287 bp, Oryza sativa
tctctgcctgcagctgtgcagcctgcctggttgcatgcatgcatccggcccctgactatattattacgtccgcatacttggcatgctgcgctggctgcgctgagctgagctgagccattcggccggcatgatgcagcagcagcagaaggcagagcaggagagaagcccatctagcagcagacgtggggatggatggatggatggatggatggacgcagctggcagctgtgtggctagcttgatctgatcacggagcctggccgtgcagcgcagtgcagtgtgcgtgcccgggcggctgctgctgcgagtgactgagctgagctagccagctaattccgccgggacggacggagacggcgcgggaccatgcggcgtgcgtgcgtacgcgttggaccgcgtggtgtgcgcgcgtgctgcgtccgtcgatggatgcaaaccatggctgactccaccgccggtatcgttggttagttgcagttcagcagctgggcgctttttacatggcacacatgcgcacgcgtgccctgcgacgacgctacacgggccgtgtaacacggcacccacgcacgcacgcacgcagcaggccagggcacggcctcgtcgggcccgggcgtcagctagcggttgggtgggctgaaatccagcgcgtccacgcatatggatttcatatgggcttcggtgttagcgggttggttttccccccggaggccgtgaagtgtgttgactgacttgaacttgagaggggaaaatgtacaccgaaggtccctcaacttgtcattgggataaaaaacgtcctcaaaccgcaaaaccatatacgcgaggccccttaactatacaaaaccgatcacccgatgtccttaggtggtttcgaccccggttttgtcctacgtgactgctgagtcagtgcgggactcacgtgggccccacctgtcagcctgtccaggtcagccactctctcttctctcccatttctctctctctctctctcacttctctcctcttgggcaagccagggcaggtggggaggaggtcgccggggcgcagcggcgggagcacaaggcgacgcggcggcgggctgaggcggctcgtcggcggcggcagaggaggaggaggcaacaatggggaagacgaaggggaagcagcgacaggataagttctaccacctcgccaagaagcagagctaccagagtcgcgcggccttcaagctgctccagctcgacgcgtggttccgcttcctgccgacggcgcgcacggtgctcgacctctgcgcggcgcccgggggatgggtccaggtggccgtcaaccacgtgcctgtgggggccttcgtcgtcggcgtcgacctcgtccccatccgcggcgcgcactctctgacggaggacatcaccaccaccaagtgtcgcgccgcagtgcggaggctcatggactccaacggcgtcgtcgtgttcgacgtcgtgctccacgacgggtcacccaacgttggtggcgcgtgggtgcaggaggccaccgtgcaatcgtcgctcatccacaacagcctaccgccgtgtcgcctcgtgctcccgccgtcgcatcggtgcagcccacctccgcagcgctagggggctgccacctccacgtcgctagcctctgccaccaccacgtactgttcgccgcgcgctcgccaagcctgccgccaccgccgctcccatccgctagagggagagatgaacagagaaagagaaaggggaaagagatagggtgaggtggacacccgacatgtggggcctatgtggctcccatgctgactcagccgccacgtagaccaaaaccgggtcaaaaccaccgaaggacctcgggtgaccggttttgtatagtcaagggacctcgtatgtctggtattgtagttcgaggatgttttttatcccgatgacaagttaagggaccttcggcgtactttttccaacttgagggcctctgttactacaagtggagcagttgatttggagtagttttgactgaatattactccctccatctacttttgatagtcatatttcatcttgacatacataccaagaataagtgattctacttatcatctatttaaatatgctactagtcatttctcgtaaacaagcgattaattaatatttacatttctcaatgcccatgtagccaatcttgtataaaagaatggagagacgtgcattaaatctaagaaagtcattaagatgataagttgttggattgaaatatgcttatcaaaaataaattttttagatctagaaatataactatcaaaagtagatggagggagtagtaaataaaagtccttagttgaactgaaatttcaatccggatacatgtaaaaaaatcaaaaaatgtttaataggcctataattaccagattattgagcggattttttttttcagattatatacatgatataaacaaaccttaaaagtaactcgaaacaaatggtctaagcaaatataataataagaaaaattgagaaaaaatatttttattgtgtgaagcaaataatccattacaacggtacgatagataatctgaaaataaccggatcactggtttctcctgtgtgccctctgcatgcagagtcaaattgaattgttctcgttgagtatttaaattaattaatttagttagtatccaggcgagccaattaagctaagctatcagcaaaaaattaattaaacgagacacacacatgatgagtccatgcatgacgcacaagctaccttagccgctgcgtactagctccctcctactaatcgtcaacatttctagaacaaaataaaccccggacgcaatcctgaattgacacgactcatgaagactcccagcctctcacgtgtgacgatcagagaatgatacataagggcataaggcgatgcgacacatctaggccaaccagctctggctaagcacaaagctgattcccggccgtttcaacgacgaagtttacaggctgaccgcgaaaatccgtctgaattcaccgaattgcagtggaaatttccacggcgggttcacgggaaggcggaagactactgtgcgtgttttaattctggattctggaagcccctgttctggatatattgtagcagtaccgtgtatccgtgtctccatgactcgattttacattggtacatgaattgatttggctagccgatcacttgatttgtgcgacatgtctcttttaggtttgagaaagtgaagcgtctattcaggtgcattcagttgtttgtatactattactatcggcaaaaaaaaaatacccctacatatcatatcagatatatatttaaagtattaaatttagtctaataataaaataaattacagattccgccaggaaactacaagacggatttattaagcataattaatccatcattagcaaatatttattgtagcaccacattgttaaattatggcgtaattaggcttaaaagattcgtctcgcaatttcctgacgaactatataattggtttttttatctaaatttaataatccattcatatatccaaatattcgatgtgatagcgtgaaaaattttgtttaggaattaaacaggccctaatactagtgtatgtgtcatgtatatgataggaagatgttctgactgctctgctattatagctttaagatgcaatagtctatcttagggcggtttacattgcacccaaaataaatcttaccaaattataacaatgccaaaattttggtaaggttgtaatattaccaaaatttttaccaaattatgacaatgccaaaattttggtaatattattttggtaagtttataatattatcaaaattttggcaggatttcttatgtatttatcaaagtttgacaataaatatagacactttttagcaactttgataaaaaatgatatggttgaaaatgacatcaatctgaatagcctcttattgaaaaggtagtcttgcaacgttgatatcacagggatactgttcttgttgggaatttttcaaacatttaccagtgtaaacgcctccataaagaggcatttctcgacgtttctatctcgatcagcaagaacaaagcaaaagcaaaaaaaaaaaaaaaagtcgattcgagaatagaccacggaaagaacgaacagttggggaaaaaagaaaccgtggtcttttgtatctcagcttttgcagagcctggacgcacaggagcgagctagctacgcagccgccctctgggagcagcaggtacaatatcatactattatctaacaataaatatagtttaatgagataaaagatacgagagaaaagcagcggcctacagcagcacagattccaagacgcagtatgtttatgacatgtgggatcatatactaatagtgtagtaagcaactattgtatgaattagctattagattggctataggtgaattggagttagtagtgggctatactattgaacttgctctgagattaattaacacccagtgatgacgagtgatgcttgctttatctaccggccgctgtcgctaagggcacccgcaatagttatctataggctctctataagatatccatgtcagcatattttactacttgaaagagattaaatgaagagagagagtaaagctatctactaacccgtagatagtctatagagaaaagcgaggcaatggatgagagagttatagatacccatgtagacatactattaatgtggtttactattaatctagtctattgctgagatgtatatgttttatagagaacatcttactttaccattgcgggtgctcttaagtgcgctgtcaccaacttcacctggccttttctagatcgagttgtacaggccaggccagtttcgatcgctgtatatgccccagtctcgtcgatttcctgtcactgtttccccgaccaaattaacgaccggtttagtcccttcttttattctttcccggcggcttgagaaaaccgtgaataatctagctagggtgcatgcatgcatgcgctaaattacctcgctgaggtgtggctatgcgtgagcctcttattgtcagttctagtacctccggtttagtcagagcaaagtaatctaaactgattgattagctgggagatgatgccacttaacatatattcctccatcgtgctgacttctgaccgatcggctgagttgcctgtcgttgcaagttaactagcattcttgcataacaaggaagtaaaattaactcgcgtttcatcttatcagctccatccttagctccatataagatgggcaaaattattcttgttctttttttctaaaatagtatattaattggcagattacgttccggaagctctggcaggggctgggcagtggcggccacaaggtcagcgctaagcttcgccacctcagcaccagtttatttggcgctgaccttgaaacaccttctccgcgagagcctaagtccacgatcttagcgccaaatcacctagcgcttaggccgagcatgtcagtgccagtacggtcattatcgaaccttgccacgcgtgccgatggttggagacgactgtcaaggcctcggcggtcggcgctaaggtgttcaatcttagcgccatcgggtgtggcactgagcacaggtccattttataagatagtttttagtaagaaactaatttgaaataagttttgaaaaaggacaaaaaaaaatgtgaaattttcgccgatatcgatggcccctcctagaaacatgtgtcaaatgtcaatatatccactgtacaacttccgttatatacccgtcaatccccgaccacaggcacacccgccagtttgcgggtcagaatatattcggaaatgtcccggcctggcggcgcggaacgaccagacaggtcacaggtcagaattgagaagccacggcgcgggccgcgggaccaaaggaacgtgatgtgatccggtgaactccgcgaaccgcgatgatgatggtgcacgatgatatgttgtgccatctcactcagcagctttcgtagccgccgcccgcccggctgcgcgcgcgtgcgtgcgtgcgcggttgctgcgacaccgcaggaggggaggaggaaagctaagcgatcgagagaaaaaccacgggcgcgggcgcagtgtggtgtggtgcggagcgcgcggtttgattgaatcgtccgtgctctctctcgccggagtacgtctaccgctgctcgatcgaccacctggctagcgttggatgtaggcggcaccggcaaaatcatccgtgcagccgtgctccgcaagacgggccggggtgggggtaagctgaggcttccaggagttcaagttgttcaaagtcgtaacgggaactaaagtggggaggcgaatatgcctttcctactgcctacactacacaagccatgcatgccacggtctctcgtcattttttttttctctctctaaggaaaagataaacactttgacaaaaccaaaaccgctgagtgtagccggagaaaatggaactgattccgaggaaacttctatagatcactgccttctaaacgaagccgtgtaaacttcaatctaattattcggacgacaatgacatccacaccgtttgctcttcagcttaattatcgcagccagtatttaaattttatatcctaattttaaaattgattttgatggtttttttattctatctattttatttttcgccaagaacacaatataaaaaatacacataaattattatctaatcgcgaatgagggttacggaatcagttgtagacaaaacgataggaccgaaaataatcttattaagagggtattatcctgatgtatacttgtagacgcatgaaacaaccatgaaaatgtccaattcagtcattcagaaaacaagcgaattagtacgagctaaccatgttcaacggcgagagaaaacatcaagtaaacaaaacaaaatgagaaacaaactacaccccgaaactgagctttcagcagcaacgtacacacacatcactgctgatgaatcaacccaacctcgtccgatcatttacattgtgtacaacacaatacggaaacttttcaaaccttccaaacctcagaaccctctagactctccccccctccaaaccttcttaaaacccctcattcccatcacctcagcacgtacgaacgagagtgatcgatcgctagctcgccgagatcaccagcctcctcgtcttcttcttcttcttcctctcgatctcgaggagggtgccatgggtaccatggttggccatgtcgcgccgggcgccggcttcatcctcatcggcatgtggcagctgttcaaccacatccggctgttcgcgctgcggccgagctcgtacgcggcgccggtgtggttcccggtgcgcggggtgcgccacctggagctcatactggtgatcgtcggcgcggctatctccatcctgatggagctcgtgatcgggccggcgaggcaccagccgttcgacgacgacgggaccatcccctccaaccacctccacaacttcgagcacgcgtccatctcgctcgcgctgctggtctacgccgcggtgactatccacatggacagggccagggcgcccatgcgcgacgccgtgtcgcagctggtcgccgccgcggcgttcgcgcagcagctgctcatcttccacctccactccgcggaccacatgggcgtggaggggcagttccactggctgctgcagacggtgatcgccgtcacgctcgccaccacggtgctcgggatcccctgccccaggagcttcgccgtcagcctcgtccggtcggcgagcctcgtgttccagggcgtctggttcgtcgtcatgggcgtcatgctctggaccccggcgctcatccccaagggctgcttcctcaacctcgaggaaggccacgacgtcgtccggtgccgcaccgatgaggcgctccaccgcgccaagtcgctcgtcaacctccagttcagctggtacctcaccgccaccgtggtgttcgtcgtcgtgttctacctccacctgacgaagctgtacccggaggagccgaggtacttgccgctggtcaagggcggcggcggcggcggcgacggtgacagcgacggcggcaggttcagcatcggagacgacgaggacgacctcgaggccgcgaaaggtggcttcggacacgtggcgggtggcgggaacgccgttgaaatcgagcggtaatttactccgcgattccgtgtcagaggaagaaacaaatgtcaggatggctatgtgattagattgaaaaacgagggcctatgtgtaaataatagtatttctttttaaaaaatatttttagtagtactatagggaattagtgatttgtgtgtgagtgaacaagctgatcgacccataaatttgggtaaatctcatgcttggatcgcttcaatttgtttagtcaagagtgtctgatatcacaagggttaaattgatccatggatgtcgcatttggttggttatgtctgtactctagccatatgagtggagattttgcacacaacggaaaaccttttcatcctctgaatctcttctgttccgtgcaaagacgatgaaccaatatgccttcagagttcagagacgtgccaagccaatcaagactgcatttcaggtcattttctgaatgggaccgcgactgctgtgttgcagtcaattcagatagcttgaccagcttgccttcttccaaacatttttgtaaaaaaagatggattggttcgaaatacttaattaattatcaggtgattacgggagatcgatcgcctgctaagcgtaagcaaatgaatggaccaagccaacagcaggattggcatgtactaaacagggcgtatcatctgctaatgtcagccatatcttagggggggggggggggggggcgaagatgtcagacaattctgataatctgcagaggagaagaacatacttgtctctcgttttgatgttgacggtaattaaatttggtacgacaggacggcagcaaaaggcttgcacgttggtttttgctgggatctagtagagctgttgtgctcaaagaagtttctgcgtgtctttgtttcaactcatatgatggattatggctagtagctcattcactttcaggaaattctcatggaaatgaaacccgatttcaagcattaccctttctaaacatttaaagccctgtttttcgccaggccggtgggaggacgctagccaaatttattatgattcgaaggagaacgttcactaaaaaaaaattcagccagcaaggatttgtttctgcatgcgggcagtatgaaaatccgtttgtataaatgacgagaggttttgtggtctaaaatcacatgttaaaataaccatattttcacgggacaaccgcttctaaaaatcaatttttacatataattgtgaaattgcatgtaaaaattaacaattttcacgtaccttttgatagaggtggttgcccaaaacatatttataaatcgatgttaggtagcctcatgttaaaaccgcttcgtagtagtgattgcagtaacgaacaacaaggttgttgagctgaggagtgtggatgtaccctcatttccttttcttttttttacaaggagacgtaccctcatttcaaatattctactatgtccttttcgaatcatttggttttacaatttatgcaagtgaatataatggtgaaatccatcttcttagcctcaaaacgcaaatcgagaacggggcacaacgcccttgcccacaacaattggattagggacatcgatctgctgcgcatcactggagcggaccacccgcgccaatacatccatctttggacgttgatccatctggtcagcccgctttccgatcagagggactccaacatttggaaactgatggctaatggattctactttactagttcggcgtacagactataattcgttggtgcggctagaacaatctacaactagaccatttggaaatgttgggctccacctaaatgcaaaatcttctcctagatcatcattcaaaacagagtttggacgacggatagactacaaaagtgagggtgggccaatcaacgcctctgtccactatgttgtgccgtgccggagtcggcgctacttctacttgcaggacagggatagatctccagctgcaagagtggggggattgtgaaacgatcgaagtctggtggtacaaaatatggcgcacggcgaatcgctcaagaaaagccctaaaatcaattatcatcctgattgcctgggaaccatggggtgagtgaaatgctagaattttcagacaagtagcttccacgcccgccaccatcatcaccaagatcaaggaggaggcgcgaacttagatcacagcgggagcggaaaaactaactgagattataccggcgggagagtagacatttttgtttgcaatgggcacaatgttctcgggccctgtaaataactttttttactccttctctattaatatagaggtggcaaagcttttgtccttccttaagaaaaatacgggtgaaatttgtactgtactatctccattcaatgattcaatcataatagatttgggccgacgatcagcctggcgaacaaatctactggtgaaatttaatcgtgacggtcaatgaccataagagaattggaaatgtaggtacgtgtacatttcagttagatttctctcatatttggaactcataattaaaaaaaaaacaattctagggatgaatcaaattgagttcattcactcgttccaaaacaggcccatatcacacgttatgggctcccaatttcttcagttgcccaactgtactccatacagacttcaatgtgatcgtgcttacagacttcaatgtgatcgtgcttacgagaaatgccaggtacagtccgccgacgagtcaattgacagcaaccaattgaagcgtgcacgtttcagcgatcaaatcaaaggagagaacgttgcgattgtccatgtccatgccgttcgtacgttaatcgttataggcgattgtgccccaattctgggacaggaattaattttgatcagtctgaattttggcggggtgccatcatcagtccacaccatctgcaggcactgtagtgtagtctgtagctcatttagtcaagtctatactgcattgtaatacagtatggtgcagcactgcaacatatgttgatctggaggcagacgctacatttaagatatttgtcacatgccttgcttggctgcactttgcactgcaaacgaatcgcagtggcagtgtctgatatttgtacagttcattcaaggagagattaaaattgttctggcccaggttcacgaataaaatagggatagacgaggaaatattctttcctccgcctattttggaggtgaggtgaagttaaaatctgttaatgatgggctcttaccgtcaagcgtcactgtatcagtaaaaatgttgcaggatcaatatatttagatgacttcaggggtcactaacgccagcttatagaagtagttggagtgatcccgacatctataagaatactcttaccgggtaccgtagctatatcaagtttcttctttatcgttcgtgtaccactcgtttttctaatgcaagctcaaacactacttgtccaatcacatatttcgtctaggacatctcgatcgatttcccctcagtaacatgctggaaaacccgagaagtattgatctttagtgaaaacatgattgttgaaagctcgaagctgtgtcgtggctgaatagaagatgcggcgcctgatccctgctataatagaagtcctgaaatagagggttgatcgatctggcgaagtaattcgaggggacaaaatgaattacaatgatacatatacagccacatatacacatgttgttacttttgtataattaaatgccattttaggggtgattgactttgtgccggagtctcggtgcctgtttggataactacatcggatgttacggcactaattagaagtattaaacacatattaataacaaaactcattccataactctagactaattcgtgagactaatctattaagtctaatcaatccatgattagctcatgtgatcttacaataaatatgtgctaattatgtattaattaggcttagaaaatttgtcaaacgaattagcactcatttatgcaagtagttttgtaagtggtctatatttaatactttaaattagtattcaaatatccaatgtgataagtactaaagttagtccgtggatccaaatactccctcatagtccaatcagtataagctagtataaaggagttaaagagatggatcaaggaagcccactgaaacgagc

SEQ ID NO: 64864 - DNA, 16914 bp, Oryza sativa
ctggttattaacataatataatacaaggaatttatctacagttctggtaggaattgcagctcattcctgcgtttcaaactgtagactgtcaaagttaagcaaaagtaaattctgccatgacgcgattagttttttttaaaggaatcaacataaagcacaatataaaaccatcttaacaggaagcaggaagttgaaacttgaaagcacgaacctgtaagagaaatcaggatccatgagaataatcaagatgtccgtttccacgcaatcaccactattttattcagattattgtcaacatgttcatataccaggcatcggtctctgctgtccgtcaatcgggttacacggtattatcccgaaaattctaattccctttcgtgtaatagtcccctttctacgacgtactagtagtgatcactgatcaggatttggttgttcccctaatgatcagcagcttacaccctttattcagacatcaacgctagtttaatagcactactacttctgttgtcctctaaaagcatctttcccctcttgaacgtgagcttcatttcagatcgtgcgaagaattagcgcactgtattatgagcaccaacactgggtactttccagctcgctacttaaaatctcatcccctactagtaagtgtgatttttcggcattatcgacgtgtcagctagcctcaaaacggccatcgcgtcaacaggtgcactgaccttctctgctacgtgtgcgtcgatctcatcgtgtattccgctacgagcttggagaagagagacgacttgtcctccagtagcctggtcggcgtgtcgcgctccacggccacacctgcaaaagcattggcacggtgtttcggtcgtcagacagacgcgacaaacccatacaatatgtaagataaattgggattggttagttggaactgtggttattgtcgttataaaatcggagattgattagtggcatctgtgattggtttgggacttggaaggcgaactaaactcaccgttgtcaaggagcaagaccatgtcgctgtcaaggacggaggtgatccggtgcgcgattgtgatgaccgtcgcgtcggaaaactgctgcctgagagttttctggatgaggttgtccgtggcggtgtcgacggaggccgtggcctcgtcgagcaccaggatcttgctccgtttcaggatcaccctcccaaggcacaccagctgacgctgacccacgctccagttctcgccgttctctatcactgcaaccaagccaagccaagccaaatcgggagaatattcaccaagaattaccaagtgtaaaagtagactttgaactgcatgattctgaacaggaaaaagaaatgagtccagatgcagagaaccgaacggacctggtgaatcaagtcgcagctccttcctcctaacttcatctcctagctgacagcgatccaaggcctgaaaaggaagggcaagatattcataaatcataatagaacttcactgcaagtccacaaatagtatgtggcagctgacaatggtgaagcatgtgaagactggaactacctcccagatttggctatcagtgtactctccaataggatcaaggttggttctcacggtaccctcgaacatggttggctcttgcgggatgatgcttagcctggatctcagatcatgaagtccgatggtgcagatgtcgatactgtctacgagtatctgaccaacggtagggtctatgatacggaaaagggcctgtatgagagttgatttaccactgccggttcttccaacgataccggtcttcatgcctccagggaatgtgacagtaaggcccttaagaacaaatggcaaatgtggagcatatctcacctgcatcaaattgaaatgttcagagatatgtactaccaggttttgaatttgacatattattggacctgaactcctgttcatcttattggcagtgggaaacgatgcagcttattcaaaaaagggaaaaatattaataaataaaatgggaggataagatgagtgagctattacatggacgttattgagcataatttctccttctgatggccagtcctgcgtcaatttatcatcttgtacagaaagagggggctctgcaggaatgctcatgtattgcagaattctctctactgatatgatcttgttctccagattgcacatgctccatacaacccatgcttgcagcatgttcagattaagcccgtatgtgactgctagaccagaaattcctgaaaacaagatacaacattagctgcaagctcatattaacaaagttggaatcatcttcagtacatatagtgtcaccatacctggatcgatgagaccagtcggaagattgaccaaaaatatcaaagagaaggcaaatgtaagggatgcagcatatccaggcggaagcaaagccattccattgctgcagcattataaaattttggtctagaaaatgcatccattaaatggctattagttgatacaaactggttttctttgccaaaacttctgatggttgttgatcctgttattgattctgcaaaatgctgtatgatgggagctttgcaaacccctactagtctttgcaactctctggctgtatcgatgtagtaacgctgcaaaaccataaacgtggtgaggattgaagagtgttgatcttgcagttgaaacggcaagaagaacaaagcaaaagtacctgataccagaagcaggcagcaagcacaggaataaaaacaacaaaaacctgccatgcaacctgagacatcacagcaataattccaacaagttgtatgatggaaaatgcaacagatcccatctggtaagcaatgctggtgtccacttcgctttgatccgttgaagcctaggcaatttaaacctgttagcacgagcgcagaaaataaaccaagctttctagaaaatttgtgcaaatgaacatgacttactctattcaaaatgcgcccactaggagtggaatcaaagaatgacattggagctctgaatatggacatatgcatcttgttgaacaacagagttgctgtcttgtatgcagctgtgacaagaatgagtgctcttacgaggttccaaaagccagtgcaacatagacgtagatcagggttgacatgcttactggaggctcaacgtcctttgagacaggagcagcccaggccatccagtaattgctagcaatctgaagtacttggaaaagtatttgggccagcaagatgaatggcacaagagctcccctgtaagctaaggtgaggtacttccagtagacccagaaccccacccttcctttctccctttcctcttcctgcaccagctgcccactctgagcattggcatcgtcttcttttccattctgtttatctttcttctcaactgacactgacctggccaggcttgctgtcttactagaagaggaagcctcgttgcctccatttgtgacatctatcgcatccaatgcggtaagagcatccttgtgagcaccaaccagttccatgaactcttcccctgatccaagtatttcgtcatatttgcctgcctgtgctattctcccacctttcatgacctacattatagttagtcattaggcatgtacatacatttcatggcaataaatatagatgaaaacttttccaatgaaatcattaccagaataagatcagcagcaggtaggaattcaatctgatgagtgacataaacaactgtttttgaagccaattctccaagcaagcattcctacaaagggtataaaaccttaagcaatttacgagcaaacatgccaaaggttatgcacttgtcgatattgtagggaataaatcatgaaatgctattgaaaatagaagatcatatcataccttgaacaagtgggatcctgtatgagcatcgactgcactgaaaggatcatcaaacaaatagatgtctgcatcctgatacagagctcgggctatctgaatcctttgcttctgaccaccactaaggttgatgcctctctctccaatgacggtctggtcaccaaacggcaatatctccaagtctttcttcagcgagcatgactcgaggaccctgtcatacttctcattatccatctgcttgccaaacagtatgttgtcctgaatcttaccactctgtatccacgccgactggctcacatacgccatcgtcccacaggtcttgacctctcctgatagctttggaatctcaccaagaatgcaagacaacaagcttgattttccagagccgacagtcccacagactgcaatacgcataccttgttgagcttgaaagttcagatccttcaacgttggcacttcaggtgaggcatcccaagaaaagcacccatttctgacctcaattgcaacatctgagctaccacttggaagtttcagcacagcatcagtcggcaattcctcgaggcataaaaaggatgctatcctgtcaagagacaccttggtctgaatcaacattgagatcgtgtcgggaagattgtatatcggttcttgcagcacgcggaatgtggccagtgcagatagcaccttccctgactccaatggtatccccatgagcatgcaagctatgaaggtcaccactgccacaaatgttggggctccccagaacacaaaggtaacaatggtcgatgtgtagagatatttcttgagccagtttgtctccgtcttcctcaggtcgatgatcttggacaagaacttcatctcccacccctgcaatttaagaatcctcatgttgcgtaggatctcagatgttgctttcatcctgacatccttgcagtccatcagcttctgctggaacttttcctgcatttgccctggaggcacattggcaagcatgacaacaacagtggcaccaagcgcagcaagcgaggcaagcccaagggtggagtacaggatgaacaatgccatgcctacttggagtggcaccaaccagaggtcgtgcatgtaccacgagaagaggccgacgcggtcggcgtcgacgctgatgatgttgatcatctcgccgctcgtgcggctctgcctggattggctagacagcacgagccccttctggtagacgacggcgacgagcgccgaccgcgcgcgtatcccggcctgctgcagccggaagaaccagtgccgttgggacaaacactcgaacaccttggcgacgatgaaggcaaggacaagcagctgccccttgctcgcgtacctctcgtcgccgttgaggtattgcacgagcgagtcgatgaggtaagggccgacgtaggtggagacgttgtagaccagcgcgtagaacgcggtcaccgcgacgtgccaccacacggtgcgcaccagtgccttggagagcgtgaacgccgtgaccttccgcccagagccgtcgccggcgagcgcctcgaggttggtcttgaacggcgggagcagaccggcgactctgtcgccggggtcgaggcccgggacgtcgtcgaggtcgagggtcttcctgtgtccgacggcgaggaggggacccatccacgagaaggtgaggacgctgaggaagccggcgccggtgaacatcgacgcatcggcggcgcaattgttactgttgttctcaccggcggccgtcgcgcttgcaccgctaccattcaggagaggctcctcgatagcagagtcgcccggttccctcctgcccaggaacccggcgaagagcagcaccacgccagcgaggaccgacacggcgtcgagcgcccacgaatgcgcgggcacggggcgcccgtcgagtcccgtcacggcgtggacggcgacggcgaggacggagaggagcaggaagagcgcccaccagagccgcagcggcgcggggaaccgctcctcgcgtcgccacccgaaccggtactgcaggtacgccgcgagcagcagccacgccaccgcgcgcgccgcggcgtccgcctcctccaccaccgcgccacgcgaccacccaccaccgccaccgccaccgcccaggtacccctcgtacgccgcgaggatgaccccaaacccgccgagaacccacgtcgcggaggccgcgacccaacgccaccgaaacccgcctcctcctcctcctcctccccgcacctccccatccttgccgcggcggcaccaccagccgaacaccatccgcgcggcgaccgcgaccgcgacggcgaggtgcgccgcggcgcccgccgcgtggaggaagaacaagggcacgtcgtcgccgtcgtctcgcccactcgccgccatcgccgcgagcggcatcggtgcggcggccaagggcatggggagtgagtggctcagtgtagctctgcaacagatgggccaattagggggggttgtggtatagtaggcgcgcgcgcgcggcggtcaaaggcggcgggcggcgaggggggctccttgcggtgcaaggcagcgggagggagacaccgccaccgccgtcgactcgtcgtctcgtccccacgtttcacttcaccgcgagaggatggcaaccaccacccgccgcatcctttttaccgccggcccgcgacggcgaattggggattttattttgttttttcacacctcggggagggcagatgagtcgattttttttttcagttttaaatgtgacaattaagaaattaccaatctcaccatctgtaatacgtggatcctaaattatcttattaggtaaaaaattacccaccatgccacccccactcccttttacacttgcaaacccaataatccaggctctaataatttaggaaagaaacaactaaccgcttattctagtacagattataacaatcaagtttatagtaatatgactcaataatctagattataataatcccaaactgaaaaaacagggccttagtttccttcaaacttacaaaaattatgtcacatcaaatatttagacacatgcatggagcatcaaatgtggacgaaaaaaaccaattgcatagtttacatgtaaattgcgagacgaatcttttgggcctaatcacaccatgatttgacaatatgttgctacagtaaatatttgctaatgatagattaattagacttaatagattcgtcttgcagtttacaggcggaatctgtgatttgttttgttattaatctacgtttaatacttcaaatgtgtatccgtatatcttaaaaaaattgaaaattgaaaaggaactaaacacggcctatgacgtgtgcgtccggtgataaatttttaattgtaactagttaaatatatctcttgattttaccgtggagataaaattaaaaaaatatataattagtgcgggagacgacgtggggtgggttctcgatcgaaggtttagtaaatgtaaatctgggggttctgattgtgtttatgcacgtcgttcggagaagaccgagacgtagatgcgagattagttagataaattcaggttttgttttgtttgttcctagtatgtttttgattttattattattattattattattattattattattattattattattattattattacaaaaggaagggcaactttcggtttgtgcgcgacttaaaaatgcaccctggtagattacataagctggtgagattgtcccaacttttacacgggaagagattcttgcaaaagttatgtagtactactattagtttggcaaaagttatggagtattttcttcctcgaacataactgaattttatgtgtaactatgtcgatcgctcaacatcgtcatagtctaatctctcattgtaatataattgaacagtgtatatttttttaattcaattagtacatttaagccccgctatttcctcccctcttataaattatcatgaaatcgtttcctattcttctaaatggtacggttttttaaaaaaaaactttctatacgtaaattgcttaagtatcttttcaaaacaatcttttaacgtagcaatagttaatatggttgctcttttgtattcttccttaataatatactctctcctttcctaaatgtttgacgccgttgatttttttaaacatatttgaccgttcgtcttattcaaaaacttttgtgaaatgtgtaaaactatatgtatacataaaagtatatttaacaataaatcaaatgatatgaaaaaaattaataattacttaaattttttgaataagacgaacggtcaaacatttttaaaaaagtggatggagggagtactagatatggatcgatggatgtagcatttgttctctagatacaacttcacaagacgtgtgtgcaagtaaaatggcctacctgtttgaatgatttgatgtcttttgaataccaaatgtccaaaatgcaatgtattgcttatgaaactacttattaaaaatatacctatactgcgtatataactcatccagtaccaatctaaatactattaatacaaacttacacatgtagcaccatcttattttaaaaaaaggaacaacctagaaatgtttcatggccgtaatgctttatttttctactgcgatgcatgcatgtcttcaatttaatatgattttaatgagtttagaaccgctgtcggtctcagtttttcatgcgtatgcctacgtgtgtgttatacttaaagcaagaatattagtgagttaaaagcctactatatgtttaaaaaaaagttataaacttactataaacttattagagaagagatgtaataaaaaaagaaaggtgttgactcgaatgcagaagctagcttaacacgtactcaagacaactatatttaatatataagtgagagaaaaatagtggagaagaaaaattaaaatcaatcttatatatgatctattatactatatgctagttttaagataagctaatatttattaagctctactattaaacctactcttgcatgactacacgagtcgtagagggcgtgcaatttcagtcatcttttaatttgccattcccaactgtttggttagttctcggagtacgtgaagagagagagagagagagagagagagagagagagagagagcatgcaacatatcttttctgccctgatctcgctcaggataaaaaaagttatactgcattagtattttaagattgccgaggtatttcaccgaggcactagcaccacaacaatatatattcaccttgtctttcgacttcttaattcgtgtgcgcttttttaaaaatttagccagttattctatttgcacctatactgtggactagtcaaatctagcacaaaagctaaggtgccatcagaaagatatagaaggttaatgacgaatcagtgacatactatatttgaaatttcagtgatacactacagtgcaaccaataattaaaataatatagtatgttttggccggtcgctttcagaagatgcgtcagcttgtttagtgtgatttagacgatcaaatttaaaaaataatgctgattctccagctaaaaggtactctattggctagtgcttcctggtaattaaaatttaaatatattatatcctcatttatcttattagtactctctccattttaaaatatagaatgcttcgtttcattaatacaagattttaataatcaactattttgtaacgatattatttatgtgacacaaaagtacaatcataactaagtacttagaataggaatctgatatatactgataaagtaaatgttgacaggagtcttattctaataaaataaaatatatcatatattttgaaacggaggaggttacactggtggataaataatctttgctgggtcaacccaaagccacaataatcctggttctaaaaagaaccgggagtcccggttgaaaaccccataggcattctatgatcttaccaaccgggactaaaaatcatctttagtcccgattcatcccctgattgatgtcagggggctgaggatctttagactaaagatcagcactttagttccggttggtgttcccaaccgagagaacaccaaccgaaactaaaattcaaagcatagtatataatctatatcccttatcctctcctccacctgtctttcccttcctccttcgcttcctacatcctcaacccgatccatcccctccacctcctcccctctcctccacctcctctccccttcccctccacctcctccccttcctcctcccctctcctccacctcctcctctcccccttcctgcccatcctccccttcccatccggcagccggcggccggcggggccatgcccggtggcgggccggcggccgtggcaggcggcggtgggccggggcggcggggccgcgccgggcggcggcggcggcaacggcgttgttttctctcttttttttagtttgtgatttacatgtataattttgtgatttattggatggatctgagatgacctgtgatgtatttgatttgtgtgtaattttttaggatttgtgatgtatttgatttgtgtatatatgtaactttaagatttgtgattttactttatttgtgatgtggatttgggatgttactttgatttggggatatgcttcccacttgataagattagggagaaaataaaaaaaaagaaaaggagaccatctggaactaccgctattctctctttactcccggttaccaactgggactaaaaagaggataacaccaaccgggaccaaagatccatttttaatcccgcttatttgaactgggactaaagatagcgatttttagtcctaaattcgtagtcccggttagaaaaccggaactatagaggagttatgaattgagatcctaagtcgccagttgccactgcatcatcagcaggacggaatagattcattcccgtagttccatgagggattaagagcaatcatacgcgacttaaccgtacttaagttctccaaacaagtgataaagaaagctgttgagaaattccgtcaaaagagaggctgttcaaaaagtgattaataagaagcacttatctgccctgaaagaggatgttcagaaagtgatcagtaaggaaagctgatctgttcagaaaagcaatcagattccactagtgcataatatctattcttaggcagtatcgaacccataaatatatggttcagaatattccaaatcaaggaaatcagatccaaatctgatttcaaggattagggtgtgtttagttcatgttaaaattagaagtttaattaaaattgaaacaatgtgatggaaaagttaaaagtttgaaactaaactcggccttagttctcaactttttcttcaaacttctaacttttctatcacatcaaaactttcctacacacacaaattctaacttttccgtcacatcgttccaatttcaatcaaacttccaattttaacgttaactaaacacactccaaatattattattggccatgtataccagctgcagctatatataggctatagctaccagcatcctatattcatgctgattttctttttaatgaaaattcttagggcctgtttagatcccctgacaaaatttataaccctgtcacatcgaatgtttggacacatgcatgaaatattaaatataaacgaaaaaataactaattacacaaattgcatgtaaattgcgagacgaatcttttaagcctaattgctccataatttaataatgtggtactacagtaaacatttgctaatgacatattaattaggctaaataaatttgtcccgcagtttacatgtggaatatgtaatttgttttgttattaatctatgtttaatattttaaatgtgtggtcatatatccgatgtgacacgcaaaaacttttcaccctggatctaaacacagccttaaaaaacaaagagactcatatacacatacacatatataactttaacatactagaccaatgagtatgtgaagtcacatacttccgcagtccgaaaaaacgaatctagcactagatgtgacatattctagaataatgaatctggacaaatgcatgtacagattcatagtactgggatgtgtcacatccagtaccagattgattttttatgggacggaggaagtagtatgcttctttgttgtaaatgtcaacacctatatcaagtctagatcttgttgggtagggttcgccattagggcatgtacaatggtgtttattagtggtctctctctattaccatgcaagtaaatttaatgatatggaaaaaagagaaaggagtatggttgttatgcatgaacagcttataatcgactcttagcatttattagagtaaattttgttgcatggtggtgaaagaaaggaaagaaaaataagaaaaagtagtttgatacattaatgattagagaccatattgtctctaactgttgtagaatgctagtctgtaaataacgtagatctcgtatctgactttacctttgtacatgccctaagttgcctagctagctgagctgcgttgagttcgtaaaatcgtaccaatcaagacctctcacaattataattagcatgtgtttccctccatttcatttcatggtgtaagaagttttgtatttgtcataagccaaatttgttctaatttaactaagtttgtaaaaacaatgagcaacattctcaaccccaaattaagttttattaaatccacccgtgaatacactttgcaatatattttttttgttgaaaacgtatattcttttataaatttaattaaactcgtaaaaatataacttagagtaagacaacccaaaacgcctgtgggaatagctcaacatgcgacggcagtaacaaacaaattgagttaattaacttcgaatttaccgtgtgctcgaccgcaacaggtgaatctttttattttttaaaaaaacaatcagcaggtgaatctaaaaatgatttggcgttgacgacaatagcgtcgtctttgacgtatgacgggtgacggcgatgcactgtaagctgaatagttggttgcaattggtataacttgattgcaactgttagaattatagaactaacgtgcgcgccagtagagatgcaagcggattaacccgtaaacccgattatagataaaattagtgagtaacccgtggattgatttacgggttacctattaatttgacctcaaaataaacttatgaattgatctacttgcatctttacgacacgataagctaagccatgacgtgaaactcacggattattttttattaaatatataagtaggttcacaggtcggtccgactagccagtgaccatttgagcaaattggcagcttaattagctatacagaacttggccccccaagcatcgatcatcgatcgatagcgatcgcgcaaattttctgaagaacttcgccgctgcttcttcccgtttgatttacttagcggtgactcattgtcgatcgatcggcctgatgaatccgggagtctgatcaagatcgacagcgatggatgatgataggagaagctaagtactttggcgccaaggcagcgaccggcagaattatgtctttttgatctttgaaaagtgaaaaaaaaaagaggccacgtccgggacaagagataaataattaacgccacgtgcgacgtaaacgaaggtgcaacaatctctgttgagctcgattaccatcttagttttttttttaagataatggacttaaataaaacttggcctctacatcctaagggatgtacacagccacaaccatgcatcttggcttcttgctgagaaacaaacaattgtagtttgcgagacgcagcagaggaggctagagggtcgaattaacggacatcgcgtcagtgtatggtcaccggttttggagggagatccaacacatacctataagatctgaagatatgctcactcgtatacgctcgtataaatacatatgtacacatatccctatcagcatacataggtatatcatatccctatcagtaccttttaaaaactgttattgaattttagagatgcatatgcattttatctcattataaacttccgtgcaaacgtgtaaaaaaaacaagtcatgaattaaatactttgtgataatataagaaaaagataaaaaaaaaactggagtgagtacattttgtacgcaaaattgcaaaaaggtacagaggttctgccttatgggtttggttcattgttgcttgttaacatggcggttttagtatcgtggggctttgacatatgaacgccggctcaacagatgtctcacttttttcactcctaaaagactaaaagtgcttttaatcacatttcctttcgtatagggagtgccttaattaaagaataaagagtacaaccggagacctaaagacttaattaaagaataaagagtacattttaatataaattttgtaaataaaaatgtaacagattgaaaattttgtttgaaagtaggacagtggatttttttttggtcgggatcatttatataaaaaagaggagcatatctgtaaaatattatcgtgagcatcagtagccctatatttatatgaatgctccttttttcatgactttttaataaataaaataaatacatactgattttctttcgttatctaaaaataaaatttgtcataaataatgtgttgcacaataaaatcataactataatagtttcatgcagcaaatttttgcattttcaacaatgtaattcatatatttctatgttaaaccatgtgtaagggtaacatggtcatttttatagaaattagatagtcagctgatggaagaggcatgaaatggagcaattagacagtcaaatgacgggaggagcatgaaagagaacaagttgaaatttcagggatacaaaaagtatcgagtaaatttcaagggtttgagaaggattgagtggtttttcaagggtatacaaggaatttactctattctgtataatctttcaaagtttatactaattttatttactagcaaaatgcacatactttgctataggtaaaagaaaatatataacaatatgttatagataaaatatattttcattaaatgtgctagtattagttgtttgcttatttggatacatggtattcatttgattcaaagaaatattagactatctgttgacgaaaaaatcgaacacaccggcttgggagatctgcttaactccagtgcaggtccaaaggttggtgagatgcgagcgtgccagtcagtttgatcctgcaactgacaagatatacaaataatagatcaaacagccgatcggctgacaagccgatggagtagttccagccgatagccgataatagccgatgccgacaccagccgatagcgatagggtttaagcaatcgaccatatgtccaatgtagataatgatataaaggcaatcggctgatgatgataaaatctaacaataatatagtctagtagaaaccaatcgactagcaatggtatgatagaataagcactgattcgaaggttaaagcgtacattggctgaaggtccgatgccataaaatccacagattagattaaacagtgaaacttttgttgtcatcggctaaatccaacttgtatatatatgtaatccttatgagccgatgcaatgtccagataacttatcggctagcaccccgataaaacattagcatgaacctatcggcttaacaagacttatattatcaacaacgatctagtagatcgaacctaaccgatgcagcacgagattgtatatgataatctaatattcgatgagccgatagatctgtcaaatgtgatggatataacaaatctatttagaacctcattatgattgtagagatatatcggctaagacaggagatcagacctaaccgagacagtcccaactaaaccgacgcatctctaaacacaatgcaattagagatagaattgagatatcatgtaggcaaatatattaaccaaactagagcgatccaagagatcgaatcgatgcagccttgaacaacaccaacgtagccgacagattcaccagggcccgacagaacgtaggacttatcccttcgctggagatcgaaagctgatgcatccctgcgtcaggtgcccaagttccgttggaagataagtaaaaacctcagggaagagggtggcgatgcgccgagagtattattgatcgatagattgatatattacaatggccccgggtgtacatatttgtcacaccctgaagttctcctcctagcctaaaattgaattaataagagactctaagaaaacaccggtgcaaagcaagagtaaaccctattaaatcaatgcaaataataatcggaattggcatgtggaatttttcttgagttctacatgtcgaaattcactaacaagatttttagtggaattttcagagctctcgaaataattttaaccatttaaaatcgagcttgcaatattttaaatcccagggaaattcttttcctcttttctttttttcctttcccctccttttcctcttcttgggccgtcggcccagtccaccccgccgcgcgcgccctcctcattgtgggccggcccaagccgcccctccctctctccccgggacgccgacaggtgggccccacctgtcgggcccgtctccttcctccagccggcgccgccgcgcccgcaaccgccgccgcgtccacgcctccgcctcctccgggccacgtcagccacgtccgcgcgtgcgccgcatctcccgcacccatttcccctctctctcgcgcccgcgcccgcgcccgagatggccgggattcgattttcgaatcccacctctctctcctcccccactccccacgttggccggcgaaatctcgcctctcccggccacgtccggctccccctctccctattaagctccgacgccaccccctctctctttttccccatttcgccgaactctcccgagctcctcatcgctcccgcgccgtgcaaccacccaccgccgccgtttccgttacttcagccgccgctagccgccgctagggtcgccgccgcaccgcgccgtcgccgccgtcgggttcgcgaggggctgca

SEQ ID NO: 64865 - DNA, 530 bp, Oryza sativa
tgagtggtggggagaggataagatggaagagaagatatgataggggacttagtttattttatggaggtataatttttgcaggcggaccacataagctaccttgtgcaaaaattcaaaaatcatattttttttcaggcggaccacttaagaggtccgcatataaaaataaaggtattttcgtaggcggacctcttaagtggtccgcctggaaaaattaatttccgcaggcggatgatgaaaattcacctcggtttatattttcgtaggcggatatttggctctgggtgtcatatccacctgcgaaaataaagatccaacgttggcgaaaatgctttttctagtagtgaaatatgtgacgctgcagctagttaataatgccaagtgatacttaatgatcgatacaaatacgagactgtgatactttatatcctgtggaaactgatttaccgctcggggcaagcaacatacagtcatcaaaagttggcgcatacatggatcacatgcacgagacaattaccaacgattaatat

SEQ ID NO: 64866 - DNA, 37786 bp, Oryza sativa
tgctccgttgcatatcttcatcactttgcaagtatagcttttgtataggatcagcatgtggtggaaggctgcatatataagatgttagaaataggaaattccataaagtaaaagaaaatatgcaggggattaaattgtacttaccatttctgaaacatcttgatttcagggatgtcattttcgttgatataccaacgacaagctgttgttccacttagaaattcatatgttcccttaaggattttcattgatgtaccaacaaatattgctattatatggttattttgaccaacttccagtattgtctctccatcaaactcaacagctctttttcctgataatgagaggtcgatggtttttccactttgaagaaacaataaagtcagtatcaagtagtttcagattagtgttagtgttcagatggggaaatatagctgatattggcataaattaccttaaatcttgtagtttgactattcttctcatcctataatctgatgaacttgtagaaatcattgctgcattagaaacagcaatgatttttccaataacatctgcaaagatagaataaagtatttgattataacattgcatatagaatattatggttacgtgtaatgaaataaaagttaatttagtacctagaaaacgatcagtcttgcttgtgaaatcatgaagtttatcaaatgacaccaagtcaaatgtatactttggaaaatccataggttgatctttggcttcaatgatacaagttcttttgtttagtttgatcatatatggattaccaactgctctataactgggcttagcattgttaactgttatcttgctgatgtagacgatatttccttcctgtaaatattggttcaataaaggtatagcatcaggtgggatctcagcatagatagcatctccctgcaatggccatgcaattttaataaaataatatatatttaatgataaatatatgttaggagaaaatataaataaaggatatagtattaccttttgatcaagtaaaaccagatctaaatgtttgatgttatcatcttcattagttcctctaaattcccatatcctagatattcggacgcatatcatgtagtcatatcgccctgggcgcagctctgcaattggagtgatattcatctgcaaattataagcaatggaaaatgttagtactgtgtttgtgtttatatagtatatagagaaaaatatagtatacattaagatctaaatgaatctaaaatttctctatatactatattttttgtttgtgttgcacatgtcccatcttcattttctattagaatttttaaacctttactattgcttactcgtgagattgcgacatataattggccatgtgtaaagactggtttttttagatataaaccaacattagataaagtttgtccttggcttttatttatagtcatagaatagcacacttttattgggaaatgtcgtcgacacaaggtaaatggccattgatttcctcgggttgttaagtttattctgggtatatatgctttttctcctatatgagttcctgttattattataccttctataatattgtctcctaaatttgttattatcaatcttgttccattacacaatcctaaattttggtttagatttcttagcaaattataggaactccaactttcagcttaagtacatgagttggaaaattattggcatttagagaatttaatattcgacaggatataatatgtccgcatcattagttgtatccatacattgagatagtgtgtcagcactataatattccttctcttgattaggtactaagctaagtatatagttgttcacttcatcaacaatctcattagttgtagctagaattgctctatttttcaaataatttggattaaagaaactatttttgaaatctgggtatgtaaactttaccaactcttctaatttgttttctcctgtgtttattaataaattttccggcactagtataatggttgtatctgtgtcttcattttgagcagtactttgtttggtatttattttaccattgcctatatccagaatccaattattaaagtcattgatttctttatattctaaagtattagatttggttttttgtaatcgcatattttcaaatagaaatatttttttaacatacccccaaagatatgactttacgattgatgcattaataatttccagttttgatgcattttctataactggtaagatttgtttagggtctcctcctagaacaacaactttacctccaaatggtttatcgatagcattaatatatttttctgataatatatctcttaatgttctatcaagagcctcaaagcattggcgatttgtcattaatgcttcgtcccatattataagagaagtttctattagtaattcagctaattttgttccacgtttaatatcacataatgatagttcatctatatcaactggtattcgaaatcttgaatgggctattcgaccatttggtagtaataatgatgctactccagacgatgcgactgttagaacaatttctttttagctctcaaaaatgatacaatagtattccataaaaatgttttgccagttcctccatggccagatacaaagaaaaaattactttctttatttattacactatttactataagatgaaatgctttcttttggtcatcgtttagctgtaagtacaatttgttagcttgctcttctaaatcatttgcattataatttaattcatcttgaattagtgtattagttgaatctaatttgtatcttactgtcatctgaggaagattaaatttatctatacttataccacttttggataataaatattctatttgttcaattagaatatcttttaattctatatcagtcgggttgtacttaattgggtgatattttgatattaattgaaattttatatcatctaccattttttccaatttgtctcaaaaaatttcctttcatcttctaaattgcaatacaatagtaggattataaataaagatcgtagttgtggagatgttgcccaacttgcagcttcgtcaaatgttttataccattcattatcatccattaataatccacgtgctgcacatgtttctttaaaagttttataagtaataccattgtatgttctaatatcttcatagttttttgctcctttaactatcattaatagcatacgtagatagaaacgttctccttcagttggtttgacataatataaacgggctattttaaaaccatgttgtcgtttgacccatttcctttcttttttatcccatttccatttttgtgggaattcacagtatgtcaagtttcttgcttcttcatgtaactgatttgccataaaccattctgtaagcatcgttctttgattatctggattttctataatattttttagttttgtatccttagttaatttgaccatattcattaagggaagatgaacaggcattctttccactggtggccaatgataatgtatttcatatccaagtaatctccacataccatcttgatcacaaatatatctacattctaaatattcttctatttcatctattttttctgtttgctcattttcagaatgatctattccttgtttgatacgttggaaaattattttagctttatcccctcctttgtttacatatttacataaatattttaacattctgctttgattaacaaactcaacatttaaatgggcttgatatctttttaataggaataaattgtgtggaacaacccatctattgtccaagttatggttatctttacgtatgtatatattagtatttctacgtttatattgtgcaaatccattttcagtaaaattagtttgatcattgaattctttagggtaaaattttgaacatttgccttttttcatgcatggacaattttcattcttggctccacatggtccatgcatcatatgttcagctataaggatgtatcctagaggatcttctctaggatctggtatttcagttgatatccatttatctatcatttcaatcgttatttcacttggctttttatctaaccaaactaagatatgtacatgtggtaaacctcttttttggaattctaccgagtataaaatagctgttgtaggtccaaatattgtgccggattgtatatcttctattaattgttctagctttatatgaaatactcgaactataatatcaggtctatcattgggttgttcgttttctaagattgtcatagtaatttcaggccacctaggattacatgtaaatgttataaataaatgtggaggtccatatacacgacatattgctatgccatcgtaatagttttgcattgtatatcgtttagaaccaacatggcttgatggtaatattattttttttcctatttggtttccttccgttaaacctttttgtactgcatcaaatattccttttaaacattcagctcgtaatttgttttgatttttagcaataaacattagtctatcttcatcttctattgcacgggcatcaactattgcttgttttgataatctaccataacataaataaggatttggttgatttggtcgataatgcatatgatatttgtagtattcatgtactgtaattgttgatcttgtttttttactctttttatttgtattactattataatatggtatgccaagttgaaatcctctttctccataaggaaataataaagggtattgtaaagccatataggctggatggaatatagatatgcgttgtaatccattatttttattttgaacaataatatctcttttataattttctagatttaattctccaactattaaaattgctaaatcttctgtatgtggcatttcatattgtattggatcacctttatcagcccctattattcgaatactaaaatcaacacctttatgttcttcaaatagatcgcgagcatagcgaaatgtttttaccaatggattatattcatcaaacattttttttaattgttcaactatatacggattgatatctgtacttcccatttcttctttatttaaagcatgtattctattttctatttcatttttagtatcaaaaatatatagttctgcaaactttggaatttcattaggcttaggtaggagacatccaatacgatgatgtatttgtccatttacacgaaacacatatggtccatcgccattatttatatttttatctattgtgccacccattgaagtaaaagaaaataaactattatattgtctaatcttctgcataaaatgttttgatagattatcttctttattattaagtaacctagcaagtgtttctggtgggttctggaatggtggtatttttattttgttatttttacagcaatttgaatatataatttcaccttttcttttctttgtctctcttttatttctttcttcaaaacaaaatatagcattgcaatgtttacatttatactctggcatacctataaatgatttgttttcatatgattcttttagatatttaatgtattctggggtaaaggacaccatgccatgtgaagttgataaatatgaagatatatggtctatctctaaacatttcttttttgcaattttttctagataatctaaattatattgtatttttcttttatttttaatatttttttgcttttctgtatatattatatctcttatattactattttttgatgtttcttcttcatctttattacattttttattgttattatgcaccatatttttttcttcttctctttttcgctttttctctcttagaatttgtagtctgatatatcttcttttcttgcaatctgatttatcatattctgctatttttattggatcttgctttctctttgatggcatattaacacttctgattatataagcacaaaaaatagccaaagtcagaaatgaatataagcataaaattaaatatgaataattaaagatattggttgaatcaatacaaaacttaatcattcatttcaacagctatatataatcagaaaattacacatgaatagtaaaaaaagtgttagctaatacaaacacttcaatatttatgacgacaaagattaataggagctacaattattgatcatacatacaatggggcaatagagctattctattgccattctctaataattcctagcgtacatcttttgtacagtacatccattccatttgtattacagtttcttacaaccatcgcacaaaattttcaaatttcaatagatagtgttgatatttttatatatatttctgattggttattgtttttaattagttccatactaaaattcagtgcatttgtggctatagataaaatggatttgctgatttattggtaaaacaatatcttatggaaataaaaataaataaatacaaaaaaaatgtgaagcttttgcactggttctagtgcaagtattttttctgtcttcactgatgttgctacaattctccaattctccataggaacattgattttccagaagggttgtagtaggatcttggtatgtctacgcatccagcataatataactttttggtcattggtacaacacatccagtacaataaatataaatataaatatatatatatatatatatatatatatatatacatatatatataaaattttccagctcgttattgttttttacctttttgtacttcctagcttcagtgtcttgctcctgtttatctccttttcttttccttattcttttatcccctgtaaaataaacatttactaatatcattgcagatgatcaatgtacaatgatgaaaaatactaaaaagaatagacaatgttttttttttctggtaaatatccatactacacgaaatgttattcacagctgattggttgtgctatagcttttctaaatagaaagtaaaatttgctgtaacttgctgcaaattatttagaggaaaagattagactttgtgactaattgatttacgggattgaagttagtataattacatgtaagtacctaggtttgtcaattaatggtttgtttggatcagaagtggaggctacagctacattgtatagtaccactatataaatcaatgtattttgaataacttttaaaaagtttaattgaaaacagttagtttggaatggtggtcatcgtaatatactatgagttaatttattaggagtacacgaaagcttgacttgttagcaaagatcaaacagaaatcaaaaggaacacatccatatgtcctctctactaagttgtcattggagatttaggtgacagaataagacgtggctggacgtaagatttctttccgattgcttccgttcccagtgacttatattataacaaatagtctaatactcctatatagtgtcagagaagtaacagatatagtatatcttgttgtccatcgtgcacatcatcaggatcagggcaagttgcagtaggctggtgttgatgttctttgattcggtataaatcaatcgatcaaaatgcaaaatactactggatctgggctaatttgggggctttcgtgatcgtgcaaggtaatgcaggcgatcgtgtacctgacctcgtcctcgtgttcactaatacatgtgattcagttcactgacctcgtcctggtgtcgccggacctgctcgccgcagagctaccggccagaggccaccgcctcggaggctcctcctcgtcgttgtgttgtcgcgcacggcgcaggatgtgcttgccgcagaggtactggctggaggtcgttgcttctttatccctcggtggatcagatgtattgccggtggatgttgatggtggtgtttggtgccggtgaatgtggatggtggaacggcaagaaggaatgtgagacaatgacgagaggaaagaggaatgatggagaatgaatatatatacagagaagaagaagagtcaatcaaggaagacgaagagtcgtggcccttccggagaaatcaggtggctttgcactttttcattatactccaacgtaagattgtcttttatattttagtccttttcgcgttttggagcgcacgcacgaaccacgctgtgccacgtggcatcgctaatcgctcgataacttgcacggatttcgatagtaagagatggcatatttgtaccttcatctacctcattgctgaccttctggttcgatattgacttcactaaatgtgcactaaaatctcttctattccaatgcagtagcttcagtttggcttcatgaaatttgagtaaatgtggcattgcctacatctgaactctgattataataattatggtttcacgtgtaatatattttttctattgtagtaaaaagtctgtaaaatatgcacataatgcaactttaattctcaacagcgaaagttgctaacttcaacagttagacttataaaaagtggcaaacgctaatcagaaaaaaaaagttagagcattatattgcttttcctttttcttacacatattctgctttcaggctgtatttaggctaaatacttatattctgctttcagcctaacgtaattatcaataatggagccggtagtcccctgatgagttcccttatctaccgatcattgaagtgtatgaagctactcataaaggtcagtgttttattgagtctatatttggtcaactaatgctgtgttttaattttgctaactcaagacatttgttccatgaacatatggagctaaatattctattgcacaatgcttttctcaggctggtgctgatgttaatggcaagggtacagttgtaacccctttgatgcttgctgcgtcgcagggaggctatactaacttcattcagtttcttctgaaggctggagcaaaccccaatattcctgatgatgtatgttttctattcttctgagtcagttgttgcttctccactttggtctataagtctgattcttttgtgttttattacaactctgaggatgttttgtctaaggtcatgtcagtttatgattaagatacagattttacctcggtttttgttagcaaaattttcaaattgttaaactatgtatttcgtgcgaaaactttctatatagaagttgctttaaaatatcaaataaatccattttcaagtttaaaataattaaaactaaattaatcatacactaatggttttcttgttttacgtgtcccatatttaatattcatccttgtcacatcctaagagggcctaatttaacaaaaacattgcacttatgatttgcatattttgtagtttcctatggattatctgaacctgtgttcttttattttattgtatgtgtaagtatatcttacgagttgtacaaagcatggatgacctttcagcaaccgacgagttctcaaatccagcctatatccaaaataccattttgatagaagttcatatcaatgtccaaaaagcccatggccagctttgaacctacagaccatggtgttttgggacgcaatgagtcgtttggttgaaacttgaaagccacagattgtgataataggccatacactgatttcaccaatattgtttgttttaggttccttgctgaattacgctgtatgaaactatttttcttcattctgttgtgcttgtgcagttgggttggttgccaatagagcatgctgcattacgtgattgcagggaagaagttgaaatgctatttccattgacttctccaattccaaatgtcccaaactggagtgttaatggaataatcgctcatgcaaaagtcaaaaatacaaagccaatggtacgtttcgtacagatatgcacttttgatctttctgtactaaaggtcctgctatgctctctgctcatatttcatgttgcttaccatgcactttgcattgcagagctctatttcacccacttcacgtctttgatgcttgttaggctgtaaaactggtttagcttacatatcaacggcatttaatagtactagatagaaggatcatgtcttaacagtactggttaatagtactggtttagctttgtaatcctaaataaatgttctgatattcaaaatttcaaaagttaacttcagatttgcatcaagatactattgtttacgttgtttaggatcaacatcagaaggagagtagaaaagtcgttttgaaggcacaggcagatttggtattcaagcagaagaattacgccgctgcagcaaaaatatatgatctggtaatttcttgcaccttatttctgattgttaacgctaatcaattattgttgttataaagtttttgtatgttattcttaagcttgggaatgatttgtttatctgatgcttgagcataggcaatagctcatggaccgactgcagttttgtacgcaaacaggagcatctgtagattgctcatgggtgatggtgaaggtgctctttctgatgcttacagatgccgaatgatgcggcctaactgggcaaaagcttgctaccgtcagggtgcagctcacatgctactcaaggtaagactcactgcagttaacgttttgtgatcctggtattatggtcggtgtcctgaactcctgatttactctaaaaccaggagtacaaacatgcgtgtgatgctctcatggatgcacaaaaattagattctgggaatgtcgagattgagagggaactaaggtaatcttctgtttcgctcgagtatgccttccaaataaaaatgtggttgcgcagggaacatgaccattagtactggcattccgttgtgattatgcccacatttactgcaactgaagcaactcaacactcaactgttcttttcggttttatatgccattcttccatctttgggtcaattttacgctttgggttgttataactgacatttttttggtccaaatcttttgtaggaaagctagggaattaatggcgaaacctccagatgagcagtgaggcagaataaccgcataatcgtcagctaagcaggaacttttcttagcgctgcactattttgttggatatgtgatgaaatgtaaataatgcacttcacggaactctcaccaatcgacagccagctgactgtcacgctcacactaacctcccttatctatctgatgctactcacaacccctgaacattgtatcagttgattcagttccacgcaattatcagaacattgctgaatgcttacgaagaaggtacaaccatttttgttatgcatgtacgaaggactccctccatcctaaaatatttgacgcccaaaatatttgacgccgttgatttttttaaaaatatttaactgttcgttttatttaaaaaaataattaattattaattcttttcctttcatttgatttattgttaaatatacttttatgtatacatatagttttacacatttcacaaaagtttttgaataaaacgaacggtcaaacatgtttaaaaaagttaacagcgtcaaacatttagggatttagggaagaagagggagtatattgcattgtcgtcgcacgtttgtgcaccggtccgatttctctgtggatattaggcccctaataagctatgtggcggcgtgccgttcgtgggccagccaggcggccacctactatcttcgccgctgcgccggcggcaaccttgggccgatggcaaattttttaaagtattaaacgttgtctaatttaataacaaaacaaattataaattccgctaagaaactgtaagacgaatttattaagcctaattaatccgttattagtaaatgtttactataacaccacattttcaaatcattgtgtaattaggcttaaaagatttatctcgcaatttacacgtaatctgtataattggtttttattttttccacgtttaatactatatgtatgtgtctaaacatttgatgtgatagatgaaaaagtttttgttttgggaactaaacagggcccaagtcgtgtgcagtgcaccggtccgcttccgtgcgtgtgtgagatgggcgttccagatcagctccaagtttgcttgaaagcgtcgcttctcgttgcgttgccacttgccaagcagcagcacgtgaattcgttgctgttatcttatctatcctggaaagcgacatcgccccctgtggcttggagttgcacgtattccattccatctctctctcacacacacggatcgacgatccacgatccactgtaccaaccgcggcatatgcttaccttaccggctcctacccccaccagcatataccacggttctaccgtagttgtacggttcagacagcgtgtgatcggcccacccacatgcatgaaccagaagcattcaatcaatcaaacaaacaaacaaacaagatcttccgcgcaggtgcaccagttttggctccaaacggggacgacgacgcgacccacttgagcctcgccctccagcccatcgatcgatccccctttagctgagcgaattattccacaagttccacgacgacgacgacacggccgggcgaggcaggcgtacatatgaacagcgcgacgcggccggaaacggtcgcgtacgtggaaacggccggtgcgtgccgatcgatccgtgagccaccttccaggcgcgcgggagcagaagtgtactatgccattggcagcgacggcgagcgaagaccgcgagcgagctagtggacacgggaggttgctctcgcggcgcgcgggaggggaggagaggagagggagaccggtggcgcgggtgcgctggaccggttcacgccccgcgtgcgcgccggggaccgaaatatctgtccgcgtcgtcgatggccggtgtcgccgtcgagcgagctacggaccaaaacgccgggatctcgaaggggcgcggcgctgcttacttggttgcttgattagttaagtttatccgccctccgttttacgcttttctgtttcccccggttatttaagccagactcaagtttctcgaaatagaatttaaggaagggtgtgtttcacgtcaaaattgaaagtttggttgaaattgaaacgattcgacagaaaagttgaaagtttgagtgtgtagaaaagttttgatgtaatggaatactttggatctaaactcggccatgggatgcatcagtaactgttactgttgctactatatcacttgatattcactttcattttggtgctcaaaataataataaaaaagctttcattttgggtatgcatcgtttgacatgtatatttttaaaatccactttgagaaaaaaaaaacatatagtaacttattctatatttgaacattgcaatcatagaaagacaactctactgtacgtgaacatttttcattatcaagatgtgaaccattcactaaaagaacaaggaaaacactcgttttcgatttctaaagaaaggttttcaaactatagataaccccatccttggccttccccctgccgataaacgtgcttcttttttcctctccagccaaatttccaaaggcgaaaacaaaaccaccggtgaaaaatccccaaagaataaaacaaccgaaaaccccgtgccgttgcccacgggataaaccaacgaacggagcgggtcccatttacccaaaagcgcactccccccatccccaccgcaaaagcgacggcccgcgtgaaaaagcgcaccgctcgatgcgcgccacgtgtccccccaccccccacgcaaccttatccactcgttcgtctccctcctcctcttcccccgcaataaaatcccacctcctccaatccacagcctcgtcgatccacttcaaaattcggagggaggaatccaaatcgaatcgaatcgaatcgaagaagcttggggggatattcttgatttgatttgttgttggaagagaagcaaatccaatggcgattgcatcgggggcggctttctcggtgaggccttcgccggcggcggcgaggccgtgcgtcgcggcgtccgcgtcggccgccggcgcggcgaggttccgcggcgacgggagcggtggcggaggcggaggcggaggcggcgggaagtggtgggcgccgctgctggggtggtcggggcagcccgactacatcgacgcgcagccggcggcgcgggaggaggcgcggccgaatccgatggcggcggcggagcagcgtggcggcggcgggaagaggttcggcgtgctgacggaggagaaggcgcggcagctgcgcgcacggatgatggagacggagagcttccacgactgcatgtaccactccgccatcgcctcccgcctcgcctccggcgcccccgccgacgacggcaagcactgagccgccgccgccatccatggctccccgcctctgcccataccgcgccgccatccaacgccgatgatgatgatgatgttgttgtgtcgttttggtatcaataacgtcgccgccgccgacgccgtcaatggccggagaagtattagtatgaggcctcgacggcggcgtgcttgtcggattgattccatggagatgggatgatttcatcctaatatctccatttctgtaactcatagtatagcagctaatgcatctaaacgttgttgtaacaagaaatttaatctggtttcttcaaccatggcttcttctgtactatacatcacaatcactctgaaattttcagaaatttcagtgttcatttttatctctgaaagtttcgagaattcaatgtttttttattcctttttcttctccaagatatgtgcagcatctaagatcgaagaacttgatcatcgaaggctcctaaatttgtcatctttttacgcataattggtgtcacttttgatctactgctacaaacttcgatctatcaaaaaggctcctataaatttgtcatctttgtacgcataattgatgtcctcctgatcacataacatgattgcactttgtgtccccgtgtgagtcactaagataagtactctctccgtactcggaagtcgtttagaacagcgtcacggtctctaaaacacaactttgacttctttttactataaaatatttattgaaaaatgatatatgtatacttttatgaaagtatttttcaagacaaatcttttcatataatttttatattttcaaactcaataacttgagagttatttatgatttatatttctaaggtttgacttaaacttaaacattgtcctaaacgacttcatttataagtatggagggagtagtaattttatgctaacttatcctaagggtctgtttagttttttagtgtaaagtttttaaagtatacgacaaacaaaatatagactaataacaaaacaaattatggattccgcctgtaaactgcgagacgaatttattaagcctaattaattcgtcattagcaaatgtttactgtagcatcacattgttaaaatcatggcgtaattaggctcaaaatattcgtctcgcaatttacatgcaatctgtgcaattgattttttttccatatttaatgctcgatacatatgtctaaatatttgatgtgacgtttttgtaaaaaaattttgaatctaaacgaagcctaagacacgtcacacatcatagtggtatactactccatttaactaatcatttattacttgtcaagctatggctcaactcactcaattaagcaaagagacactgaaaccgacatcaagcaaaggctagtggaacactccaacttgagattaaggtggtgtttggatccagggacttaactttagtccctatatttagacactaatttagagtattaaatatagactacttacaaaactaattacataaatgaaagctaattcgcgagacaaattttttaagcctaattaatccataattagagaatgtttagtgtagcatcacataggctaatcatggattaattaggctaaaaagattcgtctcttgaattaatccaagattatggatgagttttattaataatctatatttaatatttataattagtatccaaacatccgatgtgatatccgatgtgatagggacttaaactagtgccatctaaaagaagaagatttggacatgacgacgccatcaactgcttcgtctacaagttcactagaagcacggcaattcggcaagacggtgtgctccaatgtcaagggcttctttcttccacaggcaagcgggcccacatgaccaagagccccgtcagcagtcagctccgcttatctagaaaggcaccgtcggaataattgagtactcgtatcaaaaaggacagaaatggagcagacttgcaggaaccggccactggaattggatgctggtttctctagaatcccgtaaccggccactagtagattttagagttagaaaaaccaatcaaatacgaaaattttaaaacaatgatttctagttgcgctgttctatatggtgcgttctagttgcgctgttgtatatgaattttgtgggcaactaattaaatccattcagttgtactgctcttcagtagtgatcacaaaattatttagccattccgaagaaccatagtccataggcactgcataagattcataatttaaattcttcagtttaaacatgcagtagcagtaccaattctgagccgttgttcggcggcagactggttacgagaacacctacgccgtggaaccctttattattattattattattttaattttttgctgcggttgaactcgatcatcgccgcggttttgcctttccgacgcgaagtgcacagaaactctcccaaaacgacgaaccgttggacacaagcaaaagcttgtgtatatgtttgaaattaaacatccaatagtattttttaacatattaccactgcttgatcagactagtgtacactacttaacattatatatgcttatattatttgattactcacagaaacatccttcaagatccaatagcagaagtctcaggaaagggaagaaatggatgggctctgctgggccaggaaggcctaaatgtgtagcccttttgttgggctttcccttaacgtacaggaccttacatcctacatacacagggccttgatgaaagctgctcttcttcatttttcgcttttaatttgttgtgacagcacagtgtaaaactgaaagaccaacaaatttatgcagctatatccactaattttttgaatgctcgtcagccaggtcgaaccgaaatttatttctgagagacagcaagggaaaaatatttgtatttttcttaatttgatttcttggatgtagaattcaaaacaaactgacgtttatgtgatatgttattacaaggcatttttggtacgttctaagtcaaaattatttaaatttgatcaatattgtagaaaacataacgacatctacagtatcaaaatagttttattaaatccactgttgaatgtattttgcattgaaaatgttgttactttttcatataaacttgaacaaacttgaaatagtttaacttaggataaactaaaatgatttataataataaggaacggagggaatagtatatttggatagaggagatctacacccggccccatcggttggctgtttataagcataagcgaaacgtcatatttgcaaatgaaaaataatttacgaataaaacttttatatacatgttcttacgatctaaaagcaaatgctgaaaaacaaactataattaaaaaaataaaattagctctaaatttaaggttaaaagtataaattttagaagtttaagtacagatgaaaatatgaggcccgaccgtctcgtaactttgtctaagctgcgcgtgattatgcttcactaatggtggcagaaactgggccatttttcagagtggcgcaggcgcagtgatatgaggatttgagcagcgtaggcccagcccatttggctagttgtccggtcctgcctgccttagcttgggcatgccatctgctctgacactgccactttgcaaacttcactcaactttgtctctggccagcttgcaattatgcacatctcttctctatcgcgcaacattgatagcgcctgcacgaatctgctccctccgttttaaaatattccacttcatcctaaaatatattattgtaacatacccctttatagtttttcatggaatggaggaaataaaactgaatacaacacaaacatgacacatctattcaaatcattcgcagtactggattgtatctcatctagtacaatgtttctatattttaagacggtcataaaaataacttataacatttgaaaatttgttttaaaatacaacttcttcatctatcttttttttaatcaatcgtaataactaccaatgttgaagttgagactttatatattctcaccttttatgattcaaaagccaaacccaatcgatgaaagtggtaaagaaacatgtaaattaaccctaacattaaatccccattattcaaaattggttgatctttgagttgtagctctataaggataccatcatctgtttttgttgagttatcaatcttacatcccatattgatcacatatacttaaattgatcatcatataatcttggtctcttcgtttggcgtacggtgttttttctatgcatgcaaattgagtatgcgtgcatgcacgtactccttccgtaaaaaaaaacgaatgtaatatatattacagaatctgatagacttctgaccatattcgttgtatcaagacatgtctttttttttatagacgtagtaggtatttaggactagttaagcactcgttttcttgtgcatatggggagctatagtatgcatgcttttttttattctttctcactacacactcgcattaaataaaatacatggttagttaattttggacttatttttctcttatcagttgtagctgcacctatcaaagctacgatactgatgctaatgttgacagtatattgatacactgatgcaatcatacaatattgtgaacaaactttacgatagattttcgtggctccagtaaaaagcagggcaaaaatatactacctccgtcccgcaatagttatcgctttgggtttttcctttcaacgtttgatcattcgttttatttgaaaaatttgtctaaatataaaaaatgataagtaatacttaaagtacttttgataataaaacaagtcacaaataaaataaataataatttcaaaattttttgaataagatgaatgatcaaagtttacaaataaaatctcaaagcgacaagtaatatgggacggaggtagtattctccatcgagattcgcaggagaccgacttacgagtactagtacttactccctccgtccctaaataaatacagttttacgctattcatgttcaacgtttgacgttcgtcttatttaaatttttttatgattaatatttttattactattagatgataaaacataaatagtacttaatgtgtgactaaatatttttaaatttttcacaaattttttaaatcagatgaaaggttaaatattgggcacagatatccaccattgcaattattttgggacggaggtagtattaccgatccccacgataaacaaataccacggcgcgggaccaccaccgaacccacggccagcaacaacaacacacagcaacaggcctaccatatcgcgagaaggcccccagcgtcgcggagccgaaggatcaggattcactccgccctcgccgacctcgtcgccggccgccgcatcaccaccgacacctccccccatcgccgccggcgaggtgcgccctatcatcacgcatcctctcctcacccccccccccccccccgcgctcccacagccaatcgggccgcgggtctgctgttttttttttttcgttttgttatttttccaaatccgtgcagccaagggctcccccaatctcgtacagttccactgttccatttgtggcgccaccggggggctctctgccaccgccatcacgcgctcatgtggcgcagcgcagcgcagtggtggtggtggtgccctcctcctcctccccctcctgctcgctcctcctgcgatctctggtagattccctactccacgcactcccacgcgagagaacccggaaaagtcgctcccctttccgccgcccaaatccgcctttccctttgtatcgcgtcgcgtcgcgtcgggtcgggttgggtcgccactgccacttccacttccacttctcccccctcgtacgcacgcgcgcgcgcgcctctcctttatctggtggtggtggtggtgatgtttgggttgtttaccttggtttggattggattttttttttgtttgcagagttgggtggtggagcgagcgtggccgcgaggggacgcggaggggcggcggcggcggcgattgttcgcgggatgagcagcttcggcggcaccagctccgtcgcctccggtggtacgtttcgttccattgatcggtgttgaatgcgttgaggagggggggattgattcgtgaaatgggatgggattgatgctgtgatttgattgcgttcgtgatgctcctgattttgattcgaatgcgttgggggatttgggatcgaatcgtaaaatgggggtgggattggatggttggatgcaggtgggaagaggctcgagtacgggcggacgcatgtcgtgaggcccaagggcgcgcacaaggccaccatcgtctggctccacggcctcggggacaacggagccaggtacgcccaccctctcctccccaattccgccgccgtccatcctctctctctcgtcgcgatcgatcctctcgttgtgattgatgtgcttaccggatgcgtagatgaacaatagcgccaatgcacttttttttcccaactgtcaacaaataactgtcaatttattgacatccgggcatccggttagcttactgccaaatgccaacgatggcagtttctcattgtcaatttcctttcttatagccccgggttattgcaagctgattgctcaagtaatctgattggtgtagtgtaccgtgtacacaaatatcctgctctgtttatgttgtagtgatttttctgatggtttcttcccaaattccaccaccactgtacaatgaactttttaacacgcacacaatttattagtattggcgaaagaggtagattgtatgaaaccacgcgtagataacaataactctgattgcgacatgcaaagcttttgtgcgttcgaaaaaaaaaaaaactctactgcatcattgcaagttaaaatttgggagatactgatataaataatggatatatttgcagctggtctcaactactggaaacccttccccttcccaatgtaagtttggacatagatttcaaatatctatcctactccaagttgttcttgtgattatttcctttgtgtatacatcgctaaatccagtagctccccccccccttcataatgtattttgtatcaaccgcagataaaatggatttgccccaccgcgcctacaaggccagtggcagtttttggtgggttcccatcaactgcatgtaagttccatattttgtctaatttcctcctttcctcttggtcatacttctaccaacctttgggaattgctctggtatgcatgcactggtattccatacataactttgaccccctctttttttgtatttgtagggtttgatgttgctgatctttcagaagacgctcctgatgatgttgaggggttggatgcctcagctgcacatgttgcaaacttattatcaactgagccagctgacagtatggttcccgagttattctccatttgttcatttattgcggcataacatgatctttttaacctactttatcaagcaaatgtgacacatgagatcacatatgtttcctttgtgaatatggcgtatgacatggaaagaagctatgcaagagaattaagtaactacccagccaccagggatatcaaagctaaaactttatctcctatgtaaaactttgtcaaaaaagtgatgtactgtggagctcacacattattccccagaaacaaactaatttgacctcttatattgataatgcaacagacagaggccccgcaataatgcaacactcagaccagcctttatctctaacattgtcctatcacattgactattgcagtcaaacttggtgttggtggctttagcatgggcgcagctaccgccctttactctgcaacctgctatgctcatggaaaatacggaaatggcaatccatatcctgtgaacttaagtgtgtctgttggtctcagtggctggcttccttgtgccaggtttgtcctagtatgttcacgtgtttaggtatcactgaaatttcagccctgtaaatgatattgactgatatacttgttggttatcacaggtctttgaagaacaaaattgaaagctcacaggaggctgcacaaaaggcttcatccatacctcttttgctttgtcatggaaaaggtgcataaactgttctgtgaccttcattagtatactaagtttctgttacatgttacatttacatgtaatggcattaccaaatcagttggcattgttctaacattcaacttgaggtagtttggggtttatacttgtttcgttgctttatgctagctgaaggcataacctaatataccaggttctgagttttgacaatagcatggcactattcctaggaaagaaaggctacatgagtcttataatccacagcccaaatttgaatttggaaagttaattttaaattaatataggtgtttttttaactttttctattattcatatgacattcagatgttcacaatgtgtgctaacatctcagtgaatgggaggtcgtaattatttagtggcatatgcaaggatttttctcaccaactgtgaaaccgatatatgctctcaccatctgataggcatataaggaattactcccagaaaacaaaccatccatcctatatttagtgttttgtttcgattctatgcagctgatgatgtagttctctacaagcatggtgagaaatctgctgacgcactgaagacaactggattttcaaatgtggtgttcaagtcctacaacaggtttgatgcccctccctatttacttattgatgtaccagttctaatcacttacatgctatttgctccctcttgaagacttggacactacactgttccggaggagatggatgaagtctgcaaatggctcaccgcgaacttgggggtcagcagctcatcgtcggcttgattgaagaattgagctgtccgaataatacctgtggttgttccaaacaaaattgagaggtaaatggttgaatgaatagcgaagaacttggggcttgggtatacggccatggggtagcctggcgtgtcatcatgcggacatgcctcacggcatcttaactagaactcttataatttccacagtttgggtctttgttttgtttgtttcccttccctcttaaagcaggggacggcatcgtggtgtattatttgttttggttagcacggatgtttttgtttggtacgccgtgtgttcttccgattgggtcagttgtatgtttcctttatgagttatgagatgcattgggattttgggttcatcagctagtatgacaatgcatatatttctcatcacttgtcaatcagacgatatacgtgctcggttgtggtgaaatatcaacatgagatacgatatgtgtaactcacaccgtcgcacaaggatgagatcggataacgcagcaaaacccttatatgcgctagtgctgagaattggttggttaataatcccaaggcaaagtggtactacctccgtttatctaagtacttcccccgtttcacaatataattcccctgtttcacaatatagtcattctagcattttccacattcatattgatgtattcatatggatgtatctagattcatttaacatcaatatgaatgtgggcaatgttagaatgacttatattgtaaaatggagggagtacctccttgtatatgcacaagttgtttgaatttttcataagttaaaattctttagatttgatcaagcttatagaaaaatataacaatattttcaatgcaaaacaaataaactatcaaccgtttatataagtacctccttgtatatatacaagttgttttgaatttttcccaagttaaaattctttagattctttagatttgataagcttatagaaaaatataataatattttcaatacaaaacaaataaactatcaaaatatgttcacgttagatgtaatcaaactaaattggtggcataaatgttactatatttccttcataaacttgatcaaactttcaagaaatttgatttaaaaaggggtcaaacgacttataatatgaaacggaaggagtaaaacacaacagtccgtacatgagaccctaatcatttatagtcgcagcttagcccgaaacgatacaaggacaagtggcatttatttatcgtgaaaaagcttgtatacaactggaacagagggttattcttcttccaccatctttgacatgaaaagctcaaacgataggagaaagcaaatccatactacataaacgggaacgaaaatttggaaaggaagaatccagctcccatactgatgctaaagctcacgtgaccaaaatggcgtactattgtcatcttcatgatgattctttttgctcatgcttttgtgcaatatcgccaagcacatccttaagctgacccttctgaagaaaattatacaaaataaggaatcaactactgagttaagaattaaattgtagatggatacacctggtaataaaacctggggacaataagctcacttgcctgatgcatatctaatatgatatcagaccccccaacaaactctcctttgataaatatttgtggaaacgtaggccagttgctgcacaagcaaaatagaataagtagtgaatttgtcgaagaataaacagttacctgtttctaagaaacagctgaaaggcacatgccaatccatgtcttatatgatacactatatttcaactcaatgaaaactaagccttcagcaagtggagctccataatattgtagtatgggacacaggctggtgcctctgataatatattctggaatagaatgctgtatataaagcctcaatggtgatcaatgccaatctaatagtcaaaactcatcttgggttgtggttagcttaagccatatgatttttttagcataatcatttcttgaaactgtttttatgacctcaagttttaccacataacatcatactgtgttcatgtcatgaagaatttaatctcccagtctagttccttcccatgttgaaaaacataagttgtctatcatctaaaagaaacttaatgcaagattaggaaggcatgagaagaagccacttacgtgtgggctttgacacactctttgagcttgaggtctcccaaaatatctctagcactgatagggacatctgcaatagattatgatatatggtttaagaatttatggcgcacccacgtatcatcaactgtatttcaaacaaatcagaactcagtgttaacttaccatatagcttgaggactttaactgccaatgcactgaatccacacataggagactcaggaaaacccttcatgtagatcaagactgggttctctttgatatcctgcccaatgattgtgttgtagcattaacaaatggcagaaacacaaaatgaaacatttaagatatgcctagcctttctagaaaataagctcatctcatcaatttaaatattccaaaaatccatttataaatgttaatacctgagcaacaatgtcatcaaaagacatgttggaacttttgcttgtaggctggaaatcttgatgtgtatcaggatcagcagctactcgtgttgaacttgagtccccacttcctctagaatcaccaccaagtcctggtgagtagttcctaaactgctggatagctggttgtgacacagcctattattccggttatcatgaaaaacaagtttgttacgcaaacatgagatcaatagggaatatttattacccaggtagcataataaacaccaatagaatattgctaacattttaagtgcaaaatgatgaccccatattgcataactacgtaaaaggcaaagctatacaatttgcttgcagaaatttagcagtgaaagattagtctctaaaacattggaagtgtaagaaaacctaagaattatataccacagggatggaaggttaacaacacaggtgaaatctggaagacacaatggccagagaaccatatgcattgcaccaaattaaagcattaacatgggatcaaacctaaaccgtgagaagaatatgatacgtactacatgaaaactaaacagattgcccccacatcccattaaaacaattttgttcaccagatggaagctatgcacatatacagttttttttgaaacctatgcacatatacagttactgaataaaaccaggggttttatgaaatttactcaaaagctaatgacgcacaagacaagagggcacagcaatccatactccaaaccctagatacagcgttctcatcagataaattgggtgagcaattcacactccaaatcctagatacagtgttctcatcagataaattgggggtgcaaacgaagaccaaaacgaaattatggagtaattacattacagaatcacctcaatgaacagacaaggcagacaaaatgcaccaaactatcgattaagaggacgcggcaagagagtctcacatacagctactctcggcgcgcggctcgatctcacgagccctctcatgagagcggtcgacaccaacctcgccatgaatcccctgcagcaacaacaacgaagaaaaatgttaaatcaaacgcatgaacccccctcgatctaccaaaaaaagggcacaaaaatcaactcccatccccattcccacccacagcgaacccgcagctacggtgtgaaggttgcaacgagtacctaggcagcggcggagcggagccctacggtggtcggaggagccgccggcgatggccggaggagggtagggagagcacgccgccgccgcgccgccggatatgctcgtgccaacgctggtttgctgttttgatcacggcaactgcttctgttctagtacattgggcctcaaaagcccaaaagttttaggcccaaatctaggcctaccaacggcccaaatcgaggccgaattttagcccatgttgaggcctactgaaactactccggatttgtctcgggcttcgtcggatcggcggcgaggctgcttccttccccggcgccggtgtcggtgaggcggcgaggaggaggccggccggcgcggtcaggtctcgcgcgacggggcattttccctctacctgcggtctccgcctccttcaggtgttcaggttcgtgctctgctctggccggcgcgcgtagtgtttctgtggccttgccgcctccgctgctctgcatcgcgtgtaatcccggcgatgttggtatcgatttgatgctggatgaggcgagggggggaagggttgccgtccgcctctcccggcgactgcggtggccggccgtggcggtgtgatccatgggccgccattggtgtgcctcacagtcacaactcacaagtacagtttatatattcaggagtatcatcgagaagctgctatattgcgcttgattgtctttgttgtgtagctgtcagcagttgtattagtctatcatcgggaagatttctgattccgtattgtattagttggggtgattcgaacgaggaggtgataataattgtttttttttttcaggttaaagggtggttatgcctcatattttaaaatggagggagtatgaaactactagtgttccaattactaacagcctgaacctaactgttacagtgggatgcacacagcacataggttatatagattggtagattagacagggcggaacactattctttttaacggagtgtgattagtttacatctctttgagtgctgtaactgggatttcttatgtggtttccacatgagacggttgtggagagtagaggccatgtagtttcaatttttaactgctgcttctctagtctaaaaaagtgtttcctatgacgaaggaattatacttcatgctttttatgaatgattgttcttagttctatagcattcccagttttaagtgtatcatacaaagatttcagctatgagttcacaaatttattagagctgcagcttgtcagtacatatatatgaaaaatcgccgccaaatgaacattgctggtctttacacaacagttttgttgaaaatgatacacatgcagacatgctccaccatcttgtatttagtgtgctggtctcgtgttacatttgcatttggttgattgctgatgcactcggtttctacctaagtgcattcctttgtttcttgcaggctaatggatttaggtaaaacttaggccaattatccttttctattgatttagtaagaattacttgttactatatcatcgacaatttccattcagcaagagataacgtagggcatgcttgcaaagcctgatttgcaatttccattcctttgtctggaatgcagccacattggacctttttcttgcatatattgaataccgttagcagtgttcatttactaagtactgctatttatcattgtgaatatatcgtaagggatgttgtttttgcatatttgcactacagtgctatctgtgtttggtttaggttcaggccttcaggggatgagtataataaaaattctgcaggggggcacacaaaagctttgcatgtcattccattagagtagaaataaagttgattacacaacaagaaaactgggagcatacaggctccaaagaatttagtttttaaaaaggatttagatcttgcataatggtttgcacttcgacgacccagtgcccctccaaactctgagttcttggaagttcttggagcatgttctcgagaacctgctgtattggtgacatcttgtttctcaaaaccgcgtgcattgagctccttccacattgtccactctaatgagagtacatgggtggggtcctattcattcttctatacctcttggaggacagaatatgcaaattaacgagaagacatgcatttgtttgcggagaaggcgagaactgaattaacttataaaaaaaatgtgttaatcacccaagctcaagagatgcgttaagtgatattattactctaaccttgaccaaatgggacctcagggtaggagcactggatattatatgagttgtaggcaaagcaagtctctaaacctgtttgcaattgagacattttccttctgtggaccaccgacccagacaaagtcggaaatgtggtactaagtgaacactgatgttcacgggctacagcactggtccatgacagaatgattctaattattcaagtctttttgcaaataactgttgtgcatcactaaaaacaaactttatgcactgttaacctgggacctgcttgctcaagctgtcaataatcacatacatttttccatttcattttaagagaacaatcatccatgctgttatactaatacaggtgaacggtggcaggcaagccacgatcaaataaccatcctgaatgcgaggtttagtctatatcactatcctgttgattagacgcctcctatggatattcccttctattattgtcttgttaccttttgtttgtggacctgcagtgaggccattcctttctccagctcttctccaagccatgggtaatggtatctggctgtctacagtgttggtataattgcgggaaacaaaactttttcaccccgatcagaaccttttttgaattggtctcgtttggcaatgattccaatgtgctatgctttacagtaagaacccttttcttcttggtgctacccaatggtttcggtctccaaggtaaaaggtagcactagatagtgatccactgctatggtactgtatattctgcataatgtcattgtgctttttttggataatacaatattagttgaagtgctgaacagtatcttgcaagcttatattatgtcataactgcaaggtttgcattgttccaatccatgcacaatgcccttgaatagcttggctcattttaaaactgtggaatcactaggttggcttggtttgttacaaatagagcttgagttttcatgttcattttcttcttgttttgtttaaactttttttccacgtacaagactacaagtatgcatagtttagttcatctccttaacacttgaactattcttgatatggtgaagtgttaaattgctacctgtgctttactggttactgcttcttatctttggtcgactctattcaaaccaaccgagtaacattatgcagggatctacatgtatttgcagcacataattaagagtttttgtggcttctgatacatacataatcttgttagctgcacccctgctcctcgtaactacgtaaattaagtatgatctgatatgtttgcaatcgcaatgcattttctgcaaagtgactgggcaggatctgccatcgagatatgtgggctttgaatgttcccacagttccacttgcaaatgtcttagtgaatcctgctagacaggattgtacaaaacattgacctgatatgacgaaaatatgacatatggcccttgtgcttgtactggcagtagcaaaaacacactataaaaaggcatagaaaatctgggcaaatgaaacatcatggtccctgactccctgtacgctatatgggagtagaagtatagagaactgaactaccactaccactactacttacctctgtctgacttgacatttgaactttttcctggtacatatactcttttgttctcatctgactgtcttgtttctcgcaggtgcatataggtcatatcaaagcttttgctgcttgctccaatatcacctccaaagaaactgcttgatgcaagaatcagcactagcaatggttcaaaggggacatttgttagcacttagcacgaacaagacatgacctgatgctgttcatgttcttgcctttctgttaacttcaggcaaacagctgatgaacagaggcttaggcaggcaaggcagcatctaaggcatgggagaaacagatggaaggaaggcagctgatatgtacagtgcgacgtggccactaaatggactcacatgaggtgattatcccttgaagcaggtatgcaccaaaagagagagatgaaaaaggagaagcatctcctttagtttcagtttggcgttaccgcctgcacgggcgatgcatgcagtgcttgtaactttcaactgcaaagctttacttatctccttctttctttaataccaaagcaaacctacttgcccttggctcctcttcatgtgactccatccaggcataaagcaaagtgtcaccatgcttacacttcactgtgcatagcatgattccatttcccctctagtttctgttctgttatttatacatatatactacacttttacccatgtaatacttactgctttggctttcacttggtgcagctgcttgtggacactgagccaggtagttccaactatccttgggggtccaatgatgtaatgattgtttgcacataatcatccatccaagtggagaaaaaaaaaggtgacaatcaaaactctagatcctggagaatagttagtatatacttggcaagcagatactactctacagtagaaaagctgggctgtgtggctttatagtcttttgagctcttgccaccatgccgggaaactattctaatccctcgaggggatgttccctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagtgtactgtttatatctaaatttgtcttttttgtttctcgatgtgtagatcgaatttgaacatgaattttggtggactagtaggtatcattatactctacattgtcaatttttttcagattttttcacaactatttgcatcgaatttagaagaaaaaggtatacgaggggatatccctcgagggattagaatccactcccccaccatgccatccattctctcaaggtcacaacagctgcttatatagcaaagaagagagctggaagagctagtagctagcaagcctccttatttttgcacttgcaaactgcattgtttcacttgtctgcagctagtttcaatggctgccatcaaagaggaatccgactacgacagtagccggtcttcgctgacggcgccggactcccgccggagctggatcagtgacattggtagctccagctcggtctcggcgcgctccttcggcggcgacacaccggcgtcgtcatgccggtacaagccccacaaggcgaaccaggccgagtgggaggccatccggcgcctccgtgccggcgccggccgcgtcgggctggagcacttccggctcgtccgccgcctcggcagcggcgacctcggcaacgtctacctgtgccggctgcgcgagccgtggtcatcgtcgtcgatgacgacgacggcgggcggttgcctctacgccatgaaggtggtggacaaggacgcgctggcgttcaggaagaagctccggcgcgcggaggtggagcgcgacatcctccgcaccctcgaccaccccttcctgcctacattgtacgccgacttcgaggcgtcgcactacgcctgcctcgtcatggagttctgccccggcggcgacctccacgtcgcccgccagcgccagcccggccgccgcttcaccgtctcctccaccaggttcgtactcgtacacctccacacccacgtcgaacgtgtgaatgcatgcgtgcccccacccatgacccattcatgtttagttactgctccactagcctttttctttgttttaccactactactactgtggtctgaatgaatgtatctgatgatctgaagagtgggggagaaatgctctgttccagggtcaagctttgtttcagtgtcacttttgcaaaagcttagacctcagctttaggttagtgatcgtctttccatgttgcattggggctttcatccaaatcctttttgtcttgctgtgccaatctaaacagatttgttggcaccacttggggttcatactaagctaatgatttagtaagatttaaacccaaaccattgtgcagcttaagcttttgatactcacaagagggggaaaaaagagagaagagaatcttggggttattagcattcctagtctcttactgtggatggattatctttgtcggacagtgaactgatgttgctgaaaacgaattaacattgtgttgtgtatggcaggttctatgtggcggagactgtgctggcgctggagtacctgcacatgatgggtgtggtgtacagggacctcaagccggagaacgtcctggtccgcggcgacggccacatcatgctctccgacttcgacctctccctcaagtgcgacgtcgtcccgaagctgctccgccccgccaggagcgccgccgccggtggcaagccgccgctgccgccgccgtcgtcgtgcgtgccgccgacgatccagccggtgctgtcgtgcatcttccgcggcgtgcacaagtgccatcacgccaaggagtgcgccggtggcggcgcggcggcgggtaacaatggcgacggcgacggcaacgacgaggaggcggagaccgagacggcggagcccgaggtggtggtggtggagccggtggcggcgcggtccaagtcgttcgtgggcacgcacgagtacctggcgccggaggtgatctccggccagggccacggcagcgcggtggactggtggacgctcggcgtgttcatgtacgagatgctgtacggccggacgccgttcaagggcgagagcaacgagaagaccctcatcaacatcatcaagcagccggtcaccttccctcgcctcgccggcgccgccgccgccggcgaatgggaggagatgaagacggcgcaggacctgatgttgcagctcctggcaaagaaccccaagaagcggctggggagcaccatgggctccgccgaggtgaagcggcaccccttcttcaagggcgtcaactgggcgctcgtcaggtccgtccggccgccggaggttcctgcgccgccggcgccggcgccgaagaaggtgatgacgatgagcaagaaggagcggcaagagccgtacaactaccgaccggaaaaccacttcgattacttctgatcaagtagctgccatgcatgagcatgatgcatgatgcatcttggttaattaattaattaatcacttgtaagaggggagattagtagtgtacatagagtgctaatcaatgagtaaccagtgttagtttctcagtgagtgagtgagtggcaggcggccatgggtggtgggggtctgcatgcttgctctcatggcgcggttgcgcacgcgcggttcgtcactgggttgggctagtcggctacccgtgcgcggcagacacgagcccccaccagttccgtcggtcgatcgatcgatcggtgaagcagcagctttgtttgcgtggccccggacaccgtgcgcgcatctcccagccgatctcgctgctgcgcctgcgcgcaatttcttgtgccgcctttcgcggaaataaagccagccccctccccgcgaagtgtctaagtaacttatcctaaaatataacaactttttctaaaatataataacttttgacttatcttgtcctaaaatataacaacttttagctaagtgtccaaatttataggtaaaaatgcttatattttgggacagaacgagtatactctatactcatcatggaaaatgtcaagcatgtctgttcttaggccgcccaggctagtcgacgaaaactccgttaaattttaatactgacgagtaaatcgataataaaatttaaatttttatagtaaatactagttatattgaaatttgctcatgcttaaaaaattttcgggtaggcttttttcccctaaaaccaagtgcaaacgttgctcatttgttcacatttatctctataaatatacactcactatctatataattgtacacatgcaatgcacatcttatctctctggcctccgtaaaagattagactgaacggcttattattaataggtatatagcatgtcgctaaaaagaatcattaaccataaatataactactcggaacataaccagctgagtgtcagctagccatacaatttatgttcaacggtgccaatgatggcaatgctaaattttgctataaaattgaaaatgcgaacttgaatttcgatctatggaagcaattttgccaatagtttaagaggtcactaatggccaaagttgtaaacagttctgatgacaagtaaataggtaaggagagtagctaaaaataatagtgatgttcaaagtattaaaaagaatcaactcgaaacacatccaagatggattttggtggacaaaatgaatatatatatataggcacgtaatccatccgtcccataatataaggattttaaatttttttgcttgtattgtttgaccactcatcttattcaaaaaaatttaaaattattatttatttttttacttactttattatccagtactttaagcacaactttttgttttttatatttgtacaaatttttttgaataagatgaatgatcaaatagtgaaaataaaaagtcaaaataccttatattatggtacggaggaagtataagtgtcatggtgggtcagagctagcgagaatgctgtggtttgattgactgattagttagcacgatctaaccaacaaaccacgtctcacgactgacagctactagtagtaccaccaatttaccgaacgaaaacgcaatacagaaatggacacacacacaccggaattaatgaaatcatgaatgctcaggggttgaaatagccaggtgcattgcatatatagtcgccggagtttcgccgtccgtacgccgtcgtcttcgctcaacagtcagcaaactggagtagcagccgcagcagcagcacaagctctcggacatactccctccgtttcattttaagtgcaattaagttttcgtgtccaattttaatcgtctgtcttatttaattttttataattagtatttttgttattatgagataataaaatttaaataatactttacatatggcttatgtttttcaatttttttaaaaaaatttaaataagaagaacggtcaaaattatgcatggaaaataatgactgcgcttaaaatggagtatgatgcctccttcgctttgtctccaccctctcggagccacctgatccgtcacgtcgatcgcccacgaaactgcctagcttaccatgtgcatgcgtagccatcgaccggtcactcgctcgtgtagcatatacgtgcgttgatgtgatctctcacccgatccatcggtgtcggtagactggactggtagtagtagactattcttccttcgattcgattagacaaatcggatgaaatgataaaatcactcacgtgtgattctctttttgatggttatactcacgtgtgagtgtgattcgcttaattaagaaaatatgaactatatttagctcaatatggacgacatgatgaggatggagtagttgatgatcgattattagtagtagtatagattgagctagctccatacatattggagtacgatatgattcgatggcgtatatacaaaccatgacatggatatatatgatgcatgcatgtaaatgtggttgttcgctgattgagatatcaatcacaccattcgcagttctctttcatcaagttaatgccctacgttcgaaagcattatttttgcgtgtttttgtaaaatatatttggacagaagtgtgtctagataaattttgaaaaaatatacataaatgcctagggtttatttgattcggtggaatttgaatccatatgaataggaaaaatggagaaataacattgtttgcacacatcaatctagagaaatttttccaagaggcttgagtacatatgttaatttcttgtgggaaaataatttttcctttgatttttctatactttaatcctacaaaccgaatgatactcaatggaattaatccttagtgatcaaatcctcagtttttcctcaaaaaacgaacgagctcttgtagtgtttcgtagcggatgtagtagcatgtgtgctactccagtccggtatgctgtgtttgttttggtcatggcgagaatcaaagagctttgcaactccttttcctcagctgcattattgtatattggtagttctatctcgatctccatgcgcatgcatgattcgctgcacgcatgtgagaagactgtgagagggcactgcactgccccgaatgatgatgaacggctacggaacggatcatcatgagcttctcctcctgcacccctacctcccatcattgctcaacgtgctacactaatcaaggcccatgaaatcctaggcccaagattctagaaaacccacctctccggcccatcaaaatacccagctcttcggcccaagataagaactatctaagcccatgtcgccgccgcggcggcggcccagctcgtcggaggcggtccaagagctcgagagagaggcagcccagctcgccgcgcggcggaggcggaagcgagcgtcacgttgcccacgcgatcgattcgatcgacgagaggagagagcacgagaaggagcaaaggagcaaccgtttattgcaccttcactgcgtggagtactggagcgtatgaatccgcccccaaatggtgccaaatcgcagccggtggatcgaccg

SEQ ID NO: 64867 - DNA, 9064 bp, Oryza sativa
ttgccatggccgcccggccggcttgatgccgggcctggccggtacatcggctcgtggagccggagccgtggggcccgcttgccagccgtgcccccccccttgagccgctgccgagtgggcccgtgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgtttaagtccattcaagtctcagtaaatcaagaaaaatgtgtagaatccattaaaaatggttttgtttcctgtttcagtagtcttatagcatgttttgcttgtgtgctttgtttgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcccttattacacgaatacaaggcactgccttaaacaaaaagggaaggtgcttatcattggtacattgtatcctcaacatgaatcatccctaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccgaagaaggaagaagggagtaaaccttttgcaaatagcattaggggaaggagaaaaaaaaggaactttcgcaaatagttttatttataaaatatgtccttaggttttatccacttggcttatcctacagtcgagatggctctgataccatcttgtcgcgaccgggaaaattgccttttcccgaacaccagtgtattaatccccgtcccaggaaaagccgggtacaccacacaaacatggtataaaagacacatctttattatatcgataatatttacattattacaaaggtacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgtgattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagcgaaaggggcggtccacggttcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgagaaaggcgatgacaggtgggccccacccgtcagcgagggtggcgggcgggcccgcctgtcagcggcgcgcgcgcgggggaggggccgagtgggccgcggggaggagagagagggaaagagcgaggtgggccgagccggcccaagagaggaagggggggaaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaa

SEQ ID NO: 64868 - DNA, 39492 bp, Oryza sativa
  unsure (1)..(39492): unsure at all n locations
tttctaaggatgctaacgggaagaatgaggttcatccagaacctgttaagtatggaagaattgtctctttcggtaaagatgtagcagaggctccatcttcagaaattgagcagatagaatttcgtgtgagtatccaaaagtatattagcattttctttacttactgaccatcatttttttgcttatcactattttgctagatgtgtagtattttctcgtgctacttatcaatgcatctggcagtttgctctagctctttcagcagtcttgtatgcgatatgtactattcatttatgtaacttcccccctcatttagtgataattgcttttatcattatggttggtactcttttcccgtgtagctggtgcagctatttcacatctatttgcaggtaaaattaactaatatcagggccactcttttgcctacatattatttgaaaacgagtccaaagaaaattgttcccgtcattctgtatttgagctgcactgcatgcctgcacatgtgttaggattttctagcttttacttgtttatgtaattatgtgcctttgttctcttggttttatgcacttatgcagccccattttgattgtttcaattcaccgttcaataattttaggttcaattatgctacataatgctctatgtagaatggtttcttttctttaatatgttatgtatggtttggacattaattttctgaggatggggttgtaagcgtttatgattatagcaaaaccttaacgctatgcttgtttcagatgctgtcaaaggcaataatattgcccactcaaatacatcatgccgggatatatggacagagtatcatgaattaggatggggcggaataaagcagttgcagactaaggtttcctgctgctggctccataatagatctttcttcgttttgttgctccaaggatgatgcagcgtggaagtgttcacttttcgtatgggattgctgacaacttggatgatccaaagtacggccactacaaatactggtcaaatcccttggaaacaaagtaagagtcttttgccaacattctcatctcattctagtatgttctgtttcttgtgaaacatgtgatttaggtttatgtggaacatgtagttttggaatgtaaagtatataattttctggcctctgcaccaagtgagatgcacacatccattacaccaccaagctaaatgacaaacgtgtttattgtgaatcaagtacatttttttctatctgatattctgttcaacttttttcatacgccttataatcctttcatttgcagattaccaaatgcacctgaaatggaaatattttcaacgtatggagttggcattccgacggaaagagcatatgtctataaattagccccacaagcagagtgctatataccttttcagatagacgcttcagctgagggtggggatgagaataagctgtttgaaaggcggggtttacctgtttaatggtgatgagaccggaccagtttttagtgcaggatatatgtgggcaaaaggctggggaggaaaaacagcttcaacccttctggcagcaagacctacgtcagagaatcagccattttccaccctcaaatctcctcgaaggcaagggcacccagagtgggcgcacgttgatatcatggggaattttgctttaatcgaggatattatcaggattgctgctggggcaactggtgaagagcttggcggtgaccaggtttattccgatatattcaaatggtctgataagattaaattgaaactataaaactttaaaaaagcatggtagttttgtaggagaattatttgtttcctggccaaaattttatgagttttgattcgatattgtaatatgattttttttacctttcccttaagctcttaattcagtagaggctgacttgatttgtattattttgtgatttgagcggcattgtatattaaaatgtacagatgtattcatgggaattgtgttacgatttgaagttgagtactccccacattacaaaatatcaggcatatttgctctttacacggtattaagtactatgttaaccactccttccgttctaaaatgttgtaacctaagtaaagataaaattagattcattcagtacaatgaatgttcaaattcattgtaatagggtgcgttatattaggttgtaacattttgagacggaggaagtaacctttttttactatcaactactcactctcaaaatagtatattttgtctcttaatatagcaaccttagtataggacatgacactattataaatttggataagcctcttatttagatttatagtattacaatgtttcatgtctcgtattggattgttatattatgggacaggagagtaacatatggtggcgcgcacacctttaaaatacaaattgagcggcaattctagaatacagatggagacatctaataaggggctaaactgtactcgctggctcatggcactggcgtgccggtgcaccgcacaaacatcgagcaagttaacacctaagattaacaaatgaacaatgtcagagtcaaatatgcgagggagtgagcttagttatgaagatgagacaacaatggatgctagcttcagccttcatgtgtagaattagggataaaaatggttgaacacaaaatcatttatttaaaaaaaatacaggcatttgggaattttcatatttaaagaaatccactttacttgactggactattccattggattaactctaaaatatttttttcttatttcatccctaaactaaaaatggttcgttttactacttaacaacatttgtcttctttatttttctctatacgaatcgtattataagtagaatttttttaagccataaatgacatcattatcaaatttcaaaacatttttaaattagtgcttccaacctatataagcactgatattttttcaaataaaatgttaagaggtaggttataatggatctaccaatcaaaaaaaatcagtgcaaatacaaattatatggagagataaaaaaataagcaatattgctagggaataaggtgaaccactttaaatagctcggctgctcgggggtgcaaaatgagcccaaaaaaaattagagtgttatgtgctctgcccaactaattcaagggagtaaaatgaactttatttatatgaaaaaatttgctgcaagacacccaaagtttatgctatttactgaaggatacagcaagaacacacttttgttagagagctccgcaaaaaagtggtatttggatgttggacacccgtaatattgttttattatatctagaagaaatggagagagaaacatccgcgaaagtacggatataccctctctccatctgttaacgatcacagttaattcacatctctacataatccacaccacagttaatccacatctgaatctatatcacggttaatccacagccattcatcagtcgagttgaaagcagttggcccatagagaaacttgtctttaatgaatatttctttatccatttcttttggatataataaataataccgtaggtgtttcataagccaattaccatttttttaaggtgcccttcaatagaaatgtattttccggtgtcctctagcaaagagcgtaaactttgggtgtcctatcaccaaatttacctttttatatttataattaaccaattcaactattcagtgtatactataatatggtgctaaaggcatagcaaaaggtcaaacttaatgttcggtcaaaatggcaccattatatagaactaatatttatttggtcacgaatttccagaaatgtttccataagtagatctgatggtttgatagtaggctgatggcaaatgtactcgatataggactaggaataaggtctgggggtgtgagagtctgaccctcacaacatacggacttatcttccaaaatatagcaacctggtatggtgctaggttgcaatattttgtggcggagggaataacaaataaacatcatcatatgaaaatattttcaaacactaaataatgttagtacatacatgacaccaaacacatatttttaagtttaataatcagttgaagttttcaaatgttaactttgtggaaggcaaggagaccttacattttaaaacagatggagtttctttttaagaaattagatgcgtggaaaacaattttgtaagaaattggcgatggaatttaaattcgtataattattgtaatgttggtaacaggtttcacataaatttgtagtataaatgtatgtaatagatagatattcataatgaatatgtggttccgattacaataaattaagtagataagtacatagaatgcccatttatgagtactttgctatgcatgctttattataactaggtaaatacatacatagcctatgcatgagttttttttccatacatgtttagccgccgtcaatgttttccttgttaccctccatctcttcatcatcgtctttctcatcagctcaaaggctttagtaaacccttgaattttctttgccaaggtttcaaatttttgtggaacacattgtggcaaatttccacccagggacaagggagcaatggtaggaaggggactggagggaaggaggccaaggggaggaatggaaagggaggtgaagggaggagtggatgggcttggaggggaggagcgccatggccgccatggatggagctctcacaggccccgtgcgtttgggagtttaggtggaggtggtggtccaaaaattttatgagttttgaatcgatattgttgtgtacttttttcacttcccctcatctcttaattcagtagaagttgacgtgatttgtattattttacaacttgagcgcactacaacaacaccctcatgtagaggcacttttgtagaggtgttttgtaaatttcctctaaaattaggagctttatagtgtatagacactttttagaggcattttaaaaattgcctaaaaaacttttactctagagacactttaaagacattttcaacatattttattaaattttatcttgtagatgcattctttcggtattttctgaatgtgcctggtttgcaaaggcattttcttgaggcattatttactctataaagacttgttagaatgcaatgtattactaattaagggactaaatataagtaacacaagtcacaaacctacaaggaatcgcatgtggttgagttgattagtgcattgaagatacaaatgatttgcccaatagatcttaagttcaaggattggcaatatcaagggaaaatattttattatatttttttcccgtttcatatgttcgtggtacaatttaatgtctctaggaaatacctctactgtcttcattgggggtaaattaaaagtgactgcgctcctcccacagcgatttagccaatttcagggcagcgtattcgactccgccgctatccacgtcgcccgcgctccctcccgcacgcgatgtggggtctgctgtgggcccgcgtgcgcgcttcccgcgcgttgcctccgcgttttcccgcgatcgtgcgctcttcttgtggctgcttgcgtgggctgcccagcgagcaaggcgcgctggcgttcatctgattttcacgctcacagagcaagcaagcgaggcccaatcaacgacgacgctgtggcagacaagtcatatcacctctcgcttgttttatacaatgtcttttgtttgtagagaaaattcatttggaaagtgcctctatagtgtccaagacacttattagatattttttttcatttggaaagtgcctctatagtgtccaagacactttttttttactgtaatgtccaagacacttattaggcatttttgaaaatgcctctacagacatttgaaaagtgtctatactattagaaaaatgtttgtacaaaacattttcttagtgacggcagtatatattaaaatggacttgaaattggcattgtcgcataaatcatgtaatgttaaataaaggatatcatgtttctaactataatctaaaatcatagcacaattgcatataatagattcctgtagtattcaaatgaacagatatggtggttctaattacaaataagcaataagaaatagatagcccatgataagtatttccccaacacgcttaggattacaaattaagtagatagatagctcctccacgatttcccttgcgtgtttagttctcatcactgttctcatcatcgttatcctccatcacctcatcgttgtcttcgtcgtcttcaatgtcgatgccatcgtccgcttccggtaggctatgcacaatctcgtctatgccttgcaattgctccagcatacttgacattattttttttggtaaaattgttccttttccttgcggagcttgaaagctttagtaactccctgaactttgccaagattccactcagtgatccgtttcttcaaattgttgttgaacttgttctccaatctagcgatctgaagacataagcaaaaatgttataagcttttgaactagcatgtggttcgaaccttacaagaaatgcaattgtatataaattgaaaaatatgtagaattcaaatgcatatgcatcatataacctatctatatggccatatattcaagtcattagccttgcagaggttttgcagagcagttgtgccaacactcagaccaatatgagcagcacttttttgttttatgtgaaagtaggattccaagtccttcttcgtcaatgtcttaactcgtttgcgctgttaaactaaaacatgttagcacaagaaaaaaaactgaaggaaaccatgcatgatctgtactatattttccctggctaacacagtagacctgatcagggaaagtaaacatcttcctcttgtcagtagctgctgtttggtcagtttgcacaagagaagtggctcatttaccaaggaagaattactttccactgtaggagctttgccatgttgatttttcttgggagcaggtggtaaaatggccaaagatctaggcacatctcccccaggatgtcctttgggcacaccatatatgactactcacaaatgaaagtatcattgcatgtatacatgtgattagtttgataaacaaatgttaatatccatagaaaatataaacgaaaatacccatataattttatggagaaagagagaaagagagatcgatcaattaatcgataccattttggccggagtcatagaagactcctcgccattggaagttctcctttaatagaatgaccagcttaacatatctctttattaattggaaatgaatgggcagcaacatagaacccatcccaagaaccctcaaaccagtatttaccccgaagaacatggttccacaacgtatttagtagcggatccacttttccttatctattaatgagactatagctttcttttgcctatgagctagctaaagatccatcgttatcccttccaacaagggaggcggaatcaatggtcatgtcaggtttcatattcaaagagagatgtcaagcaagcgccgaatccgtgtactcaacttgcccgacccgcttcttccactagacctcgtctttcaaagagcagcagccctgcaagcctaatagaaccttgtttcctgggccaagtcagcctataagtaagtaagtagggctgaagactatctgtttgttagtttttcaatcttcttccttctatgcttagagtaagtggaaatgacatccttgatcagcaagtaagcaagcggtagtttagtctccgacaagtgaggccgaactagcccctagatcagttctcatagtgggggaatcagagtcaagttaggcacagaagagggggttgacatcattcgtcgtgattggatcaatcaaactactccacaagaaatgccaagggactccctttctcatcgcccatttcttcctcatctgttgctgccttgagtgcataaagtaggctcaacttctttggtttctaaagatcttgtagtagccgaaggcaaaccagtctgcttgttagattgaattgaattttatataacctatgcagctaaagaaaaaaaaatcataatggtctaagtggacctctcaaaggtataaataattaactaaataagtatacattagtcttactagttcggtctttttctttttctttttgttatgatgcccacatttcatacttctcaattcttatttagtaggtatacatgtgattagtttgatagataaacgttaataaccatagataatataaaggaaaatacccatatgattttatggagaaagagatatcgatcgattaattgataccattctggtcggagtcgtagaggactcctgttgtatccattcggaacgaagtgtaccagtcattaagcatttcagcttgcaactctggggtttctcctgacacactgcatgcattgatgcatgcgtacgtgcatatgttcagaagagggaggaacatgagttagctatcgatctcagctgaacatttgtttgtaaaaatgagtgctgagagggaagttggtgtacgtacttgatgcggtaggttgattgcacggaagcctcggcatcgggcgagttgttctgcaccaggatgtgatccaactttcccgtcctcgccggcgtgcaggacgacgaccatcttccggtgatctggccatcaacagcgaccaaggattaatcaagaaacatggcgagcgagagatggattaccacttcgcacatctacgtacgttaacatggatcagttagaagcaaaaggtaaagcaagaccaggaccaggaccagggttttcaatttcgaaattggattttatgcgcggggggggggggggggggatttcggaaaattctagcaaatttatttgaaaatttgactgaatttgaataaaatttgaccaaattcacaagaaaatgcaaaaaaggggaaattttgggcgaggtttgagtatgctggggggggggattttcggaattttcgaaccaaaatttcaaaccctgccaaggatcgattcaaaaagaatggcgagcagagatgtatatatcactttgcacgtacaccatgacatggattagaagcaaaaggtaagtaagaacaagatcccaaggatcgattcaagaaacacggcgagggagagagatcgatttcatcgcgtatagctatagggatcgatgacgtcgaacgtaccgttgacatggatcagcacgcgtagctgcctgcatctcttcctcaggcactcgatggatcccaggggcaccatcgggagcttccggatccggcgccaccgccggcggtaacaccatcgctcgggacgttcgatgatgtactacaatgatgcgccagttgccatcgatctcgcaacgtggtgaggggagagaacgaacaaagggaaatgatctaagagagcgcgaacggactgtgcttatgtgtgtggcggcggctgtggaggaattggggaggatagagacaccgacgggcttaaataggtggggattaagtgggtggcagcgccgtgtgagcgcgtccgctcaggcagccttccgctcgctctgcacgtgtgttggcgcgttgcgggttttcccaaattttcatcgagcacgcgacgacacacgttcgaacgattagtgcattgaagacacaagtaatgacatgaggttgagttgattagtgcattgaagacacatatgatttgcccaagagatcttgagttcaaggattggcaataccaagggaaaatattttattctatttttcacattggtttcatatgtttgtggtataatttaatgtctctagaaaaatatctctaccgtcttatagatatttgataaaatgtatctttgtttgtagagacaattcatttgaaaagtgtctctatagtgtccaagacacttattagccatttttttcatttggaagtgcctctatagtgtccaagacacttattaggtatttttgaaaatgcctctacagacatttgaaaagtgtctctatactattagaaaaatgtctctaaaaaaatagtggtggcaatatatattaaaatggacttgaaattggcgttgtcgcataaatcatgtaatgttaaataaatgatatcatgtttctaactagaatctgaattcgtagcacaactgcatataatagattcttgtagtattggttctgattacaaataataaataagaaatagataaatattttcccaacattcttaggattacaaatttagtagtacatagatctccacaatttccctagcatgtttagtactagttctcatcactgttgtcatcatcgttatcctcgatcacatcatcattgtcttcatcgtcttcaatgtcgatgtcatcgtctgcttctggtaggctattcacaatctcgtctatactttgcaattgctccggcatacttgacattattttttggtaaaattcttccttttccttgcggagcttgaaagctttagtaacaccctgaaccgctttgccaagattccacccagtgatctgtttcttcaaattgttgttgaacttgttgtccaaactagcgatctgaagacatgaggaaaatgttaaaaacttttgaactaccatgtggtttgaaccttacaagaaatgcaattgtatataaattgagaaatatgtagaattcacatgcatatgcatcatataacctgtctatatggccatctgggcaagtcattagccctgcagaggtttttgagtgcagttgtgccaatacttagaccaatatgagcagcacttttttgtgtgatgtggaagtaggattccaagtccttctttgtcattgtcttaactcgtttgcgctgttaaattaaaacatgttagcataagaaaagactaaaggaaaccatgatatgtacaatatttttccttgctaacacagtatacctgatcagggaaagtaaacttctttctcttgccaatagctgctggttggtcagtttgcacaaggagaagtggctcttctaccaaggaagaattactttccgttgcaggagctttgccatgttgatttttcttgggagcaggtggtaaaatggccagagatcttggcacatctcccccaggatgtcctctcggcacaccatatatgactacacacaaatgaaagcatcatcatatgttacatgcgattagtttgatagacaaacgttaatagccatagataatatttctaaagctggcagtttactgcaagcttattggtccctaattagttcccctctaattgtttgacacatatccctaaaccattggtgagtaaaaaaatctaaaaaagtccagccaactaataccattaggtgcaccatgttcacaataaatatcatttttttctcggtgatttttacttttgagagggccgtggtgatttctagatgaaacgtaatacgtgagtatacagtactacttgtaggttgcagatgtagttgatggagttcaccagcatggcccacagaaaagtagaaggcaacaaaaatatatggcctggtctaaaatataaacaatatagtgtgggttagaaatatatgagcactaatgatagatttgtgatttatattacctttggggtatttttctgcaagtgttaaaaatcatgtattatataattcaattcagtagacaattcaattatagttttacacaaacaaaggagccttaaacagtttggatgtggaaaatagtggaaaacagtttggatgtggaaactagtatattatgtcacgctttcgcgcgactatgacctatcacttaatttattaaatatattaaatgtatttacataccgtttacatatatagtaattagataaaaaatataataaaaattaacaatgtaaacatggaacatggctaaggaaagacggaaagtcaagaaaataaatttagcaggaagtatagttagaatgaaaattttattctctttattattacatgaaaaacacgtgtgagcacatatcactacactacacacccttaagataaacttaaagagatggtttcaattcaaaatgtactcgtatccgcatatgtgtagtattcatggtaccaagatttgaatcctggtagtaactagagtcatgcatcccaccgccacactaccggtgtttctttataaatatatttatttgatttttaaacaatattattatgacaaagaaaacatttaaggtaatttcatgcaaacttttcatttacattttaaagtaaaataaaaatcaattaaatttatatagttgctaaatatttgtcaagggaaagtgggggagggataaaatttgccatgcgcgcatgggaatcgaacccccaacgtcccattcacatgccatcctcgctaatcacatgtgccctcatgtgttttttataattatttgaaatttttgtataagttatttcattacaattgcactcaagttttggatggattttccatcaaaagttgtatagctggtcccttagttttattattatttttcatcgttttcatcactgccttcacaccatactctccactgcatgacccacttatcctccatttatattcctttggcgctcccattatataggacgtgcatgtacattttgcatgtaaaatttaagctgataattaagtttaccatcaccaaagaaataaaaggatgaattagggtcaatcaaattcagcttaggataactcattaaaataatttgtcatgtaggtgttcgtagttaattgccagatgcaaaactaattgcattaaatgaaaaaacaatcctaaactgtgcatatttgaggaatgcaccttgacccctttctacaataaaataattttaactgtttttaaatttattttttcatgtttatttacaataatacagatcaattacaatgtgcggcattgctgtgtgtaatatttgttatatcatactttaatttagcgctaaaatgtgtttttagttggaaaacgaatatttaggctgggactttcacaacaatggcctagtaaatatccaagaggatatgtggaagactcttgaagactcttgacttttcaccactcctttatagttttaccgggacttctctagatctaacgacaggtagtagccacgtactatatgttttgttgcatcctatgatccatatttttctgatgatgtggcctaacgaagttgcaatttaggtttcacttttcacgtatagagatacaaattatttcgggtttaattcaaaactagattctgcaaattgcgtggtgctaaattttaaaagaaatatatttgatatacaacacttcaattctatttacataaatacaattgtatttcctaaccaatagagttttaaaatatgattggatttcatatacaattgctagcctttgtttctatagctacaattttattttgtatctatgccattataatatagatccatcacgatctagggcgtcatcgtttggcatattcatatgcttatcagccaaaatttgaattttcaacgttaaatttggagctgattttggggttttttcatcgaagtttatttttcagcctttgcttttagatcgctaagaacatatatataaaagttttattcacaaattgattttcgtttgcaaatatgccatttggcatattcagaaaatatgccaaacgatgaggctgctaatggtgcaaatatttttatttcttagtgactaatgtgggaatttcttacatccaaaacaaacatgataactttttccgtgctatcttaataatataataatatgttgtaaaacaaattaacatgctccatttgaaacatgtctaatttttaattgtgccctacaaaatatttacggggctatgaagtgagcgcgccaacaatccaacatgcacatcaatttcctagtatgattttatggagaaagagagatataccattctggtcggagtcgtagaggactcctgtagtatccattcggaatgaagtgtaccagtcgttaagcatttcagcttgcgactctggggtttctcctgacacactgcagaagaggcaggcatatacatgagttagcgatcgatctcagctgaacatatatgtttgtgaaaatgagtgctgaaaggggaagttgatgtgtactcgatgcggtaggttgattgcacggaagcctcgccttcgggagagacgttctgcaccaggacgtgatccggcttcccgtcctcgccggcgtgcaggacgacgactgccttccggtgatctgctcaacagcgaccaaggtggattagcacttcgcacgtacaacgtacgttgatcgaacatggataagaagcaaaaggtaagcaagaccaggaacaaggatcgattcaacaaacatgcatggcgagcgagatggatttatctcacttcgcacgtacaccatgagaaggattagaagcaaaagggcaagccggaccaagatccaaaggatcgatcgattcaagaaacatggcgagggagatagatcgatttcgtcgcgtattggctatatagggatcgacgacgtcgatcgaacttaccgttgacatggatcagcacgcgtagctgcctgcatctcttcctcaggcactcgatggatcccacgggaaccatcgggagcttgccggatccggcgccgccgccggcggcagcaccaccgctcgggacgttggacgacgacgacgatccgccggttgccatcgtcgatctcagcgtggtgagggccggagagagaacgaacaaagctaggggaatgatcgatctgagagcgcggacggacgactggccttgtgtgtgtggtggctgtgtggaggaatttggggaggatagacacgccggccgaggggcttaaatagctggggggggggggggggggattaagcgggtgtgcgcggcggggtcgtgtgaacgcgtcccgctcaggcagccgtccgctcggcccgcaggtgtgtcggcgcgtccccaaatttttcatcgagcgcgcgaccggcacccgttcgaacgacgccgcaacaaaggctacgtacgtcgattgcccgttcgttgggccagaaaatacaccaggtgccatggacttgtcagcccaaaaagaattctcgactcttttgggtgctgcgaacagaaggccctgggttactaattggcccacgccgagacacacggtctgacatcgatcagtatcgatcagtatgcggcctaagggctaaggccatttccgatgggatttcattttgtagttttcaaaagtaccctataatctaataaagagatgtttaggttaatgaataatacaagtatcttcaatgcacaattttcgtttcatggtttcatatgctattaatagcaattaatgattgaatgatgttatgaatctaatttgatcacagtggggttccatttccgttgcaagggcatatgatgaaatgataatggcgacgaagcttggcaacaataacatctacagtttctctctagggacgtgggtgttgccagtgcaggttttggcgtttcaggggctttggctgatgtctaaagtgtgagcttggtgttgctttgctcgttttggcagtgcctccaataatgtcgtgattgccgtagagttggagctgctgggtcgctaggtggcaagctcggcaacgatgacacgtgccttgtgatgtcaacgttgtgtgccgcttcttcagcatcttgacgtcgatgttcgccgttggattccgccattttttctttttttttttagcttgtctagatatttactcccgcttaatgaaatataattggcagttctcctgccggtttagtttcaaaaaataatatgatggaatgattcagtctcagtgagttttattctttttttcaaggcataggcaagtgtgtaaactaagttttatcaaaactaaacttattccttctctcttaataaatttactgatatgctattagtttaccctatacaacatatcatttaatgagattgaaattcttattaaactcactgggaatggtctaaccagttatgccactgtcttccatagaccacaccctagtggacggggagaggagacctaaccatcaaaacggcacgcgctgtagatgaggaaaatatgtggttgaaaccgcacgtgcagtgaaaatcaacaaactattataaaataaaaactcgacgtatgatatttattcctatcatcatgtgtaaaatttttactcgtgattaaatttaaatataaaagttatttacaatgacgtatacaaatattagagtactggttttcaccaagtattttcatctgtacgagcgtccattgaggcacgtttgttctctcgacgcatgtgtactgtggtggcgccccggcgtacgtgaaagcgtcacgcgacccaccccaccggaccaccactccatctaggggtgaaaacggatcggattcggacggatagcagtcatgccatatcctataccatattttttaatcggattcagaggcggtgcggataatgtgcagatgcggatgcggagcggattatttcggatgtcggaaatggtgcagagtcggtgcggactcgggtcggaaacggatgaaaataatcggatgtgacatgtatatacaatcgatacaacatctgattatctgtacaatgagcaacaatgagataccaatatcacaattcacatgatcacatcataatataatgtcaagttgttaacgattgacttgtcttctgtccaaaagcatctaatcgacacatatagtattgacatcacgatggcaggaggcgtcgccggcaccgagacggagacaaccaggtgaccagcacaggaggtggcagcggtggcggcgacgcctccgcctctggggtggagacggtaggccgcggcgccggggtggagaaggaaggtggcggcggcggcggcggtggcgccgggctggagacggtagggcgcacgctgggtggagaagtcaggcggcggcgtaggaggactataagaagagaagtctcgatgaaaaaaattgacacgacgtcgacggagtcacggactgaactcctggatagattgatggataaggtggacctgaatgggctgaatctttgcacgatgaaaatgcacatgccaaatgggccaaattgagtggttatatgggttaaattgagtggttatatgggttatgaaattcggattatccgccaaaatgtttatcggataatccgcttaaaatagtggataatccgtatccgccagatattaccgataccatatccgcatccgcatccgcatctggccggatatctaaaaacccttaccatatcctcacttcggacggatttggagcggatcggatcggataatatccgcttcgttttcacccctagctccatccgcgcgctccgatccgcacacgcgctcgctcgctggcttccgcttaatttgggtgccccctccgcgtcgatctgcctctccagccgccggccgtacgtacgcctgcaaccgccgtgacgaacgaactgccgaccgagcgatcgatcgatgcgcgtgtctcgtcgcagttatagcggctgctgtcccatccaatcttgccgctggggagctcgccatttatttctcccgccttccgtgtgttcagtccaaagctagctaacgactgactgaggctgtgtttgtaaccccatgttcccgacctctcttcatcgttttccgtatacacgtttttcaaactactaaacgttgtgttttttttaaaaagtttctatataaaagttgcttaaaataatcaaattaatccattttttttaaaaaaatagctaatacttaattaatcacatgctaatggtccgttccgttttgcgtgattactgttacggatgggaacatgcatgcccgaacacaccctgaatgaacaaatcatccatggatttcacttgaaaactgtttcatttcatttcgatttttcggtacctagaatctatactcttaaaatcggtacctaagagccttttattttattttggatagcataatacctaccggatgacgtgttagaatatatctgattttggaacttcttttttgttaaacctttttaaaggaagctaggggtttatcccattacctcatggctttatttttagatactaaacttactggatttgtgtagtgtcttatgcaaagacgcggagatataaatcatttttattatcttaaaaaaaattcaattcttaggtggtgcatgcatgatatagttttggacgacataccacgagcagcagctagtcgtcgagcacgattagctagctatgcatcatccacatgcatcaatctaccgaaacgctagctacgaacgttttctgtcagtgtactgtacacctttttggcgcggtgcattttcagaggtttctgcatatgctggatcgtgtcttcttttctctgacgctcgcaaggttaccagaaaatgaggtgcgtgcgatcgattcaggtaggtgtaaccaacgcaatgcacaccgcgcggactacagcattgtccctttcgcgcgcggccatcctgtccagatcatatgctccagcctccagcacacagatcagccgtccctgtcgccgctagatcatcgatgattacctctactaccacttcgaatcttcctctacatctgcatgcaaaaatatatgcaataatcagtatctcacacatacaatgatacaaagtgaaatacagatattaatgagaggtaactatgttcatttatatatagtcctgggcattcgtatagctagctagagcaattaatgatcgagctgaaactttatcccaattcaagagggaatatccagctaagctagcaatgcatattcagcactgatcgaactaatcagtgctgcaactgtgttgctcaatcgttgcgctctctttaaaaattgcaggcacagctgcgttgccaaggcatgcatgggcacgatcggacatggaactgttctctgcccatatcgatcggtgctaaggccgagatcgatccggcctccatcttaaacaaggacacattcggtgatccctgtgtcgtacatttccctggcacgccgtactgtacagcttgatcaagattattccatctctgatagtctgatgagatgatgatcgtgatagaataattgggctaggcccaacttataatattaaatctcaaaggcccataataagtattgaggataataataccacctcaggatttaagcgaggaatatctcaacctaaatagggagttattggaggctccctgttgaccagttgaggtgggggtcggaatgccacacacgcgcgcgcgccgggccgagggcgtgggcgtggctggcggcgtgcgtcacgtcactatccttttgcagccactaacccacgttcccacgattccctccacaacagcgcgtccacgttctttctcctgatagataaggaggccgcgagtccgatccggtttcatcgcttctttcccggtgttagtttctccttctccgcgcctaagttgctctcgcttcctcgcttcttatctcttgcgcgcacgagagattggaaggagcagtgcctccgaaaccacaccttcgcctgagatctgcaccgggtaggcgggtgatcaggtttttggggagtgcctcccgcacgactgctcatcaccatgtctggagttgccgccgccgctgctggaggagatggcggaggtggtgcgccgccgacaggagccggagctggtgcgccaggaggtgccgtgaacgacaacaacaacggaggcaattctgcctcaccatccagcggagagccattctcggggtataatcttctcctcctgttcctgttgttagcgctatttctgttcccattgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaacatttttggattaaaatatgccgattaattactatatttccaacattccaaaaacctgataggacattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagttgtatgtcatggagcagttctatgactataaaatggtcgatgaccgttctgtagtagaacaagctcatgagattcagatgctggctaaggaacttgagaacaacaactgtgaattgccggacaagtttgtggcgggtggcattattgccaaactaccaccttcttggtcggactttgccacttctctaaagcacaagagacaagagttcagtgtttctgatctcattggctctttgggtgttgaggagaaggcgagggcaaaagacgtccggggcaaaaaggttgagggaggttctagtgccaatatggtacagaagaagaaccctcatgcatcccacaacaacaagaaagtcaagcttgatgtcaaacccaaggctgcaaccaattttaagaagaaaggcaagggaaaggcaaagggagactgctttgtgtgtggcaagtctgagcattgggccaaggactgtccagagcgcaaagacaggaagtctgccaacatggtcattagcgagggcggaggaacatcggggtatggtaaaatattacctacagttctctctgtttttcattcacctgattggtgggtggacactggtgctaatattcatgtatgtgctgacatttctctattttcttcttatcaggtcgggagaggttcctccttgttgatgggaaatgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagcggaggcttgttccgcttttctttgaatgacatgtgtaataatcataatgctgtgaaccatattagcgagaatgatgagtctaatgtgtggcattcacgactctgtcatatgaatttcggttgtatgacgcgcttagctaacatgagtttaattccaaaattcactttggtcaaaggttccaagtgccatacttgcgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcaaagagtttggaattattcatgagaggacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagtataaggaagtaacaccattcgaggaatgggaaaggaagaaattaaatctctcatacctacgaacatggggctgtttggccaaggtaaatatacctatagccaaaaagcggaaacttggaccaaatactgttgattgtgtgtcccttggttatgctatccacagtgtgggttatagattcttaatagtaaactctggagtacccgacatgcatgttggtacaattcttgagtccagagatgctacattctttgagaatgaatttcctatgaaacatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacactccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaagcttaggcctgatggtacaatcgaaaagtacaaggcaaggcttgtggccaagggttatacccaaaaggaaggcgaggacttcttcgacacatactcaccaattgctcgcttgaccacgattcgagtactacttgctctggcagcctctcatggtcttctcgtccatcagatggacgttaagacagctttcttaaacggagagctggaggaggagatctatatggatcaaccagacgggtatgtactagaatgtcaggagggaatggtgtgtaaactgttgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatattgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaacccgaagaatagcaagggatcaactgagatactctcaaatcattggttcattgatgtacttggctagcacaacgaggcctgacatctcatttgttgtaagcaagctgagccggtttgtctcaaatctgggagatgatcattggcaggctctagaaagagtaatgcgctatctaaagggcactatgagctatggaattcattataccgggtatccaaaagtactagaagggtatagtgactcaaactggatatctgatgctgatgagataaaagccacaagtggatatgtgttcacactttgaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgaacagttcaaaggacaacatgaagtcatctagacacatcaagagaagactgaaatctgtcagaaagcagaaaaacttcggagtgatagcattggactatgtccaaacggctagaaatctggcagatcagtttaccaaggggctaccacataatgtgatagacagtgcatcgagggaaatgggcttgatacccacctaaggttgcataatagtggaaacctgtccattgtgatcggagatcccgtgaatttcgatggtgaaacaaactatcgtgtgactgaaagaagagacccttgaaaagggctcattttcatgatgtgcttctcttcttttctgcatggtaggatggcttatgccttaatgtgatccgagtggcttttccaagcagagatgttgacctgcagaacatctcagaaggaacacacctatatgagtttgactgctagtcacagtctatgaggtttgggcgatctcaagatactcatgaaagacctggagtttgacttatatgctccaaacagaagggatgcgaacggcagcccagtaccagtcaaggttctgagtgaaacttgatcacacaaaactgacaattcaaggcatagtccattgttcagttgtgggctaatgtagctatttcctaggtggaagttcaacttaacagtctccaccaaaaccctggtatatcaaacaggcacaacattgagaacatttcttatgagccttaaaatttggtggggattgttagaataattgagctaggcccaacttataatattaaatctcaaaggcccataataagtgttgaggataataatactacctcaggatttaagcgaggaatatctcaacctaaatagggagttattggaggctccctgttgaccagttgaggtgggggtcggaatgccacgcgcgcgcgcgcgcgccgggccaggccaaggctgagggcgtgggcgtgggcgtggcgaggcgtggctgactggctggcggcgtgcgtgcgtcacgtcgctatccttttgcagccactaacccacgttcccacgattccctccgcaacagcgtgtccacgttctttctcctgatagataaggaggccgcgagtccgatccggtttcatcgcttctttcccggtgttagtttctccttctccgcgcctaagttgctctcgcttcctcgcttctgatctcttgcgcgcacgagagattggaaggagcagtgcctccgaaaccacaccttcgcctgagatctgcaccgggtaggcgggtgatcaggttcttggggagtgcctcccgcacgactgctcatcgccatgtctggagttgccgccgccgctgctggaggagatggcggaggtggtgcgccgccgacaggagccggagctggtgcgccaggaggagccggagctggtgcgccaggaggtgccgtgaacgacaacaacaacggaggcaccatccagcggagggccattctcggggtataatcttctcctcctgttcctgttgttagcgctattcctgttcccattgttagcgctatcgctatactatgtgcgctatgttcttgttcctgttcttcatgatgcctctagcatgttattgcgttactgttatgttcctgttcctgacattcatgatgcgcataatatgctactggttatgttaagatcactctacactgcttatgccatgattattgctttaacattttggattaaaatatgccgattaattactatatttccaacggaacggtgtcagtggtgtttaggataaggtcgagatacatatatgtgcctgcagcttcggcgaaactgatttgcaagtattatatacatgcagatctatttatacttcgtatcactgacaaatttttgtagtactacctgctataatgtaagccatatgattagctagtgtggggtactactttagcatcaggccggcaatggactgatcgatgctaacgaaggcttagtgacaaagcatgccctgtcccagacaacctgctaacaagtacttgctgtactttaatttcaccactatttgtgtactctgtggttttccctgctaatagtcataaattcataatggcatttttttttattctgtcttcagatgacccaccatcatcatcaccatcctctcgatggtgatctgttgatcgattgtatatatacaaaatcctagtgcttcagatagaagctaagcacatctatgatctatccaaagaggcacacacatagttcaaaaagcccatgaaaagaatgcaagaaaagaggtgtacatggtcatggagaaggaatattggtcggtggagccttatctagctagtgatgcattagccaattggggatatcaccgcggttggtagcgagcatcctcatatacattaagcctagctaaccatgcacagaagtttggtgcttattaatttgtttgtttggtgaacaatgtattcgatttggcccagctaggttgacacatgtaggactatgttgtggcgacgtcctactatctcacttctcaccagagcaaactatccagttcagtggttgaggattttgaaatgatcgataaatcttttttcaacttgtgcagttgtgctatggactaaaatccccccttccttaaagcatgagagctatggcacgtggatattgtggtttgagaggataaatttccggttttagagtttggggtgctagctaggacgttggtttaaagcacgggtggatccgaggcctgacgaccaaggtttattagcgggtaacatcacagtaatagcttctatatttccaatgtttaattaactacataaatacttgtccatatgctctagaaaatttctgaacccgctctggttcaaacttttgtagggttttaatagaagcatttaaatttttgtaatttttatgtaccttttaagcgagttggaataaatgcttcttgtaggcagaggtaattcagaattgatagccaaaatgacctaacggtaagaacctttttggtcaacactaattgtgcatgaaaaccaattgggagtttccttcgctgcttctgaacaacaattgaacagggttgcaactggcaagacatttctgaagatcacaaaaacaaaatgcacagctttccaaccaatcttccaaggatttctgaactagtacaaagtacatagaaaaaaaaattagctaacacatggtcctttgcagtttgcaccaatttgctcactgtatgctacacttgcacgggatgacgggagtattatattcgttcagacattgttagtgcgttaccttttgccctccgatcatatgatacactgattttattgtactttgaatatattattatacacaaattttaattagtacaaacataatacaaccggatgagatgatacacaaggaatgcagatagataattcacattttttgcagaaattttatggtttttttgcaacttttttttcttttttggcttgaagttgccactgtttatgaactagcaagctgctctctgcgcaatataatggcgcggttggtcgcgaggctcgtcgtgccgtacaccggcagctcgtcgccgtcggcgccgcggaggctctccagctcgaagagatcggagctcgcgtcgctgccgtcctcgtcctcctccacatcggcgaggctccgcaccagctcctccaccctgcgccgcaccaccgacgtctcggcgccggggcagaagcgtacggacctccgctccgacgccttggtgttcgacgtcgtcgtcgccgccgccgacatgcacggtggctgcggaaccggcggcgatgccggcggcagagggacggccgttggagccttgggctttcttgggaggcgcgacgaggagaacagcgccttgacgacgcacgcgaacgtggccggcgacgggccggatgacgacggcggtggcggcggcactgtgcctcttggccgcagccttgctccagggaaacacggccggctcttcttcttcttcttcttcggtttgctgttcggtggcgcggcagcggcggcggcggcggcggcgtcgacgtcctccggctgctgcggcggaggctggctgtggcgtctccggtgcgtggtcgactccgtgtcggtggtcgacgcggacgagcaggtgaagctgctgtagctggacgacgacgcgtccgacgacgaggcggtggacgacgcgtaccccgagtgccgcgggcgagccaccgactcgcgacggctcctgcccgcggcgcccgccgcctgcttcgacttggcccaccagaactgcggcggcacggctgccgctgccgctgccttcatctcctccgcctccgaccgccgcgcgtcatcgacgacagcacccgcgccatcgccaccccctccctcgtccagagaacggtagatcgcgtcgagcagcgacgccgagaacgacccgcccgcgccgccgcgcgccctccgcggcggcgccagcgttggcggcgcgttcttgccgtggcattgccgccgctccataccaaacaaagtaacaaaaaccacccaaatctcagcaaaatatcaccaaatggcgcgcgcgacaaagggatcaggcaagaaattctatatacgccgaggagatcaagacgtgcgcggaggtggaggattatataaacacaagctgcaggggggagtggagcggtggtggcagctgcagctgcatgcgttggcatgtgcacttccgtcccgtggatctcactcgttcgtcaccaacctgccgcgaattattggcagtgagtggcttgctattatcacttgagagaagttgtgagatcgcgtcgttttcttggtgaaagatgcaattgacggacgagcttgactagaactctgtacctggattctgtcagactgtcagggtctcaagagaacttccaaaaccagttaaggcctgatttagtttctaactttttcttcaaacttctagctttttcatcacatcaaaatttttctacacacacaaacttctaacttttccatcatatcgtttcaatttcaatcaaactttcaatttttacctgaactaaacacacccttaaacttatggaatgggaccaggagtgaacagtgacgtggcccattccggcggccccctgaccagctcagcttgcccatgtccttcactgacaaattttgtagggccccgcggtctaaggccatttctaaatggagagtcttcagtgaataatttcatttcgcggtttcatagattagtcatggcatttgagttgagcttttctatggcacggaaaatgtgacaggtaattaggacaaacttaaacaatgaatttatttgaacttctaaaagaattttttatataaaaagatttaaaaacacgcatcatttaacattttgaaagcgtgttaacggacaatgaataagttgtaggttggagttgaagaaaagaacattcccctaatagcgatgcatgggattagatatggttggatgaaatgaaatattctagcccccaatgctagttttaaccaatttcatagttctgtaaattgtgtacacccagtttcatctagatgaaacttttccctccctttctttataattatattgccatgtcactatatttgcttacatggcatttcatttattgagaatggcttaaggctatgtttgggaggagaagttgcgaacttgtccccatgtagaaaacgagatagctcaagcatatgattaattaagtatcagctaaaaacatgagaaatggattaatataatttattctaaacgcaacttttctctagattttttttaaaaaatagaaaacacatcgtttatcagttcagtgaaggtgagtgtgaaaatttgggagaagaatatgggaaagtcagctaattaacacgttctaaagttgcaggagtctgtttgtcctgtcatggtagccgagaacgctaatcggcgaccagtcgcgcgccccctcccccgcgcaactggacgcgtgtcgcggaggtggcgcgggcggtgcggtttttattttttccgaacgatttttctttcttttttttttggacggttttctttctttttgttttttctgtttttttttctttctgtatctttgccgtgcggttttttttgttacgcacgtttctttttctgtttttatttctttccatatttttttagttttttcggttttttaatatgtacatatacaaactttgtatatacgtatacaaactttgtatacgtgtattttctgggttttatacctgcgcataccaattttgtatacacgtatacaaattttgtatacacatatataaagtttgtatacgtgtattttttgggctttttttacatacgtatatcaattttatatacacgtatacaaagtttgtatacgtgtattttttagctctttattcatatgcacacaacttttatatacattntatatacatgtgtatatttttaatacattaaaggttcatgcatataaagaattatatatatatatatatatatatatatatatatatatatatatatatatgaaaataatatgctactacctggagtagctactccctccctatgcgccctcaattcgatcgctactaatgccaatgactgttaccgggtctaatgaatcgaatactcccgcccgtttttatttttctcggtggtcaacagaaggtcgtttatcttctacagtagatccaaaaattgaacgaagcctcccgagtttgttgtaaatatgaaatttgaaacttgtgtttgtttatccaaagcgagaaagcaggatatttcttgcgtcgttaaggaagagcagaacattatcgatctaaaattgttctctgcatttggagggttcataacccaactgaagtcagatttgtagcctcgccggcggctgtgttacagataacggtgaaagccctggcatggaggattccagttccaaggtttgctatcatattcatctgttattttttcatcttttggattcttttcctgatctcgattcctttcttgatcgtttctgctcctaattcgctttctttatgttttgcatttgcagcaactttgtagtcctgcagcaggtgcaaatgtatcaggtggtggtggctctagttctgttttcatcagaaactatcatgctggtgtaaatgtaattaggcggtaagaaattaagaagtcatgttctgctcccagttctgctgccgtacgccatgttctgctacatctctaccaaatctgcaacatgttctgctcctcagaaatcagatagcagatcatgctctgctccaaatcagtgcatgtccatctctaaacccaaaaaaagaagtgaagttctgctcctagttctgccgtgtgccatgatctgctacatctctaaacccaaatacaagcacaagcagaaactacgatccatgttctgctacaagcgcagaagaagcaggaatgttctgctctcgtttctgcacgggccttgctctaatagtagattaaatcgtttgaaggaccagaagctattctattacatatccatagtttaaggaacgggagattagcttctgctgcatgcgcatgcatacttctctgatgcagattagtttctgccattttttttagttgatgctctgccaattttttctgttggctctaataaatatcttctgctggctagtagcagaaaatcaatttgaaaagagcagatcatcaacaatttcatgtgccgccaaacagctgatgttctgcttcctttcaaacagaatttctgctcgatcttctgctctctttccagttctattctgctcctaattggatgagcagaatatcttctgtccgcttaaattttttttcacgtgagcagaatatcttctgtcagcgtatttcattttcatgttctgctcctttcccgattcacattatgttctgccaacgatattttcaaaacagttatgttctgccatttttttagctgacgttctaccggtttttaaaattggtttgcatgcaaccgatgatttagaaattatttgaactaactacatgctaatattttgtgcaaatattattggattatgggttattccactaacccgatccaataagcggagggagtaactactcccggtagcagcaaataggtgtcccccctctctctctctatatatatatatgtatgtatgtatgtatgtatatgtatatgtatatgtatacacgcatatatatattgtctatactacgtataaactttgtatacgtatatacaaacgtaaaatctatttggagaggcctctcgttttttccttaaccagcgacgccagaacatggggagaaatctactatagtgtactacatgcatgctttttttttgagaagtctattacatcacatgtatgttattttcttcttcaaacaaagttttctctcaaattacttatccgatctataatccgattacatcattgtgttcgttacaattaaatcttcacaacaagatcttacatgattatattacgatgaaaaaatatttatatttgtagattacttttattatatatgtaagttacttttatcatatatataagtttaaattactttttagatatataaaagtaaattcaatagagtctaaaagtaattaacatatattataaaactatcttaaaacaaaacggaagtaattttatcacgacattataagtaaattcgttgtagagataaaaatatgactttatctagaaataaaatttaatcagcatatatcaacacacgtaagtttaacaatttttaaaagtaacttcaatgttaattgaaagtaacttttgaatggttaaaaataactctctataaatttgtttaatcatcgattgtttttttccttttattttagctgtgtagtcacgtccaatgaaaaaaggcattcattaaagttactttctttttttataagttatttctataatatatgtaaattacttttagactttattgaatttactttcatatgtctaggaagtaatttagtgaaatctaaaagtaatttagatatattataaaagtaatttataatttttcatcaaaatataatcttgtgggatcttgttataaagatttaattgttacgaatacaacggtataatcggatcatagatcggatgagtagtttaagagaaaatggtatttgaagtatacgtggatagtgtctctaacagatggagtgatagctggtttatacaaatcagctaccactagttgtatagtcacgtccatatataaagtttgtacgtatgtgtagatagtatatacatgtatatatacatatagtagtatagactagaggatatagtagtatatatacactagtatatactagaggggggcaactgatcgcgcgccgcgcgactggtcgctcatcagcgcccccaacatggcagcccgtttgctaaaaaggaaggctgagttgtaaggtggctaatgggcctatggtacaatactggcccgtcttgaaggcccatgttgactcgtccagtccagtccatccaagtctatgcaactggcaggccggccggccagccacgagcccacgctgtctccaaaattttcagctgagctgcatcagatgcatcgctgttctttgtctgcatgttgctaattgtcactttgttactgcaaaatttcactacaagtgaacacaaacttctgttctgttctgaattctgatctagtgatctcttgtattatccgcaatagataccaagaatccacatcaacagcgcgaggctttgatcaagctgcgctctctctgcactccgggcgtcgtcatgggcagctcgccgacgaacaccggccgcacgccgcacgggctcgggctccgcggccgcctcgccggcctcttctcctcgccgtcaccctgccaccatcagcactccgacgaggtagccagccagacatgcatccaatgaaatcctgattaatcgacgagatgatgtatgtagcttgcggatgtttgatcgtgtgctgcaatggcgaaggtggtggcgaagctgaaggaggaggtggagaagcagcgagatctcaaggagacttacatggctcggctggagagcacccaggcgtatctcaggttctgcctcgaggtcgcccaggtgcacgacttcttgcacctcgtgtccaactccaatggcggcgacgacgagccgcaccgcgacgccggagatcaagagccggcaacagccgccgccgccgacgacgacgacgaagatgctgctgaagcaccgccctgtgacccctacttcgccgccaccagagacctcgccgtgcagcacggctggtccgtcgctcccgacgaggtgcgttcgcgtgaaacatttgtccatcgatcacagcaaagcttgatctcctgtccatggactcagatcgagctgcacgagatgatcgggcgagggtcaacggcggatgtgtacagggcgacgtggagggggctcgacgtggcggtgaagtggatgcgcgccgagttcttcgccgccgccgaccagcgcagccgcggcgaggccttcttcgcgcaggagctcgacgcgctgtcgcggcagcggcacccgcacgtgctgcggctgatggccgcgtgcctgcgcccgccggcgagctgcttcctcgtgacggagctgctgaccggcgcgacgctggcgcagtggctccacggtggggacggtggcggcagaagcagggagaggcggcggcagccgtcctcgccgccgccgccgccgccgctggtggacagggtgagccgggcgctggagatcgcgctggcgatgcgctacctccacgagcagacgccggcggtcgtgcaccgcgacctgaagccgagcaacgttctcctcgacggcgactcgcgcgtgcgcgtcgccgacttcggccatgccaggttcttgccggacggcacggcggcgctcaccggcgagacgggtacaacaccgatcttgccccgtgcatgttcatcatactaattacacttcaaccaaaaaatttacagtcgctgaattaactaatttgttttgaattttgataaatcactgatcagttttacattctagggacttatgtttatatggctcctgaaatcattcgctgtgaaccatacactgagaaatgcgacgtgtacagcttcggcatcatactaaatgaactagtaaccggggagcatccatacatagatacaggttacgggcctagtaaggtaaaatcttcattatgctaatctgctccttcaggtaaacaataatcggttctgttcttggctgacacaatgttgtgtttttgtagattgctttggaagtagcagatggaaaattaaggcccaaacttgcagaaagagacgtaaattctagcgtcctgaatgatctcatttgtggaacgtgggatgcagagccttcgaaaaggccttcatttgccactataacttctgcactccggaaaatcaagcagcaacttatgtaacacaaatggcaaaactagcatctttatttattggggcattggttattatttcacgagaaaaaaactgaaaggaatgtgatgtataatattactagtctactgctgctgctcttgctctgaacttttttttctctctgatggttgcatcacttgcactgctctgagtttctgatttatgataggacatgacacactacctctacatgttgaatacctcttctgtcccaaaaaaatttcaatcctaactatgaatctgaacacaagctagagtttgtctttttttagacaaagtagtatagttttactgcagttactttcaaacttgttatccacatctccaacttatgtccaagctaatgccacgtaagcgccacgtaggataaagactcggctaagatcgccatgtagacgccatgttagccaaaactaccaaggaacattgtttgcaccagttttgatggttggaggagtcgatatacccggtttttatggttggaggacatgaatcatacttgggtgatagttgaaggagtcaaaagtatacttttttccttttgctggagggaccagcacctcgaagcccaacagaataatggagagtgggccaaattcatctatcgcaaacgggccttcttgtgggctttaagcccatgcgcgtagatgtagtagcgtccgtacaagtctttgtactacgggtccagccctcaaagacccccttccccgacgccgactccgccgccgccgtcgccgcgccgcctcgccgccatgcccgccgtcaagtggtactcaactctcacctctctctctctctcttccgcgccgccgcggccagccaggccaccccccctaatcgatcgatggtttcccctcggcgcaggctgatgcactggcacccgaaccagggggcgacgctgaacagccagatcctggcggaggcgtgcgcctgcgcggagtccctggggggatccaaggacgggaggtggaagacctccatcatcttctaccgcgcgatggcgcgggacggcgcgtccgccgccgccgcggggggcgggggccccccgcagcagcaccccgacgtgccccgggagctcctcggcgtcgcgctgcacgagcgcccggggctctacttttccatcctccgcgcgcaccggctcgtcctccaggccgactccgcgtttccccaggtcatggagaagctccagtcctacaaggcccgcgtcaccctcaacttcgaggtcagattgctttccttccttttacctttctgatttgttatttgacgcccatgtttaggtctttttaggttggtaataacatgaggattctaagctgaacatgcaaaatactgctttgctcctagtagctactgaattgaatatggtgttgtcttctgattgagtattgaacttatttttgcttgtattgaacttatgtttgattaaataaatttcattacttatctgagaatcttaagacacggtactaccatgagtatgttgtcacacgagaaattaagattgttgtctgggggcaactgatgctgaattgcttatcagttggatcaagataaattaagattgtattactgtaaaataagatctcatagttccttgaaatgttagttagaagtttacaacagaaaactgtctcaagaaacacaatgaattgtgcttaatttggttaacaagtttttccgttacaaatggggttcaagacttcaagggagacataagttacatggattgtaagaaaataattacaccttagtgaaaaatggaactgtagaatcagtatctcttaactcttatcctttcatacttttctcaaaagaaagagtagttcacaaaggagagaaccaggtgtgtggtactaattcatcatatgatttctcacacaaatagttaaccagcattgattgatgccaatgtaaatgtttatacaaatgaatttgattaagagctactaataatgctccattatctaaaaaaaaagtaataacactccaggtgagaagtacgtccaaaagagaaaagggctaaatgaaaaaagacgagacatgagatgacaaaaggtaaatagaaattatccaaagatctctttgcttatttaccatcacaccgtaggttttagatgcaggtgtggttgattttttttaaaaatctcttgctcaacttgcgcattgcggtgcgtggagcttcgtgaggcttctgctggaagtctttctctctctttttttgggggactgctaaaagtctcttgaagccaggttctggtttaaattctttgctgggtctttgactagaagggtgcgtaaatccaacagtttatactgcctgtcgtagcattggatggtgcttaatttatggcttacgtggctcaatcaagatttgagaaagattgattctttcactactttagataagcctttagtgatttaaattatggatgattcaaaaactgttcctcaagtctggtgaggttgcaagaaaccttctccaccacttcttttttttataataattttcttttatgattcaaccacttgccattagggcttctaatctcaagagtgggtgatcaacaaaaatgtttgaaaaatgatcatatatctcacatcgaagctactcgattattttgtttttatgttggcccttcattttttttctagataccttacaagttctatctggtgctttaatcttggtagtgtttattctaccacggtgcgagtgttcattgtctcatatgcaagttcagtttattggatccacttgctattaaactagatgctttcatctgcagggatttcagtatcaactgggtgacttttgcctgaggattggaaaatgtgttcctaataattcggaaacactgaggggaatcatgatggaggtgacattccttttcattttcttttatttgttacacttagcctgctggcctttaaacctatgatatattgtttgctcttttttagtataatatgatagtcaaaccaaatgcagggaagcaacagtataaaatttaggtttgagtaagtattgtcacagattaacagggctttgttgcttagactttcaattcgattcttgatgttctggctcatactagccctcgattactactagtattcaacatcagtattggtagggatattaaatgaatcatgcagtaagtgtgttgagcttgacaaaattatcagacgtgcatgctgacctttgattgtctctccattagtttgcaagcaaactttgcaacttactgtttgtgtcttgctgctaaggaactactaagtagttcttcacagctttaaacttagaagattcttgttgtcatttctgggatatttatgaaagtcggtgcattatttggacttgaacactaaatcgtaagcatataaaaggtctgtacttttgtgcatgtagttctcacttgaattgttaatcgtaagagagagtgaaacttgataggttctcctgcattcatttggctccaattgttgtacttatgagtaatccttattttgcttttgttactcaatattgctagcaagtttggcatgatttttttttttatttttgctttttgtgcaggtagagtattatcccctatcttccattgaaaaatccagggcagtaatggaagacttctttgacatatggcaggaaacagttgctaagaagtcattacctggtcatttcatccacgtagaatctaacttttcagagtatggtctttcagatcactattctttccagcacactgccgttcagtacgcaacttgtttgcaacaacttatggctgccgtgaggccccaatgacatccacaaggtgtgtctcatgcggtgaaatgttattggtcttcaaggactgaggtagtgataattctgaacaattgagtagctatgacctgtattatcacgagttcttattgtcagtagatccttaattttgtcgatgtggactaactcaccaaactaggcatggtaagcaaatattgctaccctaacagcaatggtgtggcaagtttatttagcgccactgttcgtagcatgattttacaacttgcaacatggttgaagaaggcgctactccctccgtctcataaaaaacaaatggatgacatatcctagtactatgaatctagataaatgtatgtccagatttatagtaatgtgtcatatcg

SEQ ID NO: 64869 - DNA, 18346 bp, Oryza sativa
ttcggctactgtgatgccatgctagccatcccaaggtgccaatgcctcgatgggttcgagcctgacaccaccaactcttcgagaggatgccgaagaaagcaacagttgagatgcggagatgggaatcattttgtgaccatgtccggaatgaaggtccctgacaagttcattcctgtcccaaacagaagctttgatgagtgcacggctgagtgcaaccgcaactgctcgtgcacggcttatgcttatgcaaacttgaccatagccggcaccacggcagaccaatcaaggtgcttgctttggactggggagctagtcgacacggggaggactggttttggtgatggtcagaacctgtacctccggttggcctactctcctggtatgcccaccttttttcccctgcagttgcaatataactcttagggcatccacaatgtactacaaaagtagtccatagggaataaactattccattcagtcatctagtaatattgtgcaactagtctatataaagaaaatagcaaaaggtatccatatgcatatggactacccatatgacataaataatattatctatctctacttctctctcttctcctaatgtcacattgtatccatatacattgtgaggattgctataggtaaagtttatttatgtggatcccatctatatagactacttttgccatatacattgatgatacccttagatagcttgtacatggaattctgagaaaaaaaatcacttttcttgatagggtacacttctgaagccaacaaaaagaacaaaaaagtagtgaaggttgtagtcccaattatagcatgcctgctgacattcacatccatataccttgtcaggaagtggcaaacaaaaggtacagtgagggtcaatactcaatactaactaacactatgcagtcttcctgtaactactgaccgataatgatgttcttattaggcaaacagagaaatgacgaaaataagaagagaacagtgttaggaaactttacaacttctcacgaactttttgagcagaaggtagaatttccaaatattaattttgaagaggttgctactgcaacaaacaatttcagtgattccaacatgcttggcaaaggaggttttggtaaggtttataaggtaacaatttacactaagagttgtagcagtggacaagccttataatttttatcctgttaaaataattttactatacaggggaagttggaaggaggcaaagaagttgctgtcaaaagactcggtacaggttccacacagggggtagagcattttacaaatgaagtggttcttattgccaaattgcagcacaaaaatctagtcaggcttcttggttgctgcattcatggagaagagaagcttcttatttatgaatacttaccaaacagaagcctggattacttcctttttggtatgtaataattatatattctctttttacctttttcacttttggtgggagaggccgagagggttcccaaagcctgaacaacaataagtttcctttcataatgtccgtcgtagatgattcaaaaaagtctatgcttgattggcgaacacggttcaacataatcaaaggagtagctagaggacttgtttatctccaccaagactcaaggatgacaataattcacagagatctcaaagccagcaacattttattggatgaggagatgagccccaaaatatcagattttggtatggcgagaatctttggtagcaaccagcatcaagcaaacactaagcatgtagtcgggacatagtgagtaactcttcaactacctgtgtataaaatacaaacttctatatacttgaacgcattcaaactacttacactcagttggtgacatgatttaaacagtggttacatgtcacctgaatatgcgatggaaggcatcttctctgtcaagtctgacacctacagctttggtgttttagtcttggagcttataagtggctctaagatcagctcacctcatctgacaatggattttccaaaccttatagcccgtgtaagttgtatgacatatagtgcacaaagtttcaacagctaaagttttgcactaattagaaactctcttctctttgttcaggcctggagcttgtggaaagatggaaatgcagaggattttgtggactcaattattctggaaagctatgcaattagcgagtttttgctctgtatccacttaggactgttatgtgtccaggaagacccaagtgctagaccattcatgtcatcagttgtggccatgttagagaatgagaccacagcacgtcctactccaaagcaacctgcatatttcgtgccaaggaattatatggccgaagggacgagacaggacgccaacaaatctgtaaacagcatgagccttaccacactacaggggcgttagaagtttggattcagaatcaacttgttgcagaattcatcacttgatctgatcatatgattgtccctctttaatttcagaatgagctggttatagaattaaccgctacggaatgaaatttacaggaaacaaaattgtcccagtgaaaatgtgattgctctttgggtcattgggcttatgaattatcattcatattcaacagttttcggatattatggccttgtttagttctcaaaaacatctcatcgaatctttggacacatatatggagcattaaatatagataaaaagaaaaattaattgcatagtttacatgtaaatcacgagacaaatcttttgagcctaattaggtcatgattagccgtaagtgctacagtaacccacatgtgctaatgatggattaattaggctcaaaagattcgtctcacagtttccaggcgagttatgaaattagttttttcatttgtgtccgaaaaccacttccgacatccggtcaaacgtccgatgtgacacccaaaaattttcatttcaccaactaaacacgccctatatgttttacgaaaagaaaaaggtaaaatcctttcgtcgtcaaatttcactaaattattggaactggaaggttgggtacctgggtgcatttttgcaatttgcactaggcgataaaaaaacgaagaatacgaatccgcatctatgtgattcatcactgttttaatcagtagtagtactagtacctgcactcgaggggcgttgaaatggcacgcctgaacctgaacctcctcggcgaaaccacgtcacgaccggaggttgcgcgtctgcttcggttccccctcagccgccgccggcggctgcgccgccgccgcttgcccaacagcgcgtcagcactagcggttcctctttttgccgggtcggccgaaggaaccggcgaccaattttattaagattaggaggaataaaatcaaagtacaagtagttttcgcttgcaacgacaggtgtcgaattagactgtggcaggaaccacagcccggcaaactaaagaactggaacgtcaacacaacagaaagaaaactaagaactgcaattctcgaaatagcctgcttctttccacactaagatctcttctttgatagcctctgctaactggttagggcttctcgatctttggtcgaaaacacgcgcatttctttccttccaaatctaccagcaaatcagcatacaagcgctgtcgaagtttgtcctgtagcacttccgaaaatatgttctggcctgcaaccaccactctgtcaggcatgtgttctcgctcccagggatggggaagtaagcgctagctgatccattgccgcatccactagcggttcctctcctaggctgcaaggctgcaaagcctccaccacctcgcggcgtaccactgccatcgcagtggcggacgaaccaaccccaggaggtccgcgactccgccccgccgcggtctcggtgccctctactccggtggctccggcgggcggcggccgaacacctaactggggtagaggcgcattcggcggcttcggaccatctcgagcacctatggcccaaacccatcagtgggggcctgtgttggcaggaggtgaggcaaagcaggccggcccaagtcggtgaaagctcgttgatggactaatgggcctcaatgaggcctccgcccgccggagtcagcccatccgtggagtaagagcccaccgagccggcactggggcggcccacccgaggaggcgatccgccactgcaagccgacggcgcgggcgaagtggcggagatgttgccgacgatggcgcggcgaggcgggagagcgagcggccgccggccaggacggggaggccggatcgaggatgcaggcggtggcggttgcgcgagctcacggagcaggccaggttccggacaccccccccctcccccccaaacctccgatttttcgatgcggattgagttgatccgactccgtgcggcacggccattcgcgagtcgcgacatcatccgctgcacgggcgcgccggagaggagggagagcgtgtggcgagcggcggcgcgtccagggtgcagacggtatgaacccagcacgggcaggcatgattttaactaatttttcgacccaagcctccaatttttggttctaggttgggcatctggggatggctgattcatgcatgagtcaagcccgtgaggtagagcggggattggaaccacccgccacacataaacatagaccccaagcgctgctggagcacttcgccttggatagattcttccatccttaattagatgacctttcaaatacctgctcaatatatttcacaaaagaaaagacgcatggcaaatgatcacttgtgtggatctctaatcattattctgttagaggagtatctattcaatttttgaacataaattagctcttcctaatatattgatagagcaaagcagatgagaaaaaaacaagtagcacaagcgcacaaccacctacggaatgcattctttccaatatctttcagttcattgtttactactccctccgtttcacaatgtaagtcattctagcatttcccacattcatattgatgttaataaatctagacatatatatctatttagattcattaacatctatatgaatatgaaaaatgctagaatgacttacattgtgaaacggagaaagtattccgtactaatgtactatacaaccatccatctgtttagagcttatgctaaaacatttattcagcggccttctagtatagtcagactcacattattaacagatttatctgagtattctcttggttcttctgattcataatgcctctgcacaaaatatataggttgtgttggaattgggtgtggcatgtcctcgttctccagcatagacacaacgaatgacatcagtggcctagcatttgggctgtcctgaacacacatgagtccaatatggatgcatttaaaaacttcgctgagggaacagctctccaaaattgatttgtccacaaaatccctttgtcttccatctttccataagttccatgcctgaaacaagagaataacttcaatatttgttctggcaatgttatgtttgttctttgattgttaaattttgaagcattgggtaccggcaacacttacgtaagctataaggtttggaaaatccatcacaagatgatgaggtgagctgatctttaatccacttacaatttctagaagcaaaataccaaagctatatgtgtcggacttgactgaaaaggtgccttccattgcatattcaggtgacatgtaaccactatttgaataagaaagaagtttaataatttccagaacctgggtatttgaataattttggttggcaagagcagaagttacttactatgtcccaacaactcgtctagtactttcttgttgctcattgcctccaaatatcctcgccataccaaaatccgatattttggggttcatctctccatcgagcagtatgttgcttgctttgagatctctatgaattatcttcattcttgaatcttgatggagataaagaagtcctcttgctacccctttgataatgttgaaccttgtcagccaatcaagtgtagcctctgttgtatgatctgcccagaacacagttaggatagtagaatcaaacaaataattaaccaagcaagagtatttctttggattggtcgaacatactgaaaaggaatttatctaagcttttgttgggcaagtattcgtaaataagcagcttctcatctccatgaatacagcaaccaagaagtctaactaagtttttgtgttgcagtttggcaataagaaccagttcatttctgaactgctccatcccttgctcagaacacttgctgagccttttaacagcaatttccttgccatcctccaatgttccctgtgtgatttcatcattattaaagtaataggagtaaatgacatcgctattcctcatatcattgacagaatgacaaggtaaaattatatatcaccttatatactttgccaaaacctccttttccaagcatgttggtgtcatggaaactgtctgttgcagcagtgatgtcttcaaagctaatacatggaaattccagattttgatcccacaaatcatgaatagtgctcaactgttgaatgacaggtcttttcgttttttccttgttttgtcggacgccttatagtaaaatcaacaatgtcaatacttacagttactgacaagatatatgcacgctttgcaattaagcaggtcctactgcttatagtacctcttgacttgcatttactgacaagatatatgcacgctgtgagtattagtaggcacactatagctgggagtacaatatttaccaccatgtgcctcttcttctttctgtttactgtagaatttgaccctgtgaagaatgtgggtgaacagaagttacagcgtcaaacatacagtagcttgcaagcttgtgggagatagtaacctggtggtcgtgttcaaaaacaggcatgctaaatttagactaccaccttcactagattcttttttctttctgttgagtttgaagtgtgtcctatcaacacaagtgaacaaaattcaggactgctaatctaagagctattctatcgtcgcaggggaaaaagggtgggcataccagtagaatcggccaaccggaggtacaggttctcagcaatggtgttcctgatgtccctccacgcgtcggcaagctcccctgtccaaagcaaacaccttggctggttggacatggtgccggttgcggtcaagttggtgtaggcgtaggccgtgcacgagcagttgcgggtacactcgtccgtgcactcgtcgaagtttctgttctggacatgcaagaacttgtcaggaaccttcattctagacatgatcacaaaatggtcatctccacatctcaattgttgctttctccggcatcctgaagaagaattggagccaacaggctcaaacccatcgaggcattggcaacttgggacggccgacgtgaggtcgcagtagccgaatgggccacacgagccataggtatcgcagccaggggcccttgggagttgatttgcgacagtccatgaggacaagctgctgttccaactcatgaacctaaagttgcccatgtagtcaatcatgacgcgcgtgtatggtgaatcatcagagattgtgtacttgaggtaaaactcatccttagtgttcacgactgttttatagacaaaagaggtgctgttgtgcaagtatgttgcaccggacaccgagacactatcaaacagaatgaaacggtaatatggccttgtctcgtgccagatgaagatctgaaagtttgacgtgggatcgccgctgaaggagaaatccccggtggatgggtcatctgggcccttccaagcgatgaaccgcatggcgacttgtccgtaggatctcactaaaaacttcatgttgggcagaatggtatcagttggttgatcaaagctttgccatatggttgtattgttcgatagccgaagaaccaaatttcctgagtcgagcagcaccgcgtaaactccgtcgtcttcggtgacaatactgttgggacttgccatcgtcgtccatagggtgcggcctttggaatctgacaatacaagagcagaattgttgctgatggagagcgtcgcggatgaagatgcagcgatcgggtcgtcgcggttggcaacccaaacataggtgcgctcggagatattgtgataccatataccaaggaataagctctggttggaggtggccggggagaagaatccgagcgcaaagtctccacctttggagatgagcatgtcgctaggagagattagtcgcttcgcatgtctcaactggtcatcgcatctgcagaaagagattagtagtagcaagtggatgaaaactgggaggttgtggctcaggcaggccatatttgttctgccttgtttcttcgcttagctgcgagcctgcgaagcacgaagcacacagaaatatacattgttatcattcagtatatatgttactgacgtacgtatacattgtttccagaatcttgagaccgaaggaactaggaagcgacgtgtatgcagatacttttttgtccgtcatatcgggatgaaacacaaaggaaattaggaaaacctgtacgttcaaaaacctactagacagaaaaacccagcacaacaggctgcgttctcaacagattacggattactaacgacggatgaaaatgactttattgactataaatcgagagtacaaacggaaaatattaaaaagttgccgtgcaaactaaaactttagaaataaaatatgaaccaaagtataatttgctctgggcaattaaaaggctgactagcagctgagtccatagacgagcaaggtggtgcaacctgcaaagaaggcttaccgtgatgatacgtggccgcgcattatcttctcatccatcagcccttttctcggcttaccgtgatacagggcagagcatcttcatggccatggtaaaaagagatgcatggcagataagtgaggataccgtacgttgcccttgaccccaagaaaaggatatcgtaataggatggcatcaccataaatgtcatgctgtttattcttagaaaatgcagttaaaggagaattctatggtttatcattgacaaacgctcgaatctggtttctcattagggaacatgagtcgtacagtgtatatgcaatcctactattgttttcctttccttaaccagatttattgtacctagacagggtgggtcgaccgatccagctacacaatgacgaagccaggatttagagataggggtggtggcacgagacgtaagaactcatcaacgcctcggtagacaatgatgtgaatcttggtggcttaaatcctgcagagtggcagattggcctcacgcccagtcgacttttgttcgctctaatatacgtagtcgcccctcgtataattatattttgaattttgtggttatttgtcgtttgcactaatatatacataaaatgattgttgatatgattttttttatatatttcaacacattcttctagattcatatataaaattgaacttattttaggatggagagtgtatgtccgagtctgaatgtactttaggggctgttcagatttatgccatttttagccataccattttttgggtaaagttgttaaaaaagtgcctacgtttagtttgttgccaaactttggtaaatacataagaaatcctgccaaaattttgggaatattatcaacttgccgccaatgccaaaatttggtaaggtttattttggctacaatcagaacatacccttaatatagcataaaaagaaccaattttaaactatgtcactaaatagcaccaactttactcaatacttgaatgacacgacatcatttctattcatcctttttagttttggagacttgcaaccacatcgctttgatatgttaattaactcaggtggacagctagatataggctcaacttgcaactaattaatgagctaattgtatggattagatggataatcacccgaggtttgcatgcagcgcatgcatggggatgggggtgggggtgggggtgccaggtacttcggcactgcagctacgacctgtgtcggcctacatttccaagaccccctacctctttatagtagtcatttttttcaaacctcagttttataaagaggtccatcgcagcgaaatttaaccgtcgatactcgatcgaacggtgggggaggagagaaaggagacacgtggcatattttcagaggcgcaaaacttgatttctgagacgccacgtggcccaatctttggctagggttagaaccctataatcggtattagagattagataggcactgcacctttgagaggtgtgcaagttcaacagagacctgccgcgcttcttcccttgatgccgtctgctccctgcttaaccgccaccgcctgcatcctcgatccggcctccacgtcctggccggcggccgctcgctctcctgcctcgccgcgccttcgcctgcaacatctccgccacctcagtagcggatcgggaattcgggaggaacggcctccacctcggatgggccgccccagtgccggctcggtggcctctactctacggctgggctggctccggcgggcctataattagtccatcaacgatcctgtgatttaatccatgaagcctataaggaaatgaacgagcaccacctccagcatcatcgagatgggccgagtatttacagcccaactctaccattgactacctgctgaggaaataagttcactttaggtccctctatttgtcggtcagtccgattttcgtcccttgaccgcaagaccgggtacgacccgtcccccaacttacgaaaccgggtaaacgaggtccctcggcagtatggagggcggttttggccgacgtggctcctttgactaggtcttcatcccacgtggcgttgacgtggcgcttacgtggtaattttatcccgaaaaaataataaaaaccgtaggacccacatgtcagatacatgtaaaaataatttaaaaaggtagtgcccatgtggtcctacatgtcagcctccctcttctctctatcccctctctccctctcccatacactgcaagcctgcaaggagaagggcgagcggtggcggacggtggccttgctcccggtctccgcgggcgccgccaacgacatcggcgctagggctgtcaacgagccgagctcgagcgagcttgcctgcctatgctcgagctcgatataagctcgaactaagcctgtttgagctcgatcaagctcgagctcgactatcgagctcgatttttaattagaacaatgtatatttcaaaggataatttttaaaaaaatttaatttattgtttatcatattagtataagaggaaaaagaataaaataaacatacgatgctaatacaaggcatacaaataacatatttgatctaccaatttattaaatagcaataaaaaatcatatattactaggctcgttagaagctcgagctcggctcgacaaagctcacgagctttgggacagctcgggctcggctcgtttggagctcgagccgagctcgaatcgagcctaggacgagtcgagctcgagcagctcgcgagtctcgagcttttttgacagccctaatggccgcggtggcggcggcaacgtgtgacgacaccgtcggggagtgcgacgtggacgatgaggaggaggtggaggagatggcgttgatgggggcggccggcgccgccgccggggagaccggttgtcgcacgttgcagcggaggctgctcgattacctcgccgcgcgccccgagtggcggaggtccggcgggagggaccacgtcgtgctcgcgcaccaccccaacgggatgctcgacgcgcgctacaagctctggccatgcgtcttcgtgctctgcgacttcgggaggtacccgcccagcgtcgttggcctcgacaaggacgtcatcgcgccgtaccggcacgtcgtccccaacttcgctggccaacgactccgccggctacgatgaccggccgacgctgctctacttccagggcgccatttacaggaaagatgtgaatgccttgttacttactgtactctttaaaagattcttaggttcaggccaataatataatgcatgctaccactttggcttgtatagatcgagctgagagagaaactgaagattttttttggcagcagtagcagttgctcacgtacgctttggatagagtcgatatgtacatacacatatgagagcagcgtattcactgccgccgccggcaacggcagtgacgccggcgaaggaagagggagatcagttggtgttgcgagcgcatcgggtgatggcggagcagccgcggcggtaggggttgccggccttctgtgaggcgcagttctggtagtaggactgaccgcgcttattgcacgacaccttgttggcgtccagcaccgcgtagctcacctaccagttcgtcggccgccgcatcagcgtctccccggcggcggcggcggcggccgcccccatcaacgccatctcctccacctcctcctcgtcgtccacgtcgcactccctgacggcgccgtcgcacgtctccaccgccgccgccatctgccaccgccccgacgccaccacgcccatgtcgtcggtagcgcccgcggccaggagcaacgtccaccgcccgccgccgctcgtccttctccttcagcgtaagggagagggagagaggggatagagaggaggaggctgacatgtggaaccacatggccccaccttttttaattatttttatatgtagctgacatgtagccatatgggttctacggtttttattattttttgggataaaattgccacgtaagcgccaccttaacactatgtgggatgaagatctagttaaaggagccacgtaggcgccacgtcggcaaaaaccgtcctctatactgccaagggatctcgtttgtccggttttcgtaagttggggaatgggtcgtatccggttttgcggccaagagacgaaaatcggaccaaccgacaaatagagggacctaaagtgaacttattccacctgctgagtgctgagcaagagcatgagattacttcgccatggcaaggacaaaagcatatctgcatatgccgcgaggtttcgctgccgtcgacttttctcgatctctatcgagagttcagttttgtagcgatagtttatcttttcggcttttgacggaagaaaataggtctcggcgacagattgttcttttttttttcttcaccagatttttgtcacatgttatttactcccacgctcgatcttcttttttttcaaatagtttggatcatttattctaagctatttgttctatgtaaaataatctattttaatagcccgtgcaaaaatcatatgtgttgtctcagttttccaaatatgtgtttatagaggtgagtgtgtgaacgttatactgtgttttaaaaaaacatatatattgtaggccagctatttgctctaaactattttgtgttaagctacctgtactaagttattttgtttttttaatgtttcttaacgaaaaatgaggtatgtaactaggacttcccatgaggtctcgtcaactatagacttgttggctgacgggtggttagtacagcgctaccgatgccatgaaatggaatttggttaatcgtggagtgaggtcgatgtcatgacgcagatcatcaacgtgccgcgttcaactctcagatcattttggtcttctggcttatttggaaacaacgttaatgcaaaaatcttccaatctgaatccaatacgcctctggagtctggaggttagaagatcaagaaggaattttgcgtctcgcctgactgctgatttctatttttttttgagcggaacatatattccatttacttattactgatacggccaaatcgccctgattgctgatttctttgtttcataccggtttgataatacttttcgttttggataagggcacggtctctaaaaaacaactttgaccattatttttcattataatatgtataaaattgttaacaaatatacgattatattaaagtactttttaagactaatctatacatatagtcaccatatttaaaagacaaatattttaaaaatgatttataatcaaagattataaagtttgactacacccttatccaaaacgacaagtattatcagcctggagggagtagtaaactttcagaaattaactagagatttctccttttgctgtaaccgtttttaacaggatctattgtacttgttggcagccttgttttattagttacagttgtactgttctggccaggttcttttgccgtcccgggaaaggtaaaaaaggaaaaaggaaaaaaaaataacagtataacggtttcgctctcgttgattttctcgtcgtatccgaacttcgttttcgctttgcgcgtgcatcctgatctggaaggacagaaatgtcttggccgtatgtttgctttcttcggtccaaccatgctctaagactatgggaaatcatctagtatgcatctgataattggatacatatgctctatttcttcacatttacatttttgaaggcaactaggaaacagaagaacaagacctaatgagatttagagccaaagtatggaaggaaaaggaagatgaatgcaagaaccttggtggttggtgtggcaggaacggaacagaagaatttccaacaccaaagccagagggagaagcaaaagtagctgcccaattgtgcaggagttaaatcagatagagcttagcagagcttagcctggtaatttcaagagctacgagagcagttctcctttttatcagatgtacatcttcttttccagttgcctcgcctctcctcgggctcttcttttgtaagactctgtgtctttttaatcgcataatctaattttgattttgcagagctcctgccttgcttgtccaaaaaagaagaacaagggccagatgaatatggcctacctcccagttctcatctacttgctgctcatctctttctgcaaatgcgatgatcagctgacacaggtaaatcgattgatctcccccagcggcaagctcgtctccaagagcggcgtctttgcactcggtttcttctccccagccacttccaaccagagcttattcctcggcatatggtataacaacatcccagagcgaacatacgtttgggttgctaaccgtgacaacccaatcaccacaccttcatcagcgatgctcgccatcagcaatagttctgaccttgtattgtcagattccaaaggtcgcaccgtctggacgacaatggcaaatgtcaccggaggtgacggagcttatgcagtgctgctcgactcaggaaacttggttctccggctgtcaaacaatgtaaccatatggcaaagtttcgatcacccaactgacaccattctgtcgaacatgaagattctgctgaggtacaaggagcaagtaggcatgcggcttgtagcttggaagggccttgatgatccaacaacgggggacttctcatgcagcggagaccccagctcagaccttcaggtcttcgtctggcacgggaccaagccatattaccgctccattgtgcttgacagtgtgtgggtgtccggcaaagcatatggcagcagcacctccttcatgtaccaaacatatgtaaacacacaggatgagttctatgttatctacaccacctctgatggctcaccatacatgcgcatcatgcttgactacacgggcaccttcaggctcctgagttggaacgtcaactcgtcatcatgggcaatctattctcaacgcccagcagccattggcgattgtgatccctacggctcgtgtggcccattcggttactgtgacttcacgtcggtcatcccaagatgccagtgcccggatggatttgagcctaacggctccaactcttcaagtggatgccggagaaagcaacaattaagatgtggagaagggaaccatttcatgaccatgcctggaatgaagctccctgacaagttcttttatgtccaggacagaagctttgaggagtgcgcggctgagtgtagccgaaactgctcatgcacggcctatgcttacaccaacttgaccataaccggctctcccggtaccacagccagccagtcaaggtgcttgctttgggttggtgagcttgttgacatggcgaggaacaatcttggtgacaacttgtacctccggttggccgactctccaggtatgcccaccttttatccctgtggtgacaaatgacaataaagatcttagatagcctgaacatccaattaaaagcaacatccatgcatatacctgcaatctatggttagaaattctgaaagcttcttcatttctcttaataggtcataaaaagagcaggtatgtagtcaaggttgtagtccccattatagcatgcgtgctaatgctcacgtgcatataccttgtctggaaatggatatcaaaaggtacagcaggagccaatactcaacaccgactcatatcatgttttcctcctgtaattgtacttatgatattgatgttcctattaggtgaaaagagaaataatgaaaatcagaatagagcgatgctaggaaactttagagcttctcatgaagtatatgagcaaaatcaggaattcccatgtattaattttgaagatgttgtcactgcaacaaacaattttagtgattcaaatatgcttggagaaggaggtttcggcaaggtttataaggtaacaatttacacagacaaacgcaacagtggagaaacctacaacattttatcatgctaaaatgatgttattatacagggcaagttgggaggtggcaaagaaattgcggttaaaagactcagtacaggttccacacagggattagagcattttacaaatgaagtggtccttattgccaaattgcagcacaaaaatcttgttaggcttcttggttgctgcattcatggagatgaaaagctccttatttatgaatacttaccaaacaaaagcttggatcacttcctttttggtactgttcagaaacttaccacatgatccagatataattggctgaatgcttactaattagcattattcaccattgttgatagatccagcaagtaaatttattcttgattggccaacaaggttcaagataatcaaaggagtagctagaggacttctttatctccaccaagattcaaggttaactataattcatagagatctcaaaacaagcaacatcttgttggatgcggatatgagtcctaagatatcggattttggtatggcaagaatctttggcggaaaccagcaagaagcaaatactaaccgagttgttggaacatagtgagtgatttatgtgttagtgtttagaatgatatttatttcctttcctgaaacaatatttgttacttattgctaaaactgttaagcagcggttacatgtctcctgaatacgcaatggatggggtcttttcagtcaagtctgacatatatagctttggtgttatactcttggagattgtaagcggtttgaagattagcttacctcagctgatggattttcccaacttgttggcctatgtaagtacggtgaaatgatctatcttcatataatgcaaactttttttcttttttttttgccgggtcggccgaaggaaccggcgaccaaatttcattaagattgggaggaatataatgcaaactaactgtactgattttatatggaccctattctattggttcaggcatggagattatggaaggatgataagaccatggatttggtggactcatccattgctgagagttgctcaaaaaacgaggttttactatgtatccacataggcctgttgtgcgtgcaagataatccaaatagtaggccactcatgtcttctgttgttttcatgttggagaacgaacaggcagcacttcccgctccaatacaacctgtgtattttgcacatagggcctctgaaaccaaacaaacaggggaaaataccagcagctctaataataacatgagtctcacggtattagagggacggtagatgtttatgttacctattttctgcatagaaagcatttagattttaccacttctgtaattagtttgttcttttccataaaatattagaaacaaagggcagatgttacattttttttggatgagttttttcttttatcatggcccttgagatggtatttttaatgtgcaggtattacaaaataacagtagataatgtggttctcgatacactgtcctgcaaaagaatcgcaacatatttttaccatcaattcattaaactattctaagttggatgtatacagtttaaaagttgggaagttataaaatactccctccgtttcacaatgtaag

SEQ ID NO: 64870 - DNA, 12583 bp, Oryza sativa
ccgatttcctgcatcctaccagaggctggggatggctaatgatgcgaacacctgaatgaacagtagtccaaattgttcgtagcataggaatttaaggcgactttctaggaacagaatagtcagccaagttcaaatggaaattttcatatatgttccatttgttatggacaaggccaagtgtaaatgtgttccttcaggcatactactgtcaaatacttaatgcacatcaatatgttatctgattatggattttggcatggtcggataaaaatggtaccgtgtagggtcatgtaggcattctagtggtggttctgtatggttttcatgccataatttggatcctctacattgctgtctcctagatattgttttttaagtggttctgttgcctataatctcatctgatcaccaatgtgttgatgtacaaagttagagaatcctcttcagatcctggctgcagcttgcaaaatttgtgataatctaaattattttcctagcaatttagtctttatacttctttactgttttatttctgcattttcttccaactgacaattctttttcttgcttttcagcgcttaacccagacaagtggctagagttcaagctccaggagaaggcaacagttagccacaattcacaattatttaggtaatattggtaaaattatacatttttggacaacaaattgctgaaatattttttcctgctacgtacactgcaatttgtctttgttgcatgaaaccatagactattctctgctagcatatgtagtatattgctatgtaatgcttctgtattttgactaattgcacccattatcaatttcccgtagttcacgttagtgtctttgttttcctcctcatgttttgtttattgttctcaactttcaaaacagatatatcaatgttcaagatattaaattattcggtgcatcgtattttcccttttggcaagtttgaaattttcaaatcattttattgtcttgagtattaattcgaatcattctatcttgttttgcatgcttctgtcttaattgaaggcttatgcatgtgatttgatcttgcagattttcgtttgacccatctactaagttgggtcttgatgttgcttcatgtctcataacaaggtatccctttactttctggcatatgttagaatacctctactgtgagaatcatttatataaattaaacggaatatttgtttttttttaaagaatgtgtatagatgcagatgctgtgttaataaccttagttgaaacagtgttctagctaattattattgttgtcgctactagcctgtaacaaatattgtgcaaagcaaaataccactttatgttaaatgaataaatagttcatgtttttcccccatgttaaatgttactgtttagcagttagccgtttcagaaaagagagggttttatataccattctgtacatttcagcagcaccttgtttaatattttggccttctatctactcactcttttataggcgtgaatcattttgcatctacttttctgatagtatgagctagtattttttatatttatttcttaccttggagactctaaaaccattaattcatctcagggctccaataggagaggaagtggagggaggaagaaaatttgtcattcgcccgtaagcagagacaaaaacagttatccattattgcatacataacatatgttagtacgactgttcgattagatttttattggaatctaacatgttttctgcaggtacacacctatctctgatccagattctaaaggatattttgacctgctaatcaaggtaacacaaagtttaatgtctgaagttcagaacatgctagttgcttttagatcagcagttcttgtagtccagtgtaaggtagtactgaaaggagagttatttttgtgctatatgtatgttgcaggtttatcctgatgggaaaatgagtcagtatttcgcaagtctgaaaccaggagatgttgttgaggtcaaagggtaatgtgaaatgaaaatccgttgagttttctatgcatgttattggctatctgtaattgatgtctttctcttttttttttccaggcccattgaaaagctcagatatagcccaaatatgaagaaacaaattggcatggtaagacatgacttcaaccttagccaagtgtctatgtttgccaattcaatttagcaagcccaaagctagaaaaattctgaagttatcaagctggtctttttttttaaaaaattttaacaaaatgtatgtatatgctttcagatcgctggtgggactggcataacaccaatgctgcaggttgtcagggctatcctaaaaaaccctgatgacaacactcaggtctgttgccatcacaatttttttgaacttatttgcaccgacttgcacccttgtgacatccctttgagaaactatcattttatgtgaacgatattgctataccacgtaactttgttatgcatgctgacatgacagaacagatcaatgtatccactttcatactgctaccagaaataacattattagctatataatgtttgactaatgttttgttctaatctgatttatggttcttggtatttctaggtttccttaatttatgccaatgtgtcaccagatgatatcttgctgaaaagggaattagatagacttgccagtagctatcctaatttcaaggttggtattactacagggtttaattcattttgatctgattacatgggatttttttgttagtgtaacacgccctggtaatttttctctaggtattctacacggtggacaaaccatcaaatgattggaggggtggtgttggctacatatccaaggacattgccttgaaaggtttgccacggccaggggaggattctctgatccttgtgagtagtctttgtcatttctgcttatagttctgctgatattctttaagcttttgacaagagtttgtacaattttaaagctcgcttataatctccatcaacattatcttcattcatgtgtagcataaacatgattattaatgttggaatgtaagaaagcatcagtcattcaatggtttttgcttggtcaggtttgtggtcctccaggtatgatgaatcatatatccggtgacaaggcaaaggatagatcgcagggcgaggtaatgtgaagtcactatctaccttttgtgattgtagttagtgccatatttcttatccttcttaattggatgaaaacagtagaatgatatctggatgaacatactaagataattcctagctaaaagcgacaattttcgcttgccaagttccagctaacagacctgtcaaagctagccagggagcattccagtgatctaaatatcccagttgtatcctagttcctagatttgcattaaccactacaacatgacattcgttttatcactttattgccctcttttgcttggccatgttaatgttttactgatcatcaatttggttactctgcagctcaccggcattctgaaagagttaggatacactgcagagatggtatacaagttctgagtgcgtcttcaagacgttagaatgctgacatgcttgctgcaatggcgccatggcaatgatcaaataaaccacagctgaacacttcttttattatgccacagcagttgggttccagacttgagaaagttttgacatttctcaataatgttcattgagaatcacatctttttgcgtggtttgcttctgcgatatgttcttgcggcccatgcacctggatatgcattgcttcagccgtttatgagatggtctggaattgccgtggatgatcttatagagatagatccattcacagatttgagactaccttgtgcactgcatttcgagtttttacctgacgaaacagcaaattcatacaaggagagctggagaggtgaaaattaaacatgtgtttggaattttagttgccgcagaaccacagtagcacgacgattagaaaggtttagttttgaaaaccaagttttagagggtttgtttttaaaatttaaaccaaacaaacggctaaaagaactctaaaagcaaaacagttatccagcttcatcatctttttacttatacttatcagctaaattatttattttcaaccaaatttgattttaggttttttttcagcgaaatttatttttcaccatttactttaagattgttaaaaacacgtactatatcaaaattttatttgcaaattatttttcagcctcgtttcgtcgccgcttcctctcccacacggccacggccacgccgcgacacccatctcttcttcctcgccgcggcggagcggggagacggacggagagggaggggcgcgtctccggctggaccgtcatgcgcggccgcttcccgccaaggtacgcgtgcgatgcgaaccccatgcccgccacacggatccgcgcgcacccatggtgctctgccgccgcaaaatggcccggccactggttgctcctgcggctgcgtggtcgtggtgccgagggggaactcgggatcgtcgtcgtcggtggcgtagtggatgtcgccgtcggcggggtggtgggatttggaactggaaccatgtggtagcatctaggagaggctttggcttcctcttccctcttctgggatgggattcgtgtggaaagcgaggagagaagaaggccgctcgttttggcttgttgcgtgctagggtttggggaataggggggcagctggaaccctcgccttaatcgccctgataatcctgtctagattgctccatcctggtgcttggcacttctctcctgtagtgaagtgatccggtgattcagtcacaatgtgattgtgatgtctagaaccgtcattaaaaatgcgcatgattgtagtgtatggatagctacatccaggtgacaatatcataaaaaaaatattcaaaccatgctgtgttagcacaaggaattctaattaagaatttactactgatttttttttctggttggcagtagtttgcttgattatttgcttgtcttacatgcacaagagccaaagacgtagttatattagcaccactagtctaagaggataaatgattctgttgcgttgtcgatttatcaatcaattgctcagatgctaattcagtgtgcgggcaaaccttcctcatccttgcccttatctgcctgtcaccatcacctgacccatatcccttcaacttgcaatatttccaatttgtggatatatatgctatttagccttggtcataccattctcttgctcccttagtcctcattgcataccatagaacattcctagatagagaaccaccgtgaggaacatggccgcgctacaaagatcttcgcagacatttagaaggtccggttcatctggcttggtctgggatgagaggcttatgttagatggtcatagcgagagagatcaagaagatggagccttagagctgagacactcccgtagtgttgggttgattgggctgcagcgtaggcatggcgatggtgcagggcacaccaggtgcaacaacagccaggcgttccatactcgccgtgtgcccccagcacaggatcctccttcacccaaggttcccggatgcatcttctgtggaatttttaggaagccggtactttcagagccatctaaaccaagaaggttctagccttttgtgctcttctcaactatctgtgcagagctatcagtttcttttttctttgtggctttgtagtcaggtccatcatgtatagatgtaagtagtaagtcatatagttgcagttgctgtcagctttcttctttttatgctactgttctgtttttttttttactggtttccctcttgttagctcaacactagttagcagctgtattctagaatgcccgcctctgccatcatgtacttgatagagtatgtgcatatcgttgtatcatatgtataagccctttgtacatataaatacataatatgatgtatggcgttttctatcctttttcatgtacgtgtcttgttccacagccactccttatgagtacatccattcctcatgaaccagcgagaacttacttcttttaagaactatcggatacttcaaaatattttaaaaacacatctttggcagttatgctacagtttatgttcctattaaggaaaaaaattcgtgagcttatcaattattaggtcatatttaatcttatccataagaatcaatgaacattccaaatatttgcaaattttatactgattgtagcttccgtctttctccttgtggcttaagagttccatacaattatgagttctagaagttaaatatgtaggtaagcacattcgtgaagcagatgaagcattgtgtgtgctgctagctaggagttttttttccctttactgatgtcctacattgattttagagatcttgatgtaaataacaatcttaatgtcctacaataatattgtctaataaaccttaactcttgttttttttggcttaccatttcaaattcttgcaaaaagcatatgcactttgtaagttagtattgcttgcagtgctgccattattaatttcatttcattttaatgaattctttagctactacaaatcttttgagctgatgcaaatcacacaagaaactggaatgctagtgtttgttagaaatgttaattttgaatttgtagtgaagttctgttttctatttcagactattttccggtatattgctttttcttttagctgaaaaaataggaaactctcaaaggccatgtgggtgtatcgagtttgatgcagacattacttaagttaatagaagagtacgtgcccatagttgaagaacaggaccgggactagcaaagtttctccactagtggtttccaggtggactagatgacctagtgcatttacacttggttggagggattgattttggcccgtgtataggcatgctatggacttcttttctgacgatgaaaggtgtagatatgtgttgggcttaccttttaaacttccagaaactcatttcatcctttggagcaaatagatatattagttggcttccactgccaacatataagaaacagaatgcggcagtaaagtttgtgtattcctatctcatggatgtccagatactgtcagacaaaggtttaaatattgaatgactttgaagtgaccatagacagataactgattatttccattcaaaatgagaacttttttttcctgctaaaaaggagacaaataacagctttaactcattataccaagcaaatagtgggacataattaaatcaccggggtacctgcgggcagaaatttgtgaaaacatgtgagagagagcactaagcaatatatgtagcagtactgagggattgcccctaattctggaatcaggacagcctgttgaagttgaggttatttcaaagagtacagaaattttagatcaagttcctcctcactccgaaatctaagatacagatcaaacaaaagcgacattgttgcatgtcgaatcaaacatgaggatattattcaagaaacatacaagtatgttactttttgtaggtccttgtcgtgtcctatttgggatcacgcaaccagctattgaccttcctgccaccccttaagtcttctggtacttaatacgatcattctcagcttaattgcttgaaaagccaaccagttatctccacacatacaactttttctttgccgtacgatattatgttcttaacctttttgttccttttgtttaaaaagattgccttatatttctgctagcaacagttttcagtgtgcatgtttacatcatcgagtctgttcttttagttttgaacagagctgggtttcagatctttgcttgtgaaattttgagtgccaatctgcattggctatgttagcattactttatgattgatggtgatgattggcttcagtgcagacatgcaaatatgtgatcttgtttgattaaaagaagcaggttttgtggagaaagatgtgaatgcacaaaatgaaaggaaatacaatcatgctataaagttactgtctgtacagattgctcttattataattttcgacttttgctgtgaagaacatctctgttttcttttggacaagtcagaaatgaaccttttcttttaatcgctgagttgctgctttgttggagtcaatcaatcaattgcgaccatgaatatcttattagggtctattgctatgtaattattggtcatttattcaatattttagtgttggtacgtgctgaagttaattgcagatcagattgtgttctccttctaacctgtaatctcatattactgttgtgtctatctggtgagctgctgcctgtggtctagtactttgtactaaatcattaaaggacatatctggtggcacttgtaacttaagtgctgaagaatttcgtgtttattttggcctttaatatatgacatgacattctgggccatataaatatttgtttagtttcattggagttctttgcttgacttgctaagcataggtaggattatcagattagttggggaagtactactacttgattagcagtgatgttgaagcactatctaaattgtcaaagcaatatgtgcagctgcacgctccatgattaattttgcagcctttcaaaagggaaaggcagtagtagggtccggattacaggaataagttgctgtctcatcattaacacgaggggatccttctggaaaacataagtctgttttccattagttatctgtggacacattctaattgttgcttgggtctaccaagagcatgtcttaacacctaaatcttcttaattaaacacaattatctctaattcttgtggttgtgacttgtgaggggttgtggtattgtgacatgagacgtgtgactggaaaatgggttggattaccagatggccttccaagaaggaaagaggggagagagacggttaaccgatagtaccactgcaacacatactccttccgtcccccccccccccccccccccgaaaaaaaaaggctaaccttggcatggatgggacactttctagtaaaacaaatttggacataagaaagtgtcctatccatattaaaggttggcttttttttttggatgggggaatagctggtagtgacagtcaatgcaagggtgtcaatatattttgtcatcattttggcactattatggctcaagctcaagcccctctcatggacatccatgaaaaaaaaaacatgatgtggtgtgggaagcataagctatcgacggactgacaacaggtctctccgctattagatctacgataaaaatggtcacggaaattcttgaccgacctagtgattttcgtataaatggcactattacctgactgtttttattttgaaaatatatgaattttttttttaaatttcttttaacgtcgtattgttagtgataccgaatagttaaatcaataaatatgataaatttttgaccgacagagaatcattttgaaaaaaaatgctaccgatcacaattccaaccgttttcgttcctagttagatgaaggacaggtgttagtttagttatagcacaagttcatgtcagctataactaatgctagcttgtacaataatcatctgctactaagcccttgtttagttccaaaccttttttttaaacttccaactttttcgtcacatcaaaacttttctacacacataaactttcaacttttccatcacgtcgttccaatatcaactaaacttccaattctgtcatgaactaagcacaccctgaggatccgattggggagcgtaacattctgattaatggttggttggtagtcagtttctgagaagctggaaaagacttatttatagtacaaactaggtgataccctacgctttgctacgggatttatggatgggtatatgtaaaatattattgaaatgataaaagttaaaaaataatgtgagaaagatggtttgacacatatttgttgatctatataatataatattatagacgacgtgtcatgcttacataggatttaaaataggctagaatagtcattactagtgagtaaagatgtggcatacttgcatgggattttaaatgggctagaatagtactccatccattccaaaatataagacacaaccacccttaacccaaagaccaagaaataattattatcatcttgtagtttggatcatcataataaatataatgcatgcatctaatatgattagataacatgagagtggagaatttttttaaaaaataatttaatggagaagatgtcatagttaattgcatgcttgcatgcatgccttatattatggaatatctaagaaaagtggttgtgccttatattatgaaatagagggagtaattactagtgggtgatgatgtggcatgcttgcatgttgagctttaacttctaataattgttagtggataccaaatactcctctgcatgtagaattccttatagtttgttaagtcatctacattgaacttgttctctttacctacatgcctgactataattgaagaatgtacttgtgagccatttttactgtatctatatgaaccaaaacacgtaattacaatatttttttgaatttagtaattacaacaattcagggtatgatctttatatttctacttttacctgtccgaaaaatcatggctagaaaaatagaaggcgatgataaaccactaaattaattttaaagttagtttgtaaaattcaaagtttgtaatataaaacttcagttaaaggttaaccatttcgaattgacaaacttgcatgttttaattttaagaggtagagtatagtgttttttttttccaaaaaaggtacatacataggcacttatatacacgcgtgcatgttcacctctatacacacacatcctactattgtaagtatgtccgaagactcagtttaatatatgatgaagattgataaagttagcattagtcgtcacattatcagtggatatggctcccatcaataaagtggagcatagtattctcctgttttaaaatataaatgattttggtttaatagtatgcattctagtaatcgtattactattacttggatatgtcatattgaatataaaaatttcctgtattctgggatggagagagagagagtaatatacatcatttcatggtctggcacaattgacacgtgaaagaacggggagcatagtacgggtggatggcactcgtagatattaggcatgtcctcttgttgagtggtacacggtaaaggagaaaaaaaagagagagcccggtcgccttattttattttaaaaagcccatgatttctttgtcccattcgatctcgaagaacatttttgtctctacacgggtaggagtaacaatccattttttttcgaaaaaaaagtatatatattactcgaatcctctctacccgcagcgtgctcacatggctcacagcttccgttccgtccgagaaaggcaagtggttttacgcttttacgaaatcggatggatggggatgccgctacgcttccggggaggtcaccgtcagatgcggtggatgcgtgtatggtgccttcgcacgccacgctccccgaacccccaccgtcggatggctccggagtggacggcccggatgacggccacgtcgccctccaaaaccccccaaccccaccgacctctcctacccatttccccccatctctctctctctcctcccatcccgcagcagagcacacagactcgttttctctctcctccgctctctcgatttctctctctctcctctcatccgatctgcatctgcttctcctttccacacttgtgcttcgtgttcgtcgtggtctcttgtttcttcttcttcttctagatttgattttctttttttttcttccctttttcgcggcggcgaggggcgaggggggagggtgagtgtggtgtggtgtggtggttggtgggggagatcttgatctggtcgttggagatggcggcgcaggagcaggagcaggagaagcagcaggtgaagacgagcacgacgagctcgctgccgtcgagcagcgagcgctcctccagctcagcccccaacaacctcaaggaaggaggaggtaacgtcacgttctccgtcggccgtccgtacgccggatttcctttgcttgttttgttgtttgctgctgaattgagcgagcgattcggtggcggcaggggtggagagcgacgaggagatacggcgggtgccggagatgggagggggcggcgggtcggcgtcgtcgggggcgggggcggacgagcggcaggggaaggaggacgggaagcagcagggtggtggcggcggcgggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccaggtaaagccccctcgagctttgcttcaccattctcaa

SEQ ID NO: 64871 - DNA, 70491 bp, Oryza sativa
tgcccagagcatgtcggatgcatagttgatatgttggcaagagctgcccgcttggaggaagcaccaggagtggctagcttgactcacaataaattaggagcaaatgcttggaaggctttgatgggaggagggcatttgcatggtgacatgaaatttactaaagttgctgcaaagaaggtgctcaccacggaatcatttgattatgggcatgttgtgttactttctaatgcttatgcatcatctggcaaatatagagctgctgaatctgtcagatcctgttatgcaaagcgaattacaaggaaaactttagggcttagttccattgagatagtgccgtacagcagaagatagtagaacaactcttacctagggaagagagaagatacatcaaacaattagtattcactgtctgtctgtctcaagctattggaatctatctcaggcataagttgagtattcactttcaggttgccaagtctcctgtggaaaaagtaaagcatcaagcatgattttcaaatgcaagttgatgaaatagatgattgccttggacctttttctttaaaagaaaaatatgccttggtctatggaacatgaccaacgatatcacatctcaactcactattgctccaggaatctctaacacgtgaatatggattctaatggtactgacacactaaggtctaaggcagcttgtttagtgcatactcatttttcattacttcctttttttcatttgtctttttttttcctttttaaaagttgccttggagtttttacggtgatcctccatctgaccttatgccctcatctggattgtgcatgttgactttcctacatgctaggacaacaacatactattgatagtaaaaagaattggtgatagagcctgtaaataccagctgtggcagtttttttttttaaaaaaaaatgagcagtatattggggctgctgggtgtgcacctctacatatgtgcaagtgttgctttgcacttccatttcatttggcagcctggcagtccctattaatcagccactttaaaatttatcttggatgtttgttcaaggatctagtagcgttgtcccacttttctgccttaaaggtgttaacgtttcatgctcccaccaacagatatagttcacaaatgttgacactcgatagataatcatagaggaaagctatatttgtttcatgacatatatatctaccaagtactaacacttctcttcaatcaatgaacatttgtctgctctgtaagtctaaattatcccacatatttgtatagatgctgccattcatgtcttttcatgcgtatgccccagtgtcaatggctattgcttctgtttgaagcaggttcatatgtggcgtgattatttatcacctatcatatagttttattctgaaagatgacatctcaatatgcatatgccatggaattatctggtggaggcatattggtgtttgcctggtataagatgtgtgtggcaacatgtgttttgctattgtttattctatttaccccacaaattgcaatgcttaatcccttccttacatattcattacgctggtattagtgaacagaattatatgaagactatttgatgatgcagtgagaataatgtatgacaaaaactctggaaggtcaagaggttttgggtttgtgcacttctcaaacgagtatgaagctaagtgcgccaaggatgctatggatggaaaggtactgtttgatgaagagaaatgtctaacagattgtaatattaactgtttcagtgaaaaataaacaggaaaataaacatggtctttctttttattctacaggtaatgctaggacgaccattgcggataagttttgctcttgacaaggtccgtggtgctccagttgttgttccacgactttccacggtgagtttaacgattgacatgttcattacatttctggaatgaagatttttttggtaccataaattctttattctatataaacatttctgtgatttttatcatataacattttaagcaatcaaataagatctctccacctggcatgactttttttaataaaaaaaagttacttatattagacattaagtatacgaaggatcacccacactgtgtgagaatgtgagattaccgacagcaatagttcaaagatgacacaactattaatagagctcacttttttcttattacctgataaatggctagttactgcaaatcatgttcgtaaaagcatctataagaatttcaaatattgcacattaaaggctctaatagaaaaagatggtgtatgacctgtgcttacttgtcgcataaccattatggacttgtttaagtttcataagctatcactcacactccattacttcgaatacaacaggacaggccatttaaactctttattcatgtttgctagataacatgtcacccccttgctatggtacacttgtttttgtcacatccataagatgacacagaggtctgtttgatgttacaaacattagagcctcttctaaagtgaattcgaaattggaatttgaatatgtcaccatgtccaaaagtatattccttgtgccagatcaattagactcgcagttgcactattcatttgctaggtgcatctgtgtcaatgtcgatctctgtggcttcttcttccttggtaggtattttgatggattcttcagaatggagtgacattaccttatattggtagaagtgtgagcatataagaaaataaataaggttcaggactcccataagggcaataaaatagaagtaatagtcgagtttgccaagattaatgttgtctgttaaccagcttgagtgaccatctctggtcgtgacctttctcatgatgtttgccagagcagtactcaggtagtttgctccagctatagtacagaagaacagagatcctgctagggtttgcatgttctctggaaactgcttattgtagaattctatttgtccaactgcattgaaggcctcagcaatacccattaaaacaagttggggtgcaagccacaagactgacataggcgatattcctccattcgacaaggctgagttcctcctcttacgttcgacaagtcctgctaccaccattgaaatgggagaaatggccaatcctataccctgtctctgtagaagtgtaataccactttccactccagtgaatcctctagctattggtactaaaatccggtcataaatggggatgaatagagttagggcaataagggatatggatacaacagagcctgctgggatttcaaagtgcgtcccaaagtgacagtccattgtaaatgtttgcaagattatataggtgaattgctgagccaatgcgacaaagcataagactccagaaatacaaaccggcacaattcttattaagcatttgacctcctctatttgttggacgttgcaaagctcccaagagtttcttgcagaaccatcaacatttatatcatcacccattacaattgcacccttgttcagaaacctgaggatgagtaacatgcatcaaactatgatggcatctagcatataattctttgaaagggtcagtattttgtttgatatgaccagcatgtttcttcttaactccatttaagcatgtggtgcattctatgcatttactagaggaaaaagggtgtatatttaccaacaaatatgaatttctgcattttcttgcccagcacatagatagcaatatagcatctatcagtaaatatttatgtgtgctcgtgttgataagcatacaaaatactcgtgcaagttatgatatgcatgatctatatgagtttaatattcaactgtataaaaggtatctgagtcttacaacttggtaagaggtaatgaataaaaatcactaaattcaacaacctgattaattatttggtgttgctttgctttgaaaacttacaatgttttggcaataaaatagaacaatgtcaagaacttatgtttttcaaatttcgtttttttccacatgtacatatatacatgcaacatcataatttcaaatgtgcctcgggattgatgcagatataaatttcaagaaaaccaacccatatccgattcattgtaatgttcttgcaaaaactcctgaagcacactatacgcgtaaaagtgtgtgcacatatacatatgacaatgcatttatcacttctcagtttgttggatgttctaatactttcactatgactagtcattgttttagtttttcctccactctaagttgattacatctctagctacattagttccaattctgttcatctttagtggtaacagatgtttacctgaactgggaagtaagtggcaatctgaatacgcggttgcccttggaaggagggttgtagagcatcaatccttgttggtttatatcatgaggacaaggaagcttgagatttctctttttaaatgaagccactaaaacctgggcaattccagcaaatatgcttccctctggttgtacatggacgtacaggttggtacccagaaataacatgataatggcgagaaacatgagtaatgtgggtatgccaaatcctattggccagctgacattgttctggatgtagatgatgacaatcatagataacacaagggcagcagtacttgttccatagtaccaattataatagctgtttagtccctttcgaccttcttcgtcggtcttatcaaactggtctactccaaagggcaagctacaaggccggatcgctcctccaccgataattagaaagcctagagaaaggtatagcacacttagctggagtgttgatggactgttgcagcctccgcctagtcgggttttttcatggcagatcggtggcttgagagctggaagtgatgcatacaaagtcattcccagcatcccctgttattttagcaaataaataaattaaaatgagttcatgttgatgaactacactcctgggaagagcttaaatcaacaaaaatgttggatgtgcactatatatcagtttcttgcatcagttggggcttattgtacattcttcgtttctaatgaaaaaaaagcattaagctattgctgatctttttattcgttgggtgaagccttatttgacaatgacaagtgaccttgcatttctttctgctgccaagcaggtgaaatgaaactactaagagagatggtttggtcatcatatggacataccaggaggctggcgaagcatccataggctagtgttttgaaccttcccaagtagacgtcggagatgaaggcgcctagcaatggcgcaaagttaagcgtaccgaagaatatgttggtaatattagctgcctcaatttgcccaatgttgaagcgcttcacaagatagaccgtcaaatttgctaccactccaattgtcgcaaccttttcaaatgtctcagttgctacatagatacaatcagaaaagggcatccattcagtacattataatgagcattttgatttgatccgcttgaagtacaacataattcattcgtgaatccctttttgctttgatttgaggcagggtgtatcctgtgcagggatcaccgggttagagcacccatgttgtcatgtctaaatttagacaaagaagccaagccaagccagaccaaatcaacatatacttggtctaggctcagagtctgaaaatactcttatattgaatggatattagtatatgatttacggtagtcatgtagaagtattaatgagatgattcacgaatacgagtgattaaaagagtcttccgtacgtgctaatcgaatacgaataccatggacatatacatctatgatctatatatatggcccttctcaggatgcaatttattttctatattatcaaaggaaatgaattgatctttcacatgaaactatctataaaaaggggacttcgggcatgtttaaattgtagccaaaataaaccttgccattcaatatgtgtaggtaggtgtgcgtgtgtatacatacgtgtatttgagcgttgcgtctatcttgttattttcaagcctacggtgtagccgtgcagcatttgagaggtctaaggctgcgttcgtttcttggctaaggaactcattcccttcacacgtaaaacggagtggtccattagtgcgtgattaattaagtactagttattttttttcaaaataatagatcaatatgatttttaagtaacttttgtatagaaacttttgtaaaaacgcactgtttgaaaagcgtgtacacgaaatatgagagggggagttggtattaggtccctggaaacgaacgcagcctaagtaacatcagtgacggcagaggtattaggtctagtaacgtcagcgacggagctagaaatcattaaagagtgaacttaaactagtgagttgctttttttttcttaaagttacatggtggtttaagataatttaaccataattctgaagacaagtctaaggctcaagccctaactactctaggcctgccttcgctcctttagggcccctttgatttggaagaaaaacatagaaattttagaggatttcaattctataggaaaattttctatgaagccatttgaaacaaaagattaaatcctatccaattctttgaaattcctatggaatgcacaatcttatagagattttagagaaaatttagcatgagctttaacctcttggtaatttttctttgagtttatctctctcatccaattcttggggttcaatcaaacggtaattcatgtgtttttcttacgtttcgaaatcctctgttttacacttatatacctttttaaaatcctgcgtttttcctattcttatgttttcttaatcctacgattcaaagggccgttaacatactatacggatcgcaaaacgtagaaagaaatcactggaacgggagcctcacctatgatgaatggcatgcacttccaaccttgcggcgtcttccccctcttgcctgccacaacttcaccaccgacgacacccccgttctcaacggcgccgatctccatctccgtctccaaagcgtaccctcgctaccacagcaaccaccaccaccaccaccgcgcggaacggcggaggccaaccaaaacaccggcgaaaaacctcgctctccgcccgccggtgcgcgcgccagccagccagcaccagcggcgccgcgcgtatgtgaaagtaggcaatgctactaccaccagttggtagaagtggtacatcacgctacactgcacatatatgcgtgcgtgcgtgcgtgcgtgggtgcgtgacggcgtaggagtcttgtcacgctagagctattgggtgcaccacgcgttgtcaagcgccgcggagcggacgggacggttttttttgggtcggcgtgatgcgattgctcccgtgtgtttattgcgaaacggacacatatgcgtccgtccgccgaaacagtgagcacgtcacagcggctgggctggcggacgggcggttgggtttccgcggcctttgaggcggcatgacgcgtcggcgtgtctcatcctgaagatacacgtaggtttggatggagacagtccatggcggcatctagggatggcaattgtgcccgtttttctatttacccgtggttaaaaaccctattaggattaaatttgttctccattttatacccatagatattttattgggttaaaagctatgcctgatgggtaaatgggcatgggtatgggtaatcactacccatgcccgctttgcccgtttacccacgaaatctaacttacatgtaggctagaagcaaaatccactagaatacataagccacgttctttgttttctacggttttccttttatttcccttattatctctccctcttactctatcgccgtcagaggagagacaccacaccgagacagagaatatttgatgttttaaattcgatatcgaacttagaagcttgtagactttttattccactacttttgtagtggcgggtaaacgggcacgcctgcgggcacaaggcgcccgtgggcgatgggcatgggcaaccattcttacccgtcatgtagtaatagatatacccacggaaaaaaataatctcatgggcacgggtatggataggcactacccgtacccgtcgcacccgattgccatccctagcggcatctgatgctttttggtcatgttgattgtgtgcgcgcggtactgacagtccagtccacattctcccgtgaatgaatgaagaaagtttggtttttagtgaaaaaaattatcgtggaaattaaacatggaagctgatgagtacttcctccgtcccaatatataagaacctaaaatcggatgggatatttcctagtactacgaatctggacaggtagcctatgatgtccagattcatagtactataaaatgttttatccggttctaggttcttagagcatccccagcagctcctttatctagtcatccatccgatatttggagtatggaggagaaaaatagtgctccagcaaagtcaccatcacatactccatttttggagattctccaaacctagcccttcctatgctaaatatggaggttctctctcctcactccatcctcaactacccacttcccgagattttttttaagtggtgaaaggtgagagggatatgagtaaaaatgtgtggtagttgaaaaatattaataaaatataggatgttggtatatttaggatgtaatatggatgatctgttgaagtgaaaagttatatagagtgagaatttttttggatggctatccaaatgggagtatggaggatgaaatttagatgagctgctggggatgctcttatatattgggacggagggagtatgttgcaaataatgggccgtgactatcttggacccacaaattttgtggatgatctcctttgtagcccatgaagcctttgcacagtttattgggcccataaccagtactgggcctcgatcaaaggtcgcccattagaccctgtatttccatgtattattaaccccatgacctaattctttaataatcataagaggcatttccggccgggacgtcccgaaagctaagacaacgcatccatcatgccgcgtgttcgtacttaacgtgcccatgcatccagcagccggcacccaatcaagctcatgattaactaaaacacgtccaaaagttaaagcctttctaagatccccataaaactaaaccttttattagaccaactaatccttctttctgtagccgctagctaacaatctaaactaatgctatcaactccggctcaggtggaggggcctgcacttactagtacgtacgtgaccgataataatcatagagtgacaaagtgtaccatctgtttgtcctaatcccaaatatcccaatcctttccctttcctttcggtctctgttgcacagaatcgggaaccggttggtgagacgtaaccaaacgtgggtccagccggtgccgtttgatgacttggcctccaggctccaagtgaccgtaattatggcatgttaattcggtttagttagtaagcttattagccaataaattaacgaatttggtgtaaatatagtgccacatttctgacttgactcaatcattttttaaatatgtgattgctagtgtttctctctcaatcttatcttccaagttggtaattatttacttttatcattattctcttatataacttacagtataaatgttgtacttccctcatttcatattataagactttctaatattgttcgtatttatatatatgttaacatccataagttatttacattgtaaatgtatgttatttacaatataaataacttacttagtataagttttgaagtgtaaatgtatgctatttacattgtaacaagattttaactttttttaatatgatatcataaatatagctagtcccataaataaatacataaataaattcaaaaagagaaaataacaaatagttagaaaagttatatctaataatactgatgtacaaggttaactttggcgaaatctacttttgtaagcgcatcacagaagtattctataccaccattagcaaagaacgggtcttgtcgggcatcagggaagaagagagcgtggagcggagcgcgccaccgcgccgcgcggccggcgacggcgatgggtgcatggcccatccgttgtcctggtgacctgatccctgcattgcaatcttgcattcgactactctacatatgttttttaaaaaaaatctaaaactgaacgtgatatatactagtagaagtatgtctataatttgttgcactagaatatatgatagtatctagttttaggtttgttttttttaacggatgaagtatactctctctgtctagaaaaagacccatcctacatacgaacttgatatatatgtgtgttcagattcgtagctagcagtatttttttttaggacggagtggtactgtagtaggtcatgtgcagtggtttgtttttcgccgcccgaatcattcgcgccatctgggctccgcctcggcgcgacacgatcattgcccgcgcacacacccggcccggtacgtccccgtccttgccatcgccgttaaatcttaatccggcagcactagtagtagctttcaccaaacccttaactaactcggtgctaatcactcgccattaagatctaagcaagcacgaatgatgagtgatcagtggtactgtctcagccagccaatcatagctgctcatacgctgaaacagccgagtagttctgaaaatcatacaggctggaacagcagataattaagccaaaaaaaaaacaggctgaatatttcccgatgtaggtgacggctacgagcttgttacaggtgcatccaggttgtggtacatgatgagagctttagctcgctcttgtgcaatcaaatcattcatccatttccccttttctctccaaatcatcatccatgcatgcaggttggtgactgatgaaaggaagaaaagggaaggcaaacctggacagcacagacagagtatctgcatctctccctttctttcttctcgaggttttctctgattctttcggcagcatccaaatgcacgacaacgatgccacccatgatgcgtcgatggcgaccgaaagctcatctcagctcagcctcagctcgccacggtcgagaggctgcatttctgcagagattttcctcttcatggcgagcagaaaggagaatatgttcgcactatgcgtactggaggcgtgtgaatcccgtatgcgcgtgtggtgcctgctctgcctgccctgtgtgcgtgtttttgctcggatcaatgggttgatccccactgctatcatgctgctcccaatgatggctcgctagcttccccgacaggttgtgcccatcaggtgcagcctgaactcacacctcgcagggccaacactagttcacgagattgctaactacagctgctagctactccctccgtttcgcaatgtaagttattctagcattttccacattcatattgatattaatgaatctagatattcaatatgaatatgagaaatgttagaatgacttacattgtgaaatggagaaagtaatagctagccagctatacggacatgtcaaccatttttttttacacggaaatgctaaactactgttggtagaaaattgaggctaaaatattgtaaatttctaccattagatttgctttgcggttcctgctccggcgacctcacctctttctcctcaagctccaattaccccttcttcaccagccatgacgaccggcgtcttgccgacaagcggtggcccgacgatgcatggtggaactagtggacggcacggcgacatcggagtcacggggatggaggaagacggtggactggtgttggtggtggaggcaaagcaagtgtacagttaggagatggtggtggatccgacaatagtgagtcgctggagatgggggagacggtggggcgggggcacctcgccgccgccaccttgaggagaaatagagggggaagggtagtagggaggggaggcggctggtcgagggagcctctctggtgccattagcgtatttcgatcagctgacaaggccagggcgttggtggcaacaagaagcggaagtgttgagcacttcatgtggtgatggggaggaaaaaggaaaaaaagaaaaggttagagttttgagggctttgcatgaatctcaaaacataatttactacatgatattctatcattaatatagaccagggtttaagttttcaataaaaactggttgagaactgtagttttttttttgttttcacggaggacggaagcggattataagtaaaatttcaaatggtttttaagaattcaaaattgagacgatagatttaactgaaatttgaaaaaaaaactgtcataccgtcaagatcgggattcgtcgctcaatcggaaatgggaacactggtaattggtaaaagaccaaagcattaactttgttcagtagttttctgaaccgggaaacaaggagtatactgtttcggtgcttttgtttcgtctcctaattaatactgtacctcgttggctagcttgagctggatgcaaaatttatctcccggtcatcgcggtacaccgagatgtcagaatgatatacgagggcgcacatgccttgtaccaaccggaagcatccaaaaacccagatgcacagctaatgcattcactctatggggcattggaccaagagaagagaacacaggacatttttgtttcttgttcgtttgtgcttttgcaattctgcaaagcattaggggcgtttcaccgcgtatgtatgtacagcgtgttcgtgccacgatggttgcgtcagtgaggaaaggcagcccacgttaagttcagacttcagaggagaaagaaacaaggctttctctacactgtggctgcaacaagggccccacatgacagcagaagacactgctgctccacggtcggactggcattctcgccgtcaatgtcgtcgtcttccttcagtttacaactaaaaatatatacttggagtactaggaaaacaagcccaaatagtaggcatacatgtgaccaaaaccgaaccggtaaaaccgctcaggttttgcatcactctcaagtttcaacaaaactaaaacacattctaccatgtgggaaggaaagaacgctatgcgtgaaattaccgcctaaattaaactgttttgggggtcaccggtcacgggcaaattagcaccatcatctcgttcccgtccactccaccatcttgccctctagttgtacttaagtttgcaagtagtaggtgtgatcgtaggatagcctaccatgcaatggttctcatcctcaccattgtcttcctcgtgttacattcctttcgttcattctctcagtgaaatgtacattttcatcaccccacctcaaataacggtggtagaaatatggagggacattattatatataaaaaaaagtacggagaaatataattgaaatttagtagtggctaaatctcttttttttttcttttttggcatatttcgattgaatatgagtgatgccaacgtggatggccacatatcgattagtcaaaaaatgataaataataaagttacccctaatcaatctatcagtaaattactagtttatctttatctctaataactaatggatcaaatcatttctactagagagtaacgaaccatcgtccaaactacgaacataattacaaattcacaatagtctctagtctacaagtaaaattagggtgtgttaaaaaaactcaatttgtgtcattaagaaagaaggaaacaggcaacaaattacatttttttagaaaggtcaaattacatataattcgtgcaaagccaaactggctcaagctccgccacattggcattagcattttgagggcgcccgacattctcatcctcatcgtcgtcttacttaagtttttttttttatttttacgcaagtcttacttaagtttcatccatttgttccatgcttttacgttcaaacggctcccttatggcccggtcatatgctcctaccatacacaacacgctgttccaatgtcagtacaaatgttactaaggtaccactgattgcccacattctctaataaacagtaagaaagtgtttggcaaatgggaaacggaaatgatttcccaccatctttagattctaaccattcattctcccttttccatttaatcctaacccttcattcatttcctaatcccaatcccaccctccatttcccattatccaaacacaccgtaagggcttattaagaaataaaaattattttacaggtaaatttttatatatgtgttcttagtgatttaaaaccaatgctgaaaaaaaaacgttcaaaatatcttaaaatcaacttcaaaattatttttgaaaaatttaaattttggtttttgccgacggagctcaaactttgtatgaactgcgtttttttttaaaaaagaatcggaacaactttaagatgtagggctagcttggtttgaagtctaaattaggcttaccaatatttggtaatttcaatagtgtttagtgtctatttggtttgaagccaaattttagcatgcctaacaaaataggccattttaatagtgaacttaggctattttggcttcaatccaaacacaactttgccttaccaaaattagtagtgccaaaatttggtaaggcctatttaggccacaaaccaaaccaacccttaaactaaaattagggttaatgaacaacctttagaacacaaccaaaatcgcacactaaggtaaaggaacaaaacaacaaatcacgttacacccgcgaccaaagccaaaacggaaaacgcacacccagctaagggttgggcatcattgcagcataactaaacacaccgtagaatagaggagcgctttacgcggaactaattaactaaaattaaaccccgctttctcggtcacgggcaggtcggtcccaccaccccaagtccccatccactccaccaccccggccattccattccattccatttcttttcttttctttctccccctcaattattgccgcttctgtccatcccctccccctccaattccattccatcttcatctccatatcttctcctcctcgcgtcggcagttatctcctcgttgataatggcgtcgtcgtcgtcgtggtgggtggtgatgttgttgatggtggtggcggcggcggggtggggcggggtggcggcggcgacggcggcggaggcggcgcacgaggtgctgcgggcgcacgggctgccgcgggggctcctgccggcggggatcgcggatttcaggcacgacgaagggagcgggaggttcgaggcggcgctcggggagtcgtgcacggcgcagttcgaggtcgggctgcggtacaacgcgacggtggccggggtcatcagctacggccggatcgcgtcgctgtcgggcgtctccgcgcaggacctcttcctctggttccccgtccgcggcatccgcgtcgacgtcccttcctccggcgtcatctacttcgacgtcggcgtcgtgttcaagcacttccccctcgccgtcttcgaggccccgccgccctgcacccccgaccccctcctcctcctcacgcaggtaatctaatccttcttcctcgaaccaatcacgaagtgaaatctccacccacctagttcatctctgaattgggcgctcacgcggggcaggtgtgtgaggacggatcggtcgccggcggcggcgcggcgtcgcaatgaaggggacggactcgatggttgaaatcggcgaggcggaaaccaaaagaatgcgcagttttgaggcatgggagtggtcggccggtccgtcgccggcgggccggcatctgtgcagatagatagaatgaacattcctttcgttttctactactagttagtaacctttcattcctcatcactctgttcttcttgccgttcttgttgtccagtgcgatcaaagccggccgacggtggccggtagaggaggctgccggcctccggtcgccgccacggcgataatttttcgtggttatgatggttcggggattacaacgtgttgaatctgtttcttgccgtgggcgatgaacttggatcgttcccggatccaatccagcgtggcgatcggcaaaacacgcgtgttccgttccgttggatgatgcggttttgggtagcacagcaagcgtcgctgtctgtctctctcggcgctgctgatgatgcgtctcctccggtggctttcagtgtcctgttgctgctgctagatgctccggtggcgcgtatctgaggcgaagccgtccatgttggcatccaatgggatcgcgcatcctgcggtactgctactagtctcctcctgatgcgtcagattcggcggcattcgccttctcgatcagctagcgccagtctcgcgagagaatgggcgagcattgtgatctgtgcccatccatgaccaaattgaccatatgccttccctagcttgcagtacctctctccctccctctcgccattggctcttctctgacatgtctcgccaaaagtgagctcgctttgtgcgcgcgggggcgggggggcggcgattggataagattggaccattcaccgcgccacggcgccagtgaggcatgtgtttgactgctgggtggtgtgtgacccgttcttgtctgtgaaatgtgaatactggcatactgcacgcacggtgagcgccatgtaaatgctctctgctcgcgtacacggttttcttctcgcgcacacggaattcttctcgaggtgtaaaccccgtttggtaactttggggtatcaatcaaagcggcgaaaccgtgcaccgctatgtgccacatgggcgcagcattcttcccgagctccgaattgataagttggatctggtacggcgtagcgtacgcattgcatgttgcgatcgatcgatcgatcgaagtcccggcctgggcaataattcgctgctgcacatccacacacaccgcaagctgacagcggctggctgacgtggtggaaccaccaatcggcattacgaacagctcggcaacgcccaggatgactcgtcactgacacgtggatcccatagggcacatcacgatcttttcttagagaagggtattttttatcggcctctacatccgaccggatatatgcaatatttttaaattataaatttagcctaacccaatctaaaatttgctatcatgaatatgctacttaagtcaatgcaaccgctaaactacatgtggcacgtcacaatcctgcctgcgttgcatagtgttctttgtgacaccaatgccacagttggtaacgaacgaactagtcgggggcaaggggcaagacagcatgtttcgcatagcgcttgggagtgaactggtgaagttacacaggaacagcgagcgacagagagggggagaggatcaggcgagcgattgcgtattttgcattacgggagagggagaaatgggtggattggaggagcagcggcatgtgctatgggggaaagctaatgatgggaaagagacaagcgtatcaactgcagcgccttcctgcagctgccgggttggtggagtaggtgacgaccacccgcgcctgggtgggagtgggatgccggcgcggggcaagtgatcgatcgattgaccatggtaggagccacacaggccacagccacctgggtaactagtgtcatcagctgcattttgctcagttgctgcttgccatcgtcgtcgacttgttgccctcctcttttttcactgtccgttgctgcttcttgggttcacttttggtgcgtttggaactttggatagagtattaggtgatctggataggcacgaggaggaagccatgcgatgcaatgggataatatgcaatgggtgatgaggtgtttgggtgtccacctgttgaaactgtgtcattgttggacgggtgacatgtcacatgctgatggggtggcgtcagtcaatcatgtttttgtagattaaccggagtgaagaatggggtctgatgttctatctgatctgatctgatcatctcttgtggatcatcatggttaggcttggcatgatatatgaatcttggtccagtcagcaagtgggggtttttattggtaaattgctttggtaagttaagaggtcacatcactaaacatttgctatgcaaatgtgaatgcgtatgatccctacttggcaaaaacttggaacgtgctgtttgcgtgtcttcgcattcatgcatttctatccgtcgttagacaaccaatcgccaggtcaattgtagtgccggatggctagctggttggatgacactgatcatagcttgaactttacgtatttatttttggagcagatgttcgtatggtaaaatgccttaatggtatacgatctatttgacatcagatacaactttctgatattgattccaattccattcagggaaagagccagagtgccgtacaatttgcacacagaggtgtgtccaaaagaacttttttgcagtaaaaatgtgaaatatagggagacatgaaccattaggcatttgtcacccgtgtgcctgtgtgtgtcactcttctcatgatctcatcacaccagtaaactgcatattaacgcctgaattcattggtagtgccaaattctaggtaaactccggcactatcaaaatattgtagggtaaagttatttagctaatatttggattgctaccaatataaaaccaaactcttatagtatagaggagaaacttctagaatatgaccaaataaggtaggcactaccaaatatttggtgttagtccaaactaacacacatattattcagtttgccaacaaagtggaaaggcatgttttggtatcaaaccaaaacggccctaattaaaaacaaggagggacaggtaaattaattgggccgtcaaactcaggaaaagcccagtctggttcaaaaggcccaagatacaaaaaaaaaccgcaaccccaactacacgtctccggcacagtggaagtctactttgcctcccttatttcttgctcctgactcaatcgcctccaccgaccacagctgggccacctcccatggcgtcccagcacggcggcgacccgcgcctcgaccgcctctcgcgtgccctcgcctccgaccacccgccgccggcggccgccgcggtccacgcgcatctcgtccgcgcgcacgccggcacgccgccccccgtcatccggtccctcctcaaccgcgccattcgccgcctctccaagccgcacccgcgcgccgcgctccgcctgctcctcctcatgccgcgcctccccgtctcccccgaccacttctccctccccttcgcgctcaacgccgccgcgtcgctccggttgctcccgctcggcgcctccctgcacgcgctcgccctccgcctcgcgctcctcccctgccgcctccccgtcgccaacgcgctcgttgatctctacgccaagtgcgacgatctccccgccgcacacaccgcgctcgccgacatcgcggcccccgacgccgtctcgttcaactcgctcctctgcgcgcacgcccgcctcgcctccgtgcccgacgccgagtccctctttgttgccatgccatccagaacccaggtatcgtggaacgccatggtggtcgtctacgtcaatgcaggggacgtctcttctgctcgccgcgtgttcgatcaaatgcctaccagggactccacctcgtggtcggtgctgattgttgggtactgcaagtgtggttcaatgcggagtgcacgagaggtgttcgatagaatgccggcaaagaatcttgtggcatggacagcgatgatcaatgggtatgcgcagagtggggtgccaaaggaatcacttgcgctgtttagagaaatggaggctgctgggattgagcctgatgcagcaactatggtcggcgttatatctgctgcctcgcagattggcagcacggagttggctgggtgggttggaagttatgttgacaagaagaggattgaaaggaacgataaagttcttacagcacttgtagatatgcatgctaagtgtgggaatgttgacgaggctctcagtgcttttagggagattgcacagccagatgcatacccttatactgcacttattagtgggctggcagctcatggtcatgcaaaattagcgcttcaagtgtttgaaaggatgcaagctcagtcagtttggcctgatccaatcactttcgtcggtgtgcttaccgcatgcagccatgcaggacttgtcgataaaggtttggattactgggaggcaatggtgaagtactatgggatggagcgtcgagctgatcactatgcttgtgtagttgacatgcttggccgagcggggaggcttgaggaggcttttgaaatggtgcaaacgatgccaatgggcccccacccaggggctcttggtgcattgcttagtgcctgcaagacgcatggcaatgttgagattgctgaaattgttgcaaacaaactttttgagttggaacctcacaacactgggaactatataatgttgtcaaatatatatgctgagaaagaacaatgggaggaggcagaaagaattagatcagttatgagaacaagactgcccttcaaacagccaggctctagttgggtggaggatcgacagagggagcgtggcaggtttcctttgaggagctgaaaacccgaacacatatctctctttgtttcaaatgtaaattttcagatgatgccaaacagatcttattgaactgccagaaatgcaggagctactgatgccattaaggtactttcacttctttacagttcatgttatatctgaaagatcccaatgcaaattattttgtggaagtattcagataactttattgctttagtaagtttggcatctcaatgaattgatgcggtacagcataataccaacacttgtattttaacctctatatcttagataattgtttggcaagatattttaataaatggtgtggggtaagcaaataaggcaatttgcaatccatatcttaatgcttgtaactgcaagagtttagaaagaaaattttctgtaatctagtatgcagaaaatgctcaggcaagagcatgtcgatcgcttccaaatcaataatttcagaaagtaacagtctcctcacgaagacatgaagtatggaacgattatttgcatcaccatcatgcatgattgtattttgttctgaatgtttggtaaatcatgtgcagaagaactagaacaatagttttttctccatgttcattatccactttcacgaaaggatgctaattggtgcaattattctgggtattattgatcagcctgatttcactcttgacagcgggagcatagtagtctgactacaaggaattgatagacaattctcgttgctgcaagattgttaacttttctgagatgctgcaagctaagctggttttaaacaagctaattatcaggggcggatgatctatggatcagtttgtcgttaaggtaacttcaattcttcatggttcatgtcatgtctgaaatttgccatgataaattactttgatccttttatgtgttcattgagccatgtttttttttaaaaaaatatgcttgtttatctctagaagaattgagtatagtttcatgacacttgcaatttaagctcgtcatcttaggtaggtatctgtgttatcaagaatttaagatgtgtcataaaaaaaaaccggcatccgaatgtttaaactatgatggttcagctggaaatttgttgatatattttgaaattttgctaaccatgaatacaatgttcacttgcaaatcagtaagattagaaaacagatcatcatgacgttggaaatagttatttacatggtgcattccatataaatggccgtatattgttctggatgcttgataaatcatcataggcagaagaactagattaactgtttgtctccatgtcgaatacccacttcaataactggtggttcacccataacgtacactagtgacaacaagctaactgatgcaaattttcagggcattcctcagcttgacttcaccgtctcgatcgcttggattaattcatctagtttggcacctgtgacctccttgacgaccttcccgtccttgagaatcttgaatgttggcacaacctttatgcccagctcctttgcaagagactgcgaatcgcacgcaccaaggaggcttagcacgatttattcaggaaaacagcagatacattccaatcgaataatggtgggtggagcgtagacaagagaaagaaaatcagttctaactgaccttgttgtcttgattgcagtcgagtttgaggaacacaacgtcctggtccttctcggacatctcctggaatttcggtgccatcaccttgcaagggccgcacctgcaaatcaaccagtcagttttacagttattacactgagcagtgggatgagatctgttccctttcttattcacgccgctcatttcaaaataaatccagctcgtgataagactgaagaattcatgcgaggcaacagttcatcaatggagattgacgcgaagagatcagtggagttttgtggcttttgtgaagtaccattgggtgtacatgtcgaggacgacgaccttgggccctgccgacttgacaattggccagaaggtatccttgttcacctccgtcacctgcccggtcacggccaccgcctccgcctcggccccaacagtggcggtgtccgagccgctcgacctcacggggatcaccgcccttgtctcagggccagacaccaccgtcaggctcctcctctgagaagccacaccgccgccgagcaaggcggggaagcgcccgcaggcggcggggcggcatgtggagatggccggcgaggaagccggcccgtgcgaggaggagacggagaggcgtagcgccattggatgggagaattttggaaggtaatggcctaattgggtggcgagttggtgctaggaaggaaggatgtgcgtttttcttcagcagcggcagcggcagatgagtggtgagcttgaaaggatatcttgcattgcttggcggtattcatagcctttctagtggagatagtttcttggcggggaaatgacatggctgccccaggtaattcctgcacttttgtggtggcactccacctatagctttctgtgggatggggcatttccggtatctgaaagatcgggttgtgtggtgcctgcgcatctctgaggtttcatggaggagagagcttgtctaacatttgtagatggctctttgtgtctggaactgatggcctcacgattgacggtaacatggaatcagtatcatagatgtcatagatccttttacatttacacatatgctatgttagattgctagagaccctaatgaagtaaagattagaaactgcacacaaaaggttgtgttgtatagtggttgaattggagttaggcgctatagcgttgtgaacttaccaacatgatgctgggccagtattacttggaaaccatagtaattgaattatgttgacagtgtagacttttaactagccgaattatgttaacagtgaaaccatagtattactccttttctggttgttgaaaacgggatatgtttcttatacaattttacagctccagcacatgcttgatacaatttaacagctcgagtagatgctataacagatatttatctcgttttttttgggttatttccagtctatgacaaacacatcagcaattcagcatcgttttctactatttgtatgtcttccctttgagcagtgaacaaacaagtgttccaaatgcactgtaccatcaaagaatcagtaccacgtgaaaagaaaaaaaaaatcaccagcgtctctagcgaaaagccaatccagctgcacaaacacatcagcatcatcgccacgttttgcgaattctaccctactcgacacaatctcgttagtcaaactccagccgccagatattgaacaataattgtggactgctcgtttctggcttggaaaaaaaacagaggaatattcctgagatattgtaggtaaatgccagatgtcacaatgagtagtatcatgtattacatggatattttctctttgctcattgtcggaaatgcacaggtagaaggtttagtgaaccaatgcaatcaggttcattttctttttgcactaactatcttgcttcgagagtttgagtttgagaacaaatttcacaggctcgtgaatggtagtatcaagtttctgaataacctcatctcaaaataataataataataataataataataataataataataataataataataataataataataataataataaagattctaaataacctactagtcaaattcccaaaccgacacaaaatgacaacatgccaagaaggcgaagatgaggcccaaaaacatgcatccggcccaaacatagccccaaatgtagctgctaggcaaggcccaacatatacggtggaagagacggcccatgtgcagaggcggcttagagcacgcatctggcaaagcgaatgcccctgttactcgatcaggcaactaaggacctgttgaagcttattttgtcatgacacatccggtatatttatagcagctagcgctatggtttgggaggggataccgggatatctaatccaactcaattgagatcctttaggttactgcatatcgctcactgacatgtgagccggagagtgacctacatccgatccaactacattagaagctcttgcttgcaatgaaggacctgccatcgccatggactgcaacgtcctgaaggtctgtatagattcagattgtcatgaaagttatttcgagtattgctacaagatcaaaatgcagatacttggcagtccttaatgacaccaatataagaagacgtcaatttgttaaagcagaattttgtcatgaaagttgggatctaaatgtagatgcacataatttggctaagtttgcatgtactttaaattatgaggggcgttacatgtggctgttaaaatactttccctcccattaatgccttattcgattaatacaggaggatggattgaaggggattgatgggattaattccatgcaccttagtggatgtagaacaaatctccctcggaatcaaggtgtggaatgaatcaccctcgaagatcgatcaccttgagattaaccgaaaaaaaccttaagaaataacgtgttttttttcgtaaatttcttaacccattcatgatttcaaatgtttagtaaaccctagtaattctatgtggcatgctgtgagatggatctatctcctaccatgcatgaaaccagttagtttcatagaactacctcataggagaaaaaaagcatctcctttactggaaaacctcacctgttttgtcaactgtgtggggaaattgaatcaattaaccatattatctttgattgccccattgtttttttttttgtttggtgtgcctggagagatgccatgagttgggggcagactgccaggagttttgatgacatttttttactggtagagatgaactcaattgctaagagcaaatctgttaagatgtgttgaattggtgcaacggagtggtcactttggttgacaagaaatgcaatgatttttagagaaaaaatcgtttactatcctctaaacattccttttcaaatcatttcccttatgctgcagttgaaacctctgcttcaccctgatcagaaacaaagtctggagatgctgatgacccaccttagggagacgagatcaggcctacgctcaagaactgggattggttaacactgtgtccttctgaacctgattttctatttagctgtcctcgttaggtgatgtttagagctagtttcatgagagtttttggttggagttagcctggagttgtttctgtttggttcattgatacttgcaatccctatcaagccggggtgtggcccattaatgttttttttttttctgcttttgtgctgaacctctgtcaagctggcatccccagcagactcgtggcccgtgatggttttcaatagaagccgggtccttggacctttttctaaaaaaaaaaactcacatgctggatatatatatggtaatgtggaactgaaattgggcatatatggctaacaaagtttctgtacaaaaaatacacatatatgaaactgaaattgaaattgggcaaatgtatagtcaacaattttctctttttacaaaccagaacacataagtacgtacatgttttgaggtcgccgtattttgatcttaacgacttaaccaattgctagatcagtggtgatcgaattcttgtacaacacatgcgtccttgttcctacaaggttaaaaagaaattagaaataccgacggggttaccggtgatgacagcaccaacggtgcagatggtccacagcaacgctttcacgaccgggctgtccatcgtccacggcgacggcgacgactcctccggcacgccggtcggcagctgagggaggatcatgacgccgccgccgccgccggtcgccgctcctctcagcatattcaccagacgcgccttgagcctttccacccttgtgcgctgctgctgctgcaggcgcgcgccctcgtactcctcgcggaagaggtcgttggcgcaggcgacatggatctggacgacaccggcgccgccgccgccgtcggagacgtacccccaggtgtgcctcctgtcgccgagcttgacgtgcctgcacttgcagcacggcgacctgagcttccgcgtgagccgcagcttcgtcacgctgccctcggcttcgatcaccttcggcagcgccgcgcagcaggggtgcaggaccctgccgcgtttgagcagggtgcgcaaccttccgatgtcccgcacgtacgcataaccattcacctgcaagcgtgcacaactgattacacgtacgtatactagcttagagttttctgcgatgtagccaaaatcttttatatttggggacggaagatcttccgaatcatacatatataaaacaacatgcccctctcaaaaaaaaaaacatgccaagtatcgtatatttcgagaattgcatgtaggtattgagaaaaaagaaacacctaaaaccaactaagacacgatcgacaacatccgtgtttcaaaagtttttatttggacgaagctaattaaggtagtagatgaaaaataagaaaacatcgatcgatgacaagaaacatgatcaagagaaggagagatataatgggaaactattttaatttcttaaggggatatcctctcgttttgtgcatgtcactcaaatgtttatgaaaaatgtgaaaaaaaaaatctgagaatatgtattaacacgtggtctatcactccacaaacatgcaagtttaaattcaacttctacatctcgcaacggaaaaccaaattaaactataactagttaacgtatattcacagttaaatttgtttttttcgttgcgagatatagaaattgaatttgaacttgcatatttgtggagtgatgtaccacatgttaatatatcttttcagattattttttcataattatttgagtgacatgcaattaacgaggggatatcgcacgagatataatctagaaagaggtgacttacgttgcctccgcatccatcgcagcgaacgtcgtcctgcactgtacctgggaagagatttatggaacacgaggctgtaacgcttgaagggatcctggtaagaatccccgaacctgtgctgcgcgcacgcctcgtggagatggaaccccgcgcgacaccctcccagcttgcacacgtatctcatgtggtacccgtgctccttgcagccatcgcaccggaatgactccttcccggccgtcagtgtgagctcatggtcgtggtgctcgggagctcgaagcttactgtgccccgtcatctcgcaaaaacaatgaaatcaagtgaagcggccggctagctatgatatctacgtgcaggtgcatatgcatcacatatatgcaacaatataatcggattgggaactctaaaagcaagcgttatacttggagagcaagaacgtagagcatgctgctatcatgctactccgtgatcccctctttatatactatataagacctggccttttggtttgttttaagtcgcactttttaaagttgatcaacttaatttatagaatgaatgtagcaacgacatttcttaaaaaaaacaaataggctgtaaaaaattcaatggtggtgatgaaactaattttatgttgtagatttcgatttttttttataaaccttatgtacttaaagaagtttaactcagaataaactcaaaatatcttatacttcctccatttcacaatgtaagtctaacattttccacatttatattagtggtaatgaatctagataaatatatatgtctagattcattaacatcaactagctgggtggcccgcgcaattgcgcggctagtacccaaacaaaatcatatatttttttagtatgattttacttaaaatttattaaatagctatctcattgtcttaagattttgaaagatcaaaccttatcatcctcgtgtttctaattatatagtttttaaaagtcacaccagttgctaccccttatgtcatctacttctttatttgcttgctcgatctaccaatatttctattcattcttcttggaacctttaaaaattggattttatagtttttagagtttattgtcacattgggtttcatttttataatttctagatgttccgtcaaacgttaccattatactcctgtgtgacatgtccactgtctcttctctttattgtcattgagattttaaaaattgaacataattatcgtttgggttcattttttactttctagtagtcccgccaaaccgtcagcggctttgctattgtactcctctacggcttgcccgttgccttccttctttattgtcattgagattttaaaatcgaacatgataataattgttttttttttactttttagaagttctgaaccttaaaaaattgaacttgtagttttattttttataatttttagaagtcccatcaaacgatgccactatgctcctgtacagtccgtccgccacctactctttattgtcattgtgattctaaaaatcgaatataactatcgttggaattcattttttattttctagaagtcccgtcaaccgtcgacagctctgcaactatactcttatgcaccccgcccgctgcttctcctttttattgtcattgagattttaaaaatcaaatatgattatcaatgggttttttttactttctagaagtcccggcaaccgccttacttgtttacttcacggtctgcctgatatcccttcttttaatcattattaggattcaatttggtgttttattaacaatttttatatgtcgtaccaaccgccaccactctactcctttataggcctgttaattaatttatctcgtcatgtgttttagatggtcttttcttaacaaccgacaccttgtaagcttcgatgcctcgtgagcatggactcgtttcaatgatattttttccgtattgaaaatccaatttgaaatttatttcatattttattataaatataattaatctcattttgaattttagatggtctgtgtaaaacttataacctataagccttatattttaggcttaactacattaattaacactaaattatgctccgaggtgaatacagctccgagctgaatacgtttaaaataaatttacacgattatgattataatttgttgtcagttgccaatgtggccggacgcttctgggtgggttgcatgcattgctggtctggaatgctggttgcagctttgctttgtttgctttacctattgggggcgatggtaatcaactttgcttgtcacttgttctgccgcagcagcccaagtatatctacttcatatatctgcgttttatatgtgcggtaacaatgcatatatacttgcgttttggaatcataacaaattctgtaccgtattgtatcccgcttgaatttttgataccgtatagtaatccaattggatttttctaaacggacaggactttttaatctatatcaaagctctataattctttattttttctatagcaaatctaaaccgttgtaatctaaatctattataatccaacggtgtataattttctctttttctccgattaatgtgagaatttctagcccccacagtgaacgtggtgccttcttttcgagctgtcttaataatataatagaagatatgaatgtgggaaatgctagaatgactaatattgtgaaatagagggagtaatatggaacgaaggggattgtgtgatgttgccttaagacaagttggaccactaccttgagttatgtgagaaaaatcacacctctctacgcgtggtattaactaagtacgcgtaatcaaaaaataatataaatttcttagggatatatatctatcgtgagaaagtactatttgtgtccctactaaagatatcatcatcgcaaatgggtgataatataatcctcatttgtaatgggtatccactagagtataagtttggatgtccatgaaaatgaccttgactcgagactttaagctattttcacagcttatgcgagaaaaatcaagctcttctccgtgtggcatcaactacatacgcgcaatcgaaaaatcaatggaattaaatttctgggtgatgtgtctatcgtgagacgagttataattaatattggtgtgtagtgtggtcttgaaatttgagtgcatcatttgatccagtagagtttaagtatgtgtgaatatgacttagcttcaagacaagttgggctattttctcagcttgtgtgagaaaaatcacacctttctccatatagcactaaccatatggatgcacaatcgaaaaaaaaaatattgatactattcggtcaacgtatatggtgagaagaagtatcataggtgttgagttaagtttaagtatgtacatcacttcatccattagagtttaaataataaatatataagaatatgcgttggctcatatgacataagtaatacttctagaataaaatacgtcatgtaataatatttaattttaagtgtgatttctcaattacatggaattcaactagtttaaataaaatataacagggaaacttttaagtttctgctaacaaatgagttactgaatttctaccttgcgagtttgcgaggacaatgtatagaagaattatatggatagcgccacacaagaaaactcatctaatttccttagtgtacgtactagcacctgtttatatataacgtacgaatccgggactagagagtcccaggactgccgtaagatagggagcggcagtcccggttggtccatttttctttttttttttcccttccaaattgagtgagatgtatatacctaaatcaaacaccagatccccaaatcgtgtgctatgcatatacctaaatcaaaccccaaatcaacgtaacatcccaaatcattcacatcacaaatacaaatcctaagttacttacacacaaatcaactacatcacaaatcttaaaaaaaattacacacaaatcaaatgcatcatagatcgattatacatatcagatccatgcaataaatcacaaattgtaataaaagaaattatacatctcttaatcacaaattattaaaaaaacggagaggagaaccggcgcgttgcctcccgcctgctgccgctcaccacggccggcacgctgtcgccccgtgcgcggccccgctggccgccgccgcgtgctgccccaccacccgctagccgcttgctcgccgacgctgcccgccagatgtgaggaggagaggggaagaggaggaaggggggaggagaggggaggggaggaaggaaatacgagggatagaaggaggatatgatcttatctaaatattttggtgaggaggaaatatcatctgggacttaaccgatcagatatggagagaaatatttacttccggttggtagtatcaaccgggactactttagtgccgattgatacctcagcctcctgacatgcctctgacaggggtttgtgttactaaccgggactaaagatcaaaatttttataaccgggactaccggttcttattggaaccggtattattgtggaaaacagccgatccagcaaagatcatttttctagtagtgtagttttatctcatgtcaaatttatattcgactttattcagttaacgcgttgttaattcgtggtcgatcgatctagtttgtaggtgtagctgccgcaagataatatgcacaagcacatggatcagattaatagctgtcgttttaggcactacgccatttatgtggatcaggacacatgttgcaacttgcaagtgacatgaccgcaagtatatgcattgaactagtctaaaaataataataataaaaatagtctaaaaaagtagtatatgcattgaaccagtcaagtaaacgcaagtaaactaggtactttgatagtctgattgacacagacatatgtagcaactaaccggagtgtgtatggggcacaacgtacgcattcaaaacgttgggcattcaggcatttcagggttatgggtcgtaagtgaaaaaaaaatgtgaccactaatggaaaaacgcagttaatttacagcaagacttttatacccttacctttagttagtggaccaaaagatatagctaagtgataaaacgatgaaaaattcccaataaatcctaagagtacgctttaaaactcaacattattaattgtctttgaaacaagcaagcctaatcaacaattctgattttttttttggtggatggcacatggagcagtgttgatatgcttagatcgaggtcgtgcgtttggcggcgaccttcgtgagcgtggttagcggacgggaaccgcggcaggatgtggtgtgtactttgtggcagtatccttgcctagtcggctttgatgactttggaggtggtaatatctaggtcaacgactgatattctccgatgttactccagttctatttaggttcgatgtcagatgtgagcaaaattcgattagcacaataatcagccgctgatttcacagaagataaggacttcatacaacacaaaattcgattagcacaataatcaaccactgatttcatagaagataaagacttcatgcaacttataagccattgagcagaaacaacgaatggctatgtagattctcgccaaacatagattaaagtttagcaatacctattatctttatcttaaggttggtatttttaattcgtagccattcgatccagccacaacctacgtaataattggttatagcttctttgtagcatatgttgggatgaatttcattttaaaaaatgtgtattgctagattccaagagcataaaaatttgcgaaaattaggtcacctaaaaattacacattcataagcctaaaactgcatcggtatgcaatatacaattttacttatttttaactataatattattcttatatatagttttgatttattaatttgtatctgagcttgagtacttctaaaaaaaaattaaatctttatctttcatgtagtttggtaatatttattttttaggttagaatagtttacaaagtagcgtgcctcgctataagacatgtcacgtgtgtttgtcatctttatatatgatatccttataacatgctttaaggcatgttatacttgagtatgaagtatgaatcttttcactcccccccccctctcttcttattcccctttcccttttaaaagttgccaactatgcaaggtcaattagcagcacttctctcacgcatatgcaagtagctagtagtgcatgtgcatgggcgactgacaaggagcattctcgtaagaataatcaacaccttatccctatcgatgcctatcgatgtactcgtttacttggaagtttggaagttcacttgccggttcttacattctaaaccccgcgtggtacgcgacgttattagatactacatatactgtgtacctatatgtttctcccactagctagctaattaattaatctctcgtacgtttctatatatataagtgaccgcgagatcgatccaagccacggtatgctatgagctactgaaacctacctagctactcaaaagatcgatctagcttggcgagcgtgaggtggtgaggtacgtttacgtacgtacgtatactcagcatggccgggtacaccgaaattttggacaccaaccatcacgagcacaaggtgtgcttggttcgcaaggacgaacctttcatttgctctggctgcaaagagctcggcttcgagctccggtacgcttgccacactgcgggctgcaaccatcagtaccacaggtcctgtacactgcagcctctcaacactcgcgtgccagctcccttctacaagcacgacttcttcttcttcaagtcggtcagtacagctggtgcccgttgcgaggcatgcgctgctgaggtctccgctctcttattcttaattactaattcctcctggcaaggtttatgattagatatacttaagtctggcttgtatatatttatatttgcacgtatttcgaataacataaatacatatttaaaaaccaaagtaattttgaataagataaatgcatatttaaaaaaaatcaaaggagtcatccatcataaaattaagccggtgataatacctccgaaacatgagaaactatttttatcccttgagggatgttccctcattgtttatatgttacttatgttacttaaatagttatgaaaaaaattgagaagatatattaacatgtgatataccactctacaaacatgtaagtttaaattcaacttatgcatctcgcaaaaaaattaaattatagctagttaacatatattcacagtcaattttattttttttctttgctagatatagaaattgaatttgaacttgcatgttcgtggagtgatatatcacatgttaatatatcttctctttttttttaaatttttttcataattatttaagtgacatacaaacaacgatgagacatctcctcgagttatcagaatccactcccccgaaacatatgttgatgtttctttccttggatggcgaggcatgcgctactgaggtcctcgctctctccattcttaatacttccttccggcaaggttgaccttgactgcaaattaatactctctatgactttttagtaaagaacgtcgttttgattttttacatagatttcatcatttgacttattaaaattttatataattatgatttctttattatggtttggtttatgattacagttacttaagtatgacttgtatttttacatatttgtacatattttgaataaggtaaatgcatattaaaaaaagagacgtcatccgatccattgtaaaagccggcgataatacctccaaaacatatggagttgtttcttttctttggatgtccctcgtttcttacatatcatccaaacaatataaattatttttgacaacattaatcaatatgtaatatatatatatatatcattatgtaaacatgtaagtttaaatttgactcatacaagttgaaaaaaagataatgaaactaactagcaagctagtgtattgttcacatattcacagtcatatttattatttctattccaacttaatttgtatataggttgaatttaactttaatgtttctgaaataacataccacctttgatctatattattagatatatttttttatttaagatggcatcgaagaaacgatgccttaaggagaaaaatgactttccatgaaatatatatgtattcacgaaaatagtattagtagattttttttcctcaaaactactccttcaatttaatcttttagaagaataaagattaaaaggtgctagccatatacattgagaataaaaaagttgagaagatatattaatatgtgatatatcactccacaaacatgcaagttcaaattcaatatagaagttgaatttgaacttacatggtttaatttgtttttttcgttgcgaggtgtagaagttgaatttgaacttacatatttgtagagtgatatatatatcacatgttaatacatcttctcaaattttttcaattttttatagctatttgggtaatatataaataacgagaggatatcctctcgatgaaaatagtttcccagtagaaaaccctttcccgccgttaatttacaccatgctttaggaagctcgcaggtgcgaggttacgtgtactactgcccggacaagaaggtcagcctgcacccttgctgcgcagatctcccccgcgtgataaccaccgagacggtgcagctgaaactggagaggaagatcaccaagaaatgcggcatgtgccacgagcggaatcaggggagcttcagcaacccatgggcctacgcctccagcgagaagatgatccagctgcacgtcgcctgcgtccggaaagctctcgtttcgcagttcgagtcgaggctttacggcgtgcaaaagccgaagatgctgctgccgccgccgcctgctgctggagcaagcgctgcttcttcaactagtagttcgactgccattgtggaatgcaacagcttccccgtgctcgaggtggataagtaccggaggaaatcggccgggttcctcgatacgttcaggcggatcgtcagggcagtcatggccatggtctcggcggtgatcaccgggaaccatttggagatatacatggctttcatagaattcttcaaaccgaactgagctgacaacatttgcatctttgcggtttggagctcgtgtgtttgtgcgcagcaccagtttctccctttaaattatagatttgctttcagaacttgaaaatgggtttgggtggtgtgtggtggttcttgcaagttgtaataagggggaaaaaaaggaacacatttgttcgtacaattttcaacatatatgtataagacgatcagtttaactggataaggtggttgtttaagctgcagagatgtttttggattttgagttatgacaacatgcaaatgattttccgaatgtaaattataattaaattttctttcagaacttgaaaatgggtggtgtaaaaaaaaacatattcttcatgcaagggaaccgtgaatagttcaaagtatagctcaggtgacatggtgcgagggtgttcgcccagtcaacctgggtcctggttttgaatcctaaatcagacttgtcgggcctgttcactttaatgtcattttcaaccttaccaagttttaataaagttgccaaaaaaatggctacatttagtttgtagctaaattttggtaactatataaaaaatcctgccaaaattttggcaagttaccaaaattttcgcaatgccaaaatttggtaaggttttttttttatcaaagtgaataggcccgtcatctcatggtgtttcttgtaccccttattcttaatacaaagatagccagctccgttattcctcttttttttttttgaccaaacgttattcctcttttgtttccaaaaaaaaaaggaagcgcaatctggcatacatgcatgcaaacacgaaccacttaacagttggaacatctgaaaaccccggccagccagatgctgaatcaactgtcgatcatgccgctgataggatttcgttagaaatagatacacacacatatatgcatacactgatacacaaaagcttgacctggagaatcaggccagagtatcaggttgagttgggactgtgggagctagtacaatcacagagtcgttctcaaaaactgtacaatgaagtagagaacggccaggaaaagcgcaatctggtacacatcttggttcaatccatcatccggcctttggaagaactgcaatattgaacacaaaagctcaaaaagttgaaaacactatcactggatagctacagataagtgggtgggtttatataaagtgacatcaatttttgcaatgtatgattcatgtaccttagtaggatcccctgagggatctggataaacctccaagttctcatctttctttgatgatagccgagatgctgtaccctttgcagcttcgattgtgtcctttccggcttcaacagtggagaaggccctcctggacaaccaaaagtaggcctgggcaggaggagacgaggcagagaggtcccatgagtcgacctgttcgagcacttggccgctaatctggttcaatacgaactgtgaggtaacagagacgatcaggtctcctccgatggttgcgaagattggattcttaggtttgcctctgaatgtccatttgatggtcaggttgcttgtcgattgcattgacatttcctggactgtctgacgcaataacacgaatgctgattagatagtcagactggaatcaatccaaactcatgagcatgccaatgtgaaataaggagagaggcattctttgtttgaatttgaactgacaaagtcctttttcttttggacagtatgttatgcaacttgtttgggttagatatcttacaacagagttctaacttcatggatatggtatagaattgcagcaatccttaccactgtagggttttcgagtgccttggtgatccacaatggcctcttgtacttctcccgtccaacaaatgttctgaccgggtcctgaaaaaaaaagaaaggcacgaaaccacaaggtgatgtcaagtagctcatcagttattgtatctgcatctggacatcctaatctgtcactagttcagtagtttgtttcttgctgttgtttgagtggtactttcgttgctattcttcttaatataaaatcagcatcagcctggctaaaacttctgaaaatggaggcatgttacctacttaaacattcatcagatttcctcggggaaaaaaaacattcatcagctaacagcagtattttgtgttggttcatagagcttttgcaagagcttctcggggtctactctgtgcctgaaactattcttgttggtgttgctaaaccttcggagcgaatacgcaaaagcgttactcgctgattgaaatggcatagctctatttttcccttccaagaaaaaaaaaacagatagtactgttaaaaaaaaaactacagatagtgtttgccacagttcatggaatcccatgatcatatcagactcgtagcttacatgtttgctagattaacttgaaaggagatgcaaagcattggtgcgagattggtaccaaattaatgtctgaattactgataacacatagtacggagtagcagtaaagtggtaattggtggtacaagggtgatgcgcacaccttgtatttgacggagacggcgtagcaggtgaaggcgcggttgtcgtcgcggaggtcgaggatgtcgcgggcgagctgcctcgcggtggcctccacgtaggggctgcttatgcactcgaagtcgttgcagagctccccgaagtccatcccgtccaccagcttgtccgtctgcgacctctcctccgcaccatctccggcagccgtctctacctccttggaatcatccacaactgcaatcacgcacagagccgggagttaattagatcacgtacgtgcgagctggaccgcacggcgagatcgcattggtgagatgagatcttcaccgtgcaggggggcgaggcggcgttggagcgcgggagcatggcggcgggagaggaagccggtgacggcggcggggatgcctcgccgtcgccgtcgccggggggaggaggagggggaaagggtgcgggaggagaagagagcggcggcggtggcggtggcggtggccattggtggcccatggcgcggtcggcgtggcgggacgtgaaaaggcgggaggataaggcgcggcgctccacggcctctcgttgccacatgtggcctccgctccattagccctggcccaacaactgctagtccattccatttctcatttctcttctatttttcctcaatttttttaagggaaaacaaaattggcccgtgccaactactataggtctagtattttctagtggactgccttcttctaggcccaacgaggaagatgtatcccaggatgggcatgactttcctgagctttcacgtgcctctagcttcgtgttttgttgaagaacacaatgttttcttatagaaactgttctagaaaatcatgcgtcacttatgtaattcttgtattctgccctctctgtttcatattcattttacgagttactttgattaagtatataaaaaatatcatagtattttcaacacaaaacaaacgtattattgtaacatattgaatattagatttgataaaactaatttaatgtattagatattgctgaatttatttataaatttgatcaaacttaaaaagtcaaaggtacatgtaatatgaaacagagaaagcagatgggactgcaaatgggagatgattttgtggatgaagtataggtcctgtttgggggagcttttagcagctgcagcttctcctagaatcttcagttgccagaagctcccccaaacagttcatcttttaatctagattttgagaatctgtagttgtagaatctgaaaaatgaactagaagctagaagctgggacccagcttctccagattctcactagctagcttctcagcagctcattctcagaatcttaagctccccaaacaggcccatagacacgaagaatacctctgttgctccaaaactgcccagtttacggacaacaaatcgaaagatgcacctgtgatccgggctacatgcaacagataaaatatacttgcatcgaagagtactttactcctggaggtaatcatatacagtatggtgataaagtagtgagttgtcctctttgtagtggaggaggtagtagcatttgtcgcagaaataacagggattgttcagagtccacttgtcgtccaccgtcatcttcgtggcatggaagatctggcacaccgaacacttctgtagccgcctctgcatctggaatgtcatgagagggtattccgcttggttctgtgtgtcctccgggtggatcaacctcatgtccctgatcacaatcatgtgtttgcagtttccctgaaaacgtatgtgcagggtattgtcagaaacatgggggaaagggttgtagatctctacctcaaccatcatacattactacagcttcaagttaatcgattttagatttcatcacaaaacatagataacaaacaacacaaggtttgattgtgactaaatgacgatttgatttccacaaaaaaagtgatgcagaaacatcacaacaataaaggcataaggagaatagataagaacctgatgacagtagaggtacccagcaccgagacggaagttcagatcagaaaagcgagtcttttccatttttgcagatttaaaatcaggaacatttgaaacattcaaacccatcagtaaatccttttgtcgtttcttcagcacaccagaagtaatggcatcccacttctcttccgcctcatttctggaatttttaatccagtcaagtataggtttactataatcaacagtagaacgccttgtgtcattatagaatgtgtcctgacaatagagagcgttgattaatacagttgcaattctttaagaacacacagcaaatttctgttcacagatgcatacctcaataagaaaataaccagaatgaacgtgttgctttgccacattcatcagcttgtctttgaaacagtaaatattgtctctaagatctgtaaggagctggcttcccaacactagaaattcctggctctgcaaggaaaggagatcaccaaaaaatttattccccacatatttcaccctacaaataagtataccaaaaaatatatgtatataagtcattactttcacagagccatatctcttctcataaacttccacacacagaagtacttctggatagactacaggtctgtgctccccaggtttgaaagttttgttctgggataacaaaaatggttagtgtgaaatttgagacaaatgagccacttgtgtaaaagagcaaatgaaataggctatagtttttaatgcaaaccttccaagttgtgctgatgtacctaagagattttgcaacatcaactttctcagctgatggcttagaaactttggccaacacagaatcaccactgcgttcaaaaaaatatgtttatagaaggctgtaatgaaaacaatataacagataaaatcaaatcatctagttatggccataagtgcatagcctggacagctgtattttatacttatcttattctctagtggctcagttataaaaaggaagcaaactattcctaccgggcataccatatatgatttacataaatgggctaataaataggatacatgagtaaatgtatgggctaatcaaaatccagtattaaggggaggtaaatttctatacctagttagttcagccagcacagaagtaccaattttttactgaaacatgaatctagccaaactgggctgcatcctgctatcatctgaaccacaaagaacgatttacattacttttacactgttatttgccacagcccatcagtaaaagttcaaattacttatcaacagaaattccacagctcttcagcaaagctgtgataacaccatcccattcggtagaaaattaaataatatatatctatgagcttatggcacaatcagaaaatggaattactaacaatacatacccacaaatcaaggtcaaataaatacatgcccacaaagttaactgttttacctgaatgagtgcaagctggctgcatgtttgtcttcctcttgtttggccttaatttctgccatcttcactgctttagtaagatagctcccctagttatagccatgccacaacatatgatgacgcaaaaccatggtcagattttccagagattaacaatagatgcaagaagaagagggaaatatgtatatatatttttttagagaaaactactatacaagataaattcatcagaaaatgcatgcaattaagcagagatgcaacattagggtaaggcatacttgtaaaatatgtgctcgaacttctctatcaaaatgcctgcctctctttttgccctttccgcattttgtatctccatctgcgcctgcagcatcatgtgaaacaacttccagatcctcgacaggtggtacagactcatgtgaaacaacttccagattctcgcctaatgaatttgaagtggtatttccaccttttttcattcttcctctggatttccccttcatgccacctgttttcccttcgatgccttgttgtggtacgtatggtacaactgccgtgtcaacagatggtccaggtatctccgtttcaactgacgaatttaaggtcggagtgacattttttcgcttcctgcctctagtttccccttttacccctcttgttttaccgttgtttccatgcacatgtggtatgcttgccgtatcctcagtaggtgatctggaagtctctctctcacctgatgagcttgatgtgatagcaccatttccaaaggtggaactagctgacattctgcatgtgatagttcgaaagaacatcagaccctatcattttgtgagccacataagacatgaatattaaatataataatatgaaaagaaaatttagatgccaggaattcagctacaagccataaaaattgaaaagagatgatttggtgcataaagtgcaaaccgctgttccatgctaccaattcacaatagaactttctttatgagttggcatggaatgacgctatccaacaattaaccgtccgtgttgcatctaattccaactcgcataaaagaagcaccaatcaagcaaaaatagcttaccctccatcaatcctctgatcctccagctgtgacaaagcagtggaatcccagccctcctaaaaacaccaaataacagagacatcacatcaaaatattgttcacaaaactagaactacaattaagcacattagcataagctcgataggaacggtcacctccatagcctcccggagagcgcgctccaccagctcctcctctgagaggaccctcaactcatctacgctgcagaatccacaaaatgtacaaaccagaacacgaataagcatatgaacaacatgacagacactgggggatttctccacctgatacggcggaatttggggggcttaccagagctcttcgtcgaattcatcaccaggatcgcccaattcatctttcagcgactgctcgcaaagtaacacagaacgcgattacaccaaagcaagggcacggattgaagagctagggtttggcggtgtgctcaaggggattcgaacctgcagctcgtggagcgcggaggacatgaactcggggaccgtggagacgggtccgaccatgaaggggacgaacacgggcccgccacgagcgaagggcatgcgccgctgctcgccggcggcagagctctccgcctcctcccccgccgccgccgccgccatcgccgtgtgtccgcctctttcgctggttgggggggttttcggcgccaatgcggtgggaagaaggctaaaagctactgggcccagtataaagcccaatatgaagaatcactactgggccgtcgtcgtctccgtcgagtatcgtctcgctccagagcactcggctggcgggcgaattttttttttaatatttacagaaataatctatcgaccaaaaaaattgcagaaatagcccctgccgccccaatggtgggcggcaagctgacgtggcagacggtgggtcgaccacgccgtctgccgccgtcggccaaaattgcgattagaccctagggcggcaaggggctaattgcaattttggccgcccataaagagcttgcggccgtaattttttcatctgggtcccttgccgccccaatagagagcgacaagggacccaaatgaaaaaagtacggccaaaagatatttctatgttatgttaataataaataaagaagtatttattggtaaaacttgttaatattgttataaaaatgtattgaagttggttgttgcgcaatttcatatgttaagtgaggtattattttgtaccttattcgatgtattagtactcagataatttatataggcctatcgcagtctgggtcatagaaacattatatggacttaaacaaggagaattatgtaacatgaagaaatagtagtacaatttgaacatgatacaactatttccattgcggttacatagatgatattagattcgaactaggagggaggtagtgcaatagttgaacacaacgacgatatagtaatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtatctatccattctctgtattgacatctccttggtggttcctgggaggaaagattaaatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacaaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcaaccttcttgtaaacaagtggttaggtcgagaacgggattttctgtatcgacccactcgatgtatgcacaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattaattggcatcgatcaccgcataggcagagaggacgctggcaccaaggtggtagtaggtatacacaaggatcgctacgccagtttggatcctcaacaccccggcgtctagccattgacgaaagccggttggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggcgccgaaagttacatgcatgatcggcgccgaaagttacattggtcgtatgcgccaaatggcgggcaaatatcgtatcgcacgcgaataaaggaggctgcatcggtgcggcagaaagtagtcatgcatgcgccgaaaggtatcgtgcatgcgccgaaaggtatcgtgcacatataacaacaacgtagtcattacacaagcatacagtactgaaaagtgaagcaaataaacaaagagaagattgctctactggccctgccccgcgccgcgaccacgcttggtcctccgggcctgtgctcgcacgtagtcctgggagtaggtgaaacgatccggtggcacagcacgggtagcacgagtgtcccgcggaggagtggcctgcgcctggtcctgcgtctgcaccggcggtgcgcctcccagctgtgaggggccgatgacatcctctgtcgagcctgaagcgaagtcgaagtcaaagtcagtgatgtcgaagagcaaggtggaaggcagcaagcggtccgacgaggtcccagcatggtccagtggtggaccctgactcgacgtgccggctgcctgtgatgaagtcccggtgtactgccagaactgcgctaagtgcgaggtcgacgcagctgcctgagacgctgaccttgcagcctgggagaagtgggcggcctgcgtcatagcgaactgggcgaaacctacacatcgacaacgggacccttgtaagctaagacataatgcatgtaaattgattgtcgaagtaatgttgtttttttaagtacctgtggggggcacaacagaaggcctaaccgaggaaggcggggtgctgaacggtgcacgaaaccctgaagcaatcggcaggtgaaacggctcacttatatgtgcgaggcatgtacagaaatagtaataaaaatacttacctccgtgcggagggggagtcggcctaggaacgtgcgcagctggacggggaccagtcagtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaatgttggatcgtcgttgaaccatcaacgacgacccggttgatgtcgtcgacctgcatggttaatttgttcgtaaatattcgtaaaatttgatgaagagaaagacatgaaaacataaaggaatggtgcgatgcagggtactcacagcacgagcgaagtcctggtcgtggtgcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcgtggtccacgacctcctcggttgcgaggaaccagtcctcaacaaaagtcgccaacgttactagtgcgaaacgtgccgtcagatcgtcctaccagtccacagccgtggtcactggcccaacagcgtctcccgcgagcggtagccccaacaagtacgatacgtcctgcagggtaggggctacctcaccgcacggcaagtgaaaagtgtgtgactctggcctccatcggtcgaccaaagctgctaggagggacctgtccacagtctattgtctggccgggtccgcgtcgccggcggcagcctccaccagccgacacatcggtaggaggccggcctcacgcagcctgcaataacaaattaatatgtcattataaaaaatattacagcgcaactaacttatagtaatacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatactgacgtgccatctctgaaaaatatagtgtttcgtgttagaacaattcagaaagtagtaatgtaaaacaaaagataatttgcaaaattatgaaatagtaataaaatcatgagaataattatgtacaacaagagtacaggctatttaaatatagcaaacgttactaatggtacactccgatgacgtgcaatttaacatatatgtagagctcgataatataacataacattacgtgtcgaagtccgacatacatcagcatacctaaagacgttaggcgccttagtccgacgttacatcacgagaccaaaagacatgacatgccgaagtctgacattacacgacgaaacatagaacataagaactacaccacggagccagacgtggcacgacgacgcctaggacgtggtcgagtggaggtagtgccttcacccgtagggcgagctccatctgctgttgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacatatattgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatactcatgcctgccttatcttgacatagtatctcaaacctgtgctgttgggtaccttgcactagagctcgatgtttcatggcctttttatgcaactcctctagctttttctgcatgaaagctccaaacaaaatgctgttattcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccgttgggagaggtccaagagcttgaggagggtcagcaacggcggtcgatggagctgctgcacgctgatcactgcatttggctgtcaactcatctaatctcttccaaagctcattgaattttttctcctggttatgattgcacagcctcttgaacatgttcatgagctccttgttcttgaattgcttgaagaaatcagcccccatatgacgcatgccccacctactctatacatcttcccaaacaccggggtatcctcgttccatactcccaaactgcaactcttctatcgctcgcagaatgccaacgtgcctatcatgtatcatgctcacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacaggacgacagttcacgaatgctatcttgcatgcatgtagagctaagaacgccctttgcagcacactcttgccaggatgttcaattgaggggaatttcttcacttcgtaagagctctcagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatatgcgtgcactctccagggacaaccatcttttttcttaacacaccgaacttcatattgcgaccggttcgacttggcaacccaaaactctctatgaagtgacactgcaaaatgttttactgcttccttcatatcttcttctctactataaatcgctccctgaataacctcattttctttgtgctcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccacttcacctggttgaatgcccactggagctactacgcccccgtcctctcgtgcgttgacctcctccacagaagtctcatttacttcagcacttggtccctcgccatcatccatgttcatctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaactatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaatgaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatctggcagggcttcgccccttcttctcttctcctcccctctcttcttttttttttcactggaattgaggagggaagaatgagggctgggggctaggcggcaggccttttataggcagcgaggcctgccgcccggctagagggcggcaaggggccgcctgcaaaatggccggccccgactggcttttttgcattcgggccccttgccgccccaccagagggcggcaagggttttcctgcaaaaaaaccctccctccgtcaccgcccgttcctcccccgtttgccacgtcaacttgccgccctagaggtgggcggtatggtctatttttgtaatttttttggccgatagattatttctgtaaatattttaaaaaaaatctaaaaccgaaaaaaattcgctggcgggctgggtgctctccaccgccgacccgtgactcggcccggtcgcaacgccgccaagctactccactatatccagtattatggttcattgataccgattagatttagctactagatgttaagagagttacagtaaacttattcctatttttattgaaattgaattattcttttatgaaattgaataaagactgttaaattcgcatacccaagggtactaaggccctgtttgttttagtttaaaattattgtaatctagattattgagtcagattattataagttggattataaaaagcctacatagaataagctgttagctgtttgtttctctgaatcattagctctacatagaataagttgttagctgtttgtttctctgaattattagctagttgttaggtgttagccacccagtatagctgtttgtttctcggaattattagctagttgttaggtgttagccacccagtaatctaaaaaaacacctttagagtggataactagattatagtaatctagcttatagattataataatctatcaaaataagctatctgtttgtttcatcttacttctattaatctatattataatagaagtaagatgaaacaaacatatagcttattatgatagattattacaatctataaatccactctaaatgtgtttttcttagattattgagtgactaacagctaacaaacagttaataatcaagagaaagagaaacaaacaatcaggtttggaaattccagtcatttcggacctcctttgatacgatattatttcggccaaaattttattttttttaacttttcatgaatttcagtaatatttgttcaaaatttcggactaaaatttcagaaaatttggtctatcggtgacctccgatacagtcggtcaatccaataaattaaaccctgcaaacagtttattctatatcagcttgttataatacagcttatagtaatctagatcaataatctagattacaattaagttaaaacaaatagagcctgaatcaataagcatgtaaaatggatctcaaccataatagatttacaaagtcatgtttatgcgtcacttacaaagttatgcttatgcgtcatgtccaaatacgtgctcattcaaataattggtttcgataagcaggtttccgttgctacaaagagaaaagaagatctatcaggtttccgttgcacaaagagaaaagaagttcccatgagtcatcgcttgtcaaacgttgtttgacgatatccttctcccaattattatccatgagcgccaattatcatccataagtcatcgcttgttgtttgacgatatcttctcctaattattatctcgttttcaatctaagataattttccgtgaaaactcgataaaaaagaggaaactcggtaaaaaaaaaaaagagtactgggattgctggttctcgttctagttcgttgaacatcaatttcacaaataagataatccaattcatgaacatcaatttcacaaaaaagataatccttacactgctatctaatcaaagtataaccctccagtctctccaggattgctatctaatcagtctctccaggtttgctatctaatcaaagtatcgatcgaaaatccatcagtttatccaggatttcatcaacacagaagtccagcgagctctgatcgtcccctcctcgcagcggctttttccatctctgcataaatcaaactactatatacacaaaacattctcaaaaacaaaatctttagtcaaaaaaacactcacggttcaaatgactaccgtttcgccgtcgtcgaacgaccacagccgcagcggttcgccgccgtcgtcgtccggcaagactaccgtttcgccgtcgtcgaacgaccacagccgcagcggttcgccgccgtcgtcgtccggcaggaggctttgtggaggagggatcgcgtgttcgcgccagattgcttcgaatcggttgtgctcgatcatgtacccgcccaagttgatgtgctcgccgtcgtacgcgacgccgttcccgctcgccgccggcggcggcgcggcatcctcctgggagtccaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggcatggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggcgatcgcccagacctcctccttcgacggccaccacgtcggctcgcccccggcgccgacgcccgggcagatcacggcgacggggacgtcgcaccgcgtcgcgagcgagctcgccttcctcaccagcctctccttcctcatctccaacgccgcgcgccgctgctcgccggcgacggcgggggtgacacgagcctctccgccgccgccgccgccgcgcggcatcggtgctcccatcatctcaaacgtgtgcgtgtgctagcagatgaatcttgtgctagcagatgaatctcctctcgcgcgagttttgtaggctgctccccttccgggcccaagaagcgcacggggttgggcctgaacacgacccggagttcccttcttttttttttttttggaaaaagtccacttagactcccttaattgtttaccaaatctaattggtgaccattaactgaaacaccggataggatgactccccgaattattgaaactagtgcaatttgactcctccaacggttttacaggacggttttgctgacgtggcggtgctaacccgattttcattctacgtggcgctttcgtgtcattagaattaaaaaattgtttgtgggacccatttgtcacacacaagaatattatgggacccaccgacatgtggggcccacatgtcatcctttctccttcccttcttcctcctccctctgtctcccttctctctcttttctctcccccttctctgatctgatctcccgggggcgcctcttcggcctcactcgacagcaactcggcgagatcggcgagcgtggtgaccgacgggcggcggcatccatgagagcaggctcccgggggcgcctcttcggcctccctcgacagcaactcggcgagaccggcgtgcgtggtgaccgacgggcggcggcatccatgagagcaggccgggcggcgcagatggagtcggcggcgacgcggcgtggatctctggtggtggtggaagcggggcggagcccgaaccgtcctggctcgcggaggatggccggcggccggtcggcaacgggcgcaaacacccggctctggcggcgaggccctccagggcgggcgccggtcggcgacgggcgctcatccccctggtctccggcgaatggcgtctttctctcagatcaatcagcaccatcttttcacaagatggccggatcgagtcaaactagaaagcaacattgtatcaccggggagattccacgccatttgcagctcgacgacatagacacgggcacacggccgatattacgcgtacagcaatctgacaaacgcgttgttattcccctctccaaccttcctcgatcgtatatatggcagcagcgcagcacgtcgtcatccggccatggacgtcacgggagctggtcgcctggtcaggccatggcggagcagggagcggaggggtcgatggcggcgttgagacgaggcgatgcgctcggagccgaggacgccgtgggagcaacgcggcggagggggcccgacgacgccggccgtggacctcggcgcagagggcggaggagatccggcggagaccgaataagggaaggagatcagatcagagaaaagggggagagaaaagagagaggagggagagagagggaggaggaagaaggggaggagaaaggatgatacgtgggtcccacatgtcggtgggtcccataatatattcttgtgtatgaatgacagatgggtcccacaaataattttttaattttaatgccacataagcgccacgtggaatgaaaaccgggttagcaccgccacgtcagcgccacataagccaaaccacactctaaaaccgctggaggagtcaaattgtactggttttaataattcagggagtcatcctacccggttttctagttaagggtcacaaattagattcaatgaactattaagggagtctaaggggactttttcctttttttttttggcaattgcttatttgaccctgttttgccgatttgaccctaccttttgaactttgcttatttgaccctccttttcgagtacgaaggttccgtctgaccctctttcgctgactccgttagggttcaatttttttttaaaaaagaaaatgtttccagagttcctaatggcaaaaataccctccaaagccaaaccctattctgactctctctctctcactcgtgcgtacctctctctcacttgtgtgtgcggcggcggctagctaagggggcggcggcgacggcgagctgagggggcggcggcggcgtcaagcacagccccgccggcgcccgctcgttgtggtggagggcagcggcggcggcgagctgaggcggtggcgacgacgtgatgtacagccacgccggcgccctgtcacgccccgaactagtcccgactggaactagcccgtgacgctccaaattaacctgttaatcgataccagtcccagaaaacagtgctggtatcacaggaagacagaatatcacagcaacagaggtctctttattatagagtagtagtacagttatgttgggctgcggacagaccccgagctcacaactgcattacaaaaggaaaacggaagcaggacttggaccaaacaatacaggcacgacttgggaactaggccgaaaccctaaaactcatcgtagccggcttgctcctggaagaactcctcatcagcaggatccgcttcatcttcttcagcaactaggggggaattatttatatagggcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggccacccgggcctacaacttttcaaacggccacccgggcctagctgatcccatcagctacagattttcaaacgtcgaaccccttttcacaacagcaatttcacaagcagtagtcaaacaaaactacgctatgaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggtatttccaaagctgacacaggtttaccatatgccgacgagaggggtcccagaccaacaacaggttaggtcccagaccatactgtgccaggaagcccaggggtcctccccgacaccaccccggcgaatccacatgtctctcggcatcaaggcacccctgataagctagttactcagccaggggtgtcccattccacccatatggtcgtacttgtcttatgtttggatgaaattccaaggaaacggtccttaagtgcaagaacgggaaaccgtacacccggtatgttccccggtccgcggttttggaaattcatttagttcgcaagcaccgacccaggtgtcgggttttccaagtcttttgcaaaacccaagtttttacccaagttgttactcagattttaagtttgaaggcgtccgtcgatactcgcgcagggtgcacgaatatcgagacgcaactagatggttacaaggggacatggtatcgcaattaacaaagggaggatcaaatgcaacaaaattaggtaggtccgccaatctgccttgcagacgggacaagcagatcaagtgcgatcctatcagtgcataatattttgcaagcaatataattaaatttcaaatataggctcaagatggtcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaacgggccggccggcccaagaaggcggctcagaacggcccaagacgcgcgcgcgcgggagggaggagagagagagccggtggaccgggctcaccacgcgcggtcccgggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgtagcctcacggctcgtggtggagcgcgcgcacgggaagggactgaccggggtcggctcgacccggtctaggctgagctggcgccgacgtggcgcctacgtggctgccacgcgggccggcgggaggtagacgacgacgccggccggaacggacggcggtcgacagcggcgagcggcggagcgaaccacggcgataccggcgaaagcgagcacaccgggtggttgcacgagacgaggggagacgagccaacggctcggattcgccggaggaagcttgacggcggcgaatcgcggcggcggcaaccggcggggagggaagaggggaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggcgagtgacggcaacggtcggggcggcgccggctagctacggggaggctactcgtgctaccaccgaaaactaagggggggagatggagcgaggaggaagaacggagggaggcactaccatgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggagggggaaaagaggaagggcgggcgcctgggtttatagggggcggcaatgtcggtttggaaaccgactttggcggtcaaggcgcgggctggcgctccggctagcggccaaaacggcgacaggagggagggaggatgacgccggcgggaggaaaaagggaaaaaggagggggagaaagggggcttgcccccttgccgatttaggaaaaaggaggagggaggcggaggcgtcgcggcagagggaggagggctcggcctccgtcccttggcggcttgcgcgcggagtggcggggccgaggcgatgacggcggcgatgacggcggggcggtttggagcggcgcgacgacacgggcgacaggcgcgggctggcgcggcagagggtgacggcggcggcgaccagacggtcggccactcggcacgcgcgcgcggcttgcagcgggagggcgcggcggatggagaggcgcggctcgagcacgcacgctggctgcggggccgagcggctgctggcgcggcagggtagcggggccgggcggcgcagacgcgacgcgggcgaggaccacgcgggcgcgcgcgcgcgaacgacgcgcggggagcggaaaggaggggcggaaaggaggactcggctcggcgcgggcggctcacgcacgcgcggacagagcggagggagcggaggaggggcgctcggcgcggcttgcgcgctcgcgcacgcagcgcgcgcggcgcacgggcggggtggagcggagggagagagagagagagagagggcgccggggagggagggggagatgggccgagagggattcggcccatcgaacccgggggaggcaaacttgacttttgtggaggaatttgatttggagggatttggattcggaattgaactcgatgatagatcggggattgagatcttgagatggcacggacactagacgacaagcgaagaaacaaatttcacaattagggtttttaagagataattttcccgctaggcgccacgacggaacgggcgatacagaccaaccccctaacaagaatctcgaccccgagattcagcacctaagggagcagctccgggaactcggcgtggagaagatcttctcgctcccaggtcgcctcatcttcagaatggttgctccattggactttgtagaacttgatggtcttccttcgagtttgacgttctgcctcttcaagaaccttgattggtctttccttgtaggtcagattcttttccagctcgatattacccagggggacttgctcttctggaactcgaagacatttctttaactgagatacgtggaacacgttgtgcacatctgcgagaccttcaggtaactcaagctgataagccacttcgcctcgtctggcagttatgaggtaggggccgatgtagcggggtgctaacttgccggacatcccaaacctcctcataccacggaggggtgatacccgcaggtacacatgatctcctttttcgaacttaaggtcacgcctccgattgtcagcgtaattcttctgacggttctgcgctgtctttaaatgttctcggattagcttaacttgttcttctgctgccttgagtatgtcaggaccgaataccagcgcttcgcccacctcattccagcacaagggggtgcggcactttcttccgaacattgcctcattcggcgacatctaaatactggcctggtaactgttgttgtataagaactcagcatacggcaaacaacgatcccaagtgccttcgaaatccagggcacacgcacgtagcatgtcttctaggatttggtttactctttctgtctgaccatcggtctgcggatggtaagctgtactaaagtttagatcggttccgagggcttcatgcaactgcttccagaaccttgaggtgaactgagtgcctcggtctgacacaattttcttgggacagccaaatctacatacgacatgggtcatgtagagttctgctagtttctttccatcataggtggttttcactggcacgaaatgagccggtttcgtgagctggtccacgattacccaaatggagtcgtacccgctaggggttcttggcaaaccggtgatgaaatccattccgatttcttcccatttccactcgggaattggtaggggctgtagcagaccagcgggcctctgatgctctgccttgactctttggcaaatgtcacacaaggctacgtattctgcgacgtctcgcttcattccagcccaccagaaatatgccttgatatcttggtacatcttcgtacttcctggatgaatggagtaggcggactcatgagcttcttttaggatgagatctcttaattccttcttggccggtacacagatgcgtggaccgcaccaaactgtgccttggtcgtctatggagaaattggtgtctttcttctcctgtattctttttattaactcttttatcccttcgtcgtttttctgagcttcccggatttgcgactctagggtaggctgtactgtcaagctggcagggacacctgactgcaccacggtcagcctcaacttctccaattctctgcacaggcgatcttggtcaggccgtattcgagctacattgcaataggccttgcgacttagcgcatcagcgaccacgttggctttacaggggtggtaatgaattccaagatcgtaatccttgattagttccaaccatcttctctgcctcatatttaactccgtctgtgtgaagatgtacttaaggcttttgtgatcggtgtatacttcacatctgttcccgattaaatagtgcctccagatcttaagagcatgaaccacggctgccaattcgagatcatgggtgggataattgacttcatgaggtctgagctgcctggatgcataggccacaacctttcgttcttgcattaggacacattctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcatgggtctggctaacttagagaatccttcgatgaatcttcgataatatccggctaagccaaggaagctgcgaatctctgacacattcttgggcgggttccaagcaagtacagcttcaaccttgctgggatctacttcgacaccgttggaggagatcacgtgtccaaggaatgctactcggtctaaccagaattcgcatttcaaaaatttagcgaatagttgatgatccctgagcttttccattattagcctcaggtgttcagcatgttcttcctcattcttggagtatattaggatgtcatcgatgaacaccacgacaaactagtccaggtattccataaagattttgttcattaagttcatgaagaacactggagcattggtgagtccgaaggacatcactgtgaactcgtatagaccataacgcgttgagaaagcggtcttcgggatatcttcagatctgattttcaattggtggtaacctgatctcaagtcaattttagagaaaactcttgctcctttaagttgatcgagcaaatcgtcaatccgtggcaacgggtacttgttctttatagttacttcattcagggctctatagtcgattaccattctttcagagccatcctttttcttaaccagaagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgttaattcttctggaaatacgtcgggatattcacagactatgggcaccgactccaaggaggtgacttgtaaacaggttaagatagaccgacttgcggtaggactgttagaggtaaagcggacttgctttcctccaggtccttgcaaagtgatggacttttcggcacaatctatctgtcctttgtgctttgccaaccaatccatccctaggatgatgtccaagctttgcgagtctaggactatcggtttggctaggaagtcaacttcctcaattctaaggttaacttccgggcatatttgagttgcccttatatccctcccaggggaatgtactatcatcggtacacgtaaattttgggttttccaaccatttcttttcacaaaagcttgtgatatgaaggagtgggaagctcctgaatcaaacagaactattgcgggtatggagttgacagagaacatacccatcacaacgtctggagcatcctgagcagtctcggcttgaatgtggttcactcggcctcgaccaaagttgttggacgcatgagaaccttgtccacttgcctgggagctaggacgagactgagctgccgctggagtaggagttctagcagtgctgccattagcatgccctgagctggtgttggtaggattctgagggcactgtctagcatagtgacccatctggttgcaccggaaacactgaactgctgacggtccctgcggtgacttgaaagaggtaacactgtttggcgcagtattgccactaggggcacgctgctgtggctggggtgccggacggttcatctgaggacgaggggcgtagcctggctggcggttagcttgagtgaccgactgatggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtagggaagtcatgagcaagcaactggagtctcattccaactgcgattcccttcaagaacttcctgatcttcttcttgtctgtgtccacttcctcaggggcataccgagccaacttgttgaactgacttaggtactcattgacattgctgttgccttgcttaagtctgttgaattcctctttcttcatgtcaatggtgctttcaggtacatgagctgcacggaaagctgtagcaaactcatcccaagcaatgttagtgggttcagggtgtgcattgcagtaattctcccaccaatctgcagcaggtcctcttagctggtgagaggcgtagagcgtcttctcaacaggggtacactgcactaagttgaattttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaatccttgcaagatttgtgtctgaactgccattaagtgctgcatgttgttttccacatgaggtggggaagggaggcgttcttctccagaattgtgactggcagtgtggtgagagcggtgagactgttccatctctgcatcacaggaagccgtgcgatgcgagcggttgctgcggcggggttgctcaacttctgcgttgcgggaagcagtacggtgcgaacggttgctgtggggagactgctcatgatttacttctggctcggctctaccatcttcaaaaccaaagcgggctggcgcacgagctgcacggcgggggcggctagccatctaaactcccagaagagggcggggtaagaatcagataagcacttaggagggcaaggagcaaagtaaatagcaactcagatagcacacactaggcataaactggatttttcaaatcataaaaacacctgatacaacgggtgtggacaagtcacagagctacaccgagcttgactgtgcgcacaccacctaggagaaccagactaccaaacaacacccacaacaaacacacgcacgcactacctcgccacgactccaaaagagttggcggcggaacaaaagggcctagcacacggacggctgctgaagactgcctcctctactcctcgtcggcctggctgcctcctgtagtcggctcctcagtcgaagaaacgtcgatcggctgacgcgaagggaccggcggaacctgtcgagggccggcagcagcacgggccgctggcggtaggggagctgggtagtggaaatggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtgacaggggcggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcacaccccgaactagtcccgactggaactagcccgtgacgctccaaattaacctgttaatcgataccagtcccaggaaacagtgctggtatcacaggaagacagaatatcacagcaacagaggtctctttattatagagtagtagtacagtcatgttgggctgcggacagaccccgagctcacaactgcattacaaaaggaaaacggaagcaggacttggaccaaacaatacaggcgcgacttgggaactaggccgaaaccctaaaactcatcgtagccggcttgctcctgaaagaactcctcatcagcaggatccgcttcatcttcttcagcaactgggggggaattatttatatagagcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcaatctttagaaatgaaaacaaggttggcacccggccaacagcttttcaacggtcacccgggcctacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaattaacaaagggaggatcaaatgcaacaaaattaggtaggtctgccaatctgccttgcagacgggacaagcagatcaagtgcgatcctatcaatgcataatattttgcaagcaatataattaaatttcaaatataggctcaagatgttcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttggtctaaaggaaaaggatttaattaaatcctttttggaaaagaaaagaaaagaaaagaaaagagggatggaaattagacttccctcgggcggctagggcgcggcccgagagaaaaggggcggctcggccgagcttaacgggccggccggcccaagaaggcggcccagaacggcccaagacgcgcgcgcgcgggagggaggagagagagagccggtggaccgggctcaccacgcgcggtctcaggtgggacccgcttgtcagcggcttggctcaccgtgcggagggagcacgcgacgcggcgctagggtggggggaaggacgcggtgcacgcgcgcggttcgcggtggacgcgggtgcggcgggcccacgcgcagcctcacggctcgcggtggagcgcgcgcacgggaagggactgaccggggtcggctcgacccggtctaggctgagctggcgccgacgtggcgcctacgtggctgccacgcgggccggcgggaggtagacgacgacgccgaccggaacggacggcggtcgacagcggcgagcggcggagcgaaccacggcgataccggcgaaagcgagcacaccgggtggttgcacgagacgaggggagacgagccaacggctcagattcgccggaggaagcttgacggcggcgaatcgcggcggcggcaaccggcggggagggaagaggggaaaacggcgacgaggtcacgaggggccaattcccggcggcgagagcatctatgcggctacgggaatccgatgctagcgtcggattgggcggagctacgccgagcgaggctggcgacgagcgggtgctacggagctcgggcggcgacggcggcgggcacacggcgagcgacggcaacggtcggggcggcgccggctagctacggggaggctactcgtgctaccaccgaaaactaagggggggagatggagcgaggaggaagaacggagggaggcactaccgtgaagaggaggggcgctgagacgagaggccgacggcgcgggagtaatctctccggcctcgggccggggaagaggaaggagagggcgcggccaaagtccccttccgcgtcctagtgcgcaccggctcctccggcacacacgtgacggctgcggtcggcgagagggacgacaatggcgcgggcgagaaacagagaagattgggagggggaaaaggggaagggcgggcgcctgggtttatagggggcggcaatgtcggtttggaaaccgactttggcggtcaaggcgcgggctggcgctccggctagcggccaaaacggcgacaggagggagggaggatgacgccggcgggaggaaaaagggaaaaaggagggggagaaagggggcttgcccccttgccgatttgggaaaaaggaggagggaggcggaggcgtcccggcagagggaggagggctcggcctccgtcccttggcggcttgcgcgcggagtggcggggccgaggcgatgacggcggcgatgacggcggggcggtttggagcggcgcgacgacacgggcgacaggcgcgggctggcgcggcagagggtgacggcggcggcgaccaaacggtcggccactcggcacgcgcgcgcggcttgcagcgggagggcgcggcggatggagaggcgcggctcgagcacgcacgctggctgcggggccgagcggctgctggcgcggcagggtagcggggccgggcggcgcatacgcgacgcgggcgaggaccacgcgggcgcgcgcgcgcgaacgacgcgcggggagcggaaaggaggggcggaaaggaggactcggctcggcgcgggcggctcacgcacgcgcggacagagcggagggagcggaggaggggcgctcggcgcggcttgcgcgctcgcgcacgcagcgcgcgcggcgcacgggcggggtggagcggaggtaga

SEQ ID NO: 64872 - DNA, 17140 bp, Oryza sativa
ggcatgctgacgaaagaagagcgagaagactatcgaagcttcttgatggaattccgagattgcttcgcttggacatacaaggagatgccaggacttgaccctcgtgtcgccacccataagctgcgattgatccccaatttcggccagtgaagcaaccaccaaggcgcttaaggccagagttccaagaccaagtcatcgccgaagtcgatcgactcatcaacgtgggttttatcaaggagatacaatatcctcggtggttagccaacatcgtccctgtggaaaagaagaatggacaagttcgagtctggggtagactttcgcgacttgaatcgtgcttgtcctaaagacgactttcccctaccaatcacggagatggtggtcgattcaacaacgggttatggcgcactgtccttcatggacggctcatcaggttataaccagatcaagatggatccccttgatgccttcgacacggcgtttagaacccctaaagggaacttctactacactgtcatgctgttcgggttgaagaacgccggtgccacataccagcgtgccatgcagttcgtcctcgacgatttaatccatcattcagtggaatgttatgtcgatgacatggtagtcaagaccaaagatcgcgaacatcatcaaaaagaccttcgcattgtctttgaccgactacgtcgacaccaacttaagatgaaccctctcaagtgcgcctttgccgtccaatccgttgtcttcctcggcttcatcatccgtcatcgagggatcgagatcgagccaaagaagatcaaggcgatacttaacatgccgccccctcgagaactcaaggatctgaggaaactacaagggaagctggcgtacatccgacgcttcatttccaacctctcgggccggatccaacccttctcaaagctcatgaagaagggcacaccctttgtgtgggatgaagaatgccaaaatggcttcgataatatcaagagctacttgcttaatcctccagtactggcagctcctgttaaagggcgcccccttattctctacattgcaacgcagcctgcctcgataagcgctctcctcgctcaacataatgatgaagggaaggaggtggcttgctactatttaagtcgcaccatggtcggtgctgaacaaaactactccccaattgagaagttatgtttagccctcatatttgcattgaagaaactaaggaactacatgttggcgcaccagatccagctcattgcaagggcggactctataaggtatgtgctaagtcagcctgtgctcactgggcgactaggtaaatgggccctactcatgatggaatatgatatcacttttgtgccgcagaaagcaattaagggccaagccttggcagaatttcttgctgtacatccagtgccagatgactccccactcatcaccaatctaacggatgaagagattttcaccgcagagcttcaggaacagtgggagctttactttgacggagcctcacgtaaggacgtcaaccccgacggcacccctcgacggagagctggggcgggattggtgttcaaaactccacaaagaggtgtgatctaccactcgttctctcttctcaaggaggagtgttctaacaacgaggcggaatatgaggctctcatctttggtcttctcttggcgctctctatggaggtacgttccttaagaacccatggggattctcagctcattattagacaaatcaacaatatttatgaggttcgtaaaccagaactggtgccatattacacagtggcccggaggcttatggacaagtttgaacacatcgaggtcatccatgtgccacgaagcaaaaatgcgccagctaacgctctggcaaaactggctgcagcgttggtctttcaaggagacaatcctgcgcaagttgttgttgaagaaaggtggctccttccagctgtcctagagctcatccccgaagaagtcaacatcatcacgactaattctgctaaagaggaagactggcgtcaacccttcctcgattacttcaagcacggctctctacctgaagatcctgtcgagagacgccaactacagtgatgacttccctcatacatctacaaggccggtgtcctctacaagcggtcttacgggcaagaggtcttacttcggtgcgttgatcggaatgaagccaatcaagttctccaagaagtccaccatggagtatgcggtgggcatcaaagcggaccaaaaatgtaccatagcatccgactggcagggtactattggccaggcattatggcggattgcctgaagacagctaaaacctgtcatggctgccagatccatgacaatttcaagcaccaaccgccggctctgcttcacccgacggtcccttcttggccgttcgatgcctggggaatcgacgtcatcggcctcatcgatccaccttcttcaagggggcatcgcttcatcctcgctgcaacagactacttctccaagtgggcggaagctgtgcctctgcgtgaagtgaagagcagtgacgtcatcaacttcctcgaacgacacaacatctaccgcttcggggtaccacatcgcattacctccgacaacgccaaagcctttaagtcccagaagatctataggtttatggagaaatacaagatcaaatggaactactccaccggttattaccctcaagcaaatgggatggccgaagccttcaacaagaccctcggcaagatcttaaagaagacggtagacaagcatcgaagggattggcatgatcgtctttatgaagcactatgggcgtaccgagtcacagttcgtaccccgacacaagccaccccatactctctcgtctatgggagtgaagctgtgttgccattggagattcagctaccatctctacgagtagcaatccacgatgaacttactaaagacgaacatattcgcctccgatttcaggagcttgatgccgtggaggaagagcgcctaggcacccttcaaaatttggagttgtatcgccaaaacatggtgagagcctatgataagctcgtcaagcaacgagtcttcaagaagggcgagctcgtactcgttctgcgacatcccatcgtcgttacacacaagacgaagggaaagttcgagccaaaatgggaggggccatacgtcattgagcaagcatatgacggaggtgcttaccagctgattgatcatcaaggatcacgaccaatgccgccaatcaacgggaggttcttaaaaaaatattttgtataaaaccctgcgcctcttgttttcttgttttctttaaaaaaaacactgtgagcttgccaacatgcattgaccattgcattgtctggtgctccacgttttgttttacaaaatggatgccacatcccacaaaaaaaaattaaaatggctttccacatatcacactgagctggtagaagaagacaaggcaaccttagaacacctctacaggattcaatggatgaccatgacagactgtgcttacaactaaacatccttcacgccaacacacaagtactacgggtgcatatttccgaggaatagcaaaaagacttgattgggttacttcctagtaacaaggtccccacgccttcatgtccttcggtgtgcttcagacctatggagataccaagccccagggaagactataggagaagagtaagaaagggctacctacctcaacacaagttgtggttcagtgtgcagccacttgccatccctgtgaggcatgtcaacaagggactttacaaaagaaatgggcctgcgaggattacatggcccacaaaggggaatggttgtcctccaagttctaaggatgccaagatcccagatcaatctcaacaaagtcgtgatgatcttaactcaagaaaacaatccaatatcaatctcaatgaagccgtggtgtcatgaagccgcgaagcaaaaaaaaaaagaagaaacaaaaagatccaagcaatcagtgatctccactgcattctgtcagaaataggaggatagccattcatcatcctcggcaaaaggaaaaggccactctcacagccgttcccctataaccctatcttaattcagccatacctaattctctcggttcgatgaagcacaataccaggggcatgggactcgtggtggtacctagtgaactgaaaggctagagcatggattttcgctgccttctgaaagtatcaccatgtatgctactcctatacacaagcacactaggaagttaggttgacagggagcaatcgtcatggtcattcggtgattcccgcgacacgttcttcggcaatcttatctgacgctaccacatagccagtgttcagtgggaaagccaatattttaaaagaaaaatcaacaaaatcattttcttgctgggtttctttctatcaactcacctggtttgctcgactctagcaaccatactctagtttttttttctcttttcctctctcgttttccttttcgtgatgcagggttttcgcttcacgtcatttggaggcaacataacactctgaagtcgccatcgggctatacacctttcaacctgacgggtcggcatcacaacagtcaagtggtcgcgtccggattgataagatatttctttcttgggagcggggcggcgtaccaacgcgtcagcgccaagccgtgaaacccttcatgctgatgaggcaggcaccgtgatatatcaacggtttcaatcggtctgataaaatgtcttcaattgtggcatgggtctttttcgctgcgagtaggagacgatttcaagttattttgttggctggcacctatacttggtcccgacaaaattcctttaattattatttgaaggcatggatcttcgcctcgagacctcaggaggacagcttatacctgaagtcatttttattcttcacctattctcaaagcgccagactttctgaacggtgctactaccccacatgggttgatctattatatgaagcaacttgtacagaaggcaaaccaggaattgatggaagagatcatgcatgcagctgcatgagtacagaatttgtgtatggcactgtagcatggtgatgatgcgtcgtcctctgattgctcggccacattgccacaggatgggtttgttaaaaaggaattatcttaacaatgcaaactgctggctggccttggctcaatatgttgccgccgtgataatcaacagaagttcatatgtattcatgcacttataaattacagccatatattcccatatatcagctctcgggtcccggcaggatcttcagcgggttctatatgcgacggtggccgcatgcgagcagtgccaagtattcggatacagaagggataatacatattagcaagttaaaaaaaacgaagaggacaaaacacaagcactccatatatatcgatgaagacaataagacagactcaaataataaaacaagtactcctaattaatgggtgcatgataatgccccaactttattcaaagattaaaaactagctagctgatcatctaaattaagagcgcttctaatgtgctttacatgactcgaaaataaaatcctaattaaggtaaaccaaggagaagcatatggaggctattctgattcttcgacgtactaccccaaggcgccgattctctacgatatgatagaatggcggccacctctggcggcgcggccactgcaaggcgtttcctctcttcagcaagatgccccaaatagaccttcgcctcgtcacgacgctttatcagttgcatgacgccgtcgatggtactatcataaacttgccggttcttggcggctgcctcctctgattccaaacactggtgctccttctccctcgcatctttggctttcagctcgtgttcctccgcctctttcttccaggtagcccttgcttgcttggacttctgaagatccgcggccacgtcttcacggccactcttgaggaggtcaaggtctagtagcacgtctgaacacgcactctctaactttgctaaggaagagcgcgcctcgccttcatgagcagctaaagttctcccttcaaaggttactgggagctctcccttaagatgttgcacaagtgcccccaagtaagacatcaacttctccaagtctgcggggcgtccaagctcgtaactattttcccatgcagcggtggcagcaccaatgtactctatggtgccctccttgttcaggggtttctccatcaaacaatcttggatgcttaatagatcctcctccaccatgcgggcattgcgacgttcaatgggcgtggactttggaagctccagcgtcggcaattcgtcagtcgccgaactcacagagttaagttggagatagcgaccgcccgtcccgaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaagagaaagcagaggagaatatgacctctattaggagtctaatcatccttaccttcctgatgcttttgagtcgagggtcccggagttgaagcggcatcagccgtcggcatcacccgagaagagcggacaggagcattagcagccagcacaactgaaggtacatcgtcaataggtaccggagcaacatcggaagaggcagtagctttaagtccacccaaagcagttgcctgctctatcgtatcctgagttgcaagtatgttctaagagacaggttatcaaaccagtatgacatagaattttaagagaaaaaaaaagaataggggaaacacggataccttgccagtgccatcagaagaagaagaagaggaggaggagtcgctcaactggacagcatcaagctccatgtcgggcaccacagagcggcggcggcggcgacgatcatcgcttgaagactccgtggatgacaccctctcgtaaactacggggttttttcctcgcttctcacgcatggtgcggtccagctcggggtgtggagaatcttcaatacgcagaccctttttagaagatttcggcaatggaagtctgtcaggacgagcagttctctccttcttatgacgccagtcacgcaggaattcgattgactcgccgtggcgtttgtatcctcctcgatcatctctacggaccgggatcttcgcgatatgctgggaagggttgtcacccttggtctccttctgttgcttgccaccggatcctcccgggcgcttatcttcgacagtgtgtctatctcctgccgagcgcctatcccatgttactcgcctgtcccccgttctccgcccgtctcgcgggacacgctctccgctgccccggtcgctggcgccacgctcgcctgcacccctggatgctccgtcttccctggccatctcaagatggttgcctgatgaaaaagtacaggatgatcaagaagcgtcctaattccgacggctaaagaatcgacaatggatatatacctgtgatggagttaaacacctgaggcgccgtattgcataatcaatgcacaggcatgaccagcaatatataggcttcatccaaattactcgtaactgcaaaggatttggagtcttagccgatgacggtctagctttgtttttctttcgccgcacggccggagataagcttcagcatgggagtcctttcgtcgcatgactaaactctaccggacatgtatcgcatgagccaacacgacaccaagttaatttcgctcgctccacgatcaaaatttacttggtgggggcatctgtttgatggtattttggtgattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatactgggaatatatatacttggattagtatatgtgcatgtataattaaccaataactagccgtgtgaagattggctggtgaggcaatcacgcgcatgcatgcatgtactacagtagacggtcgtatgtgtgtgcacgcctgggtgattaagcaacctatgcatatccgagtgattaatcataggctcgacccatggccaaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaatcagatatttgacgccaggagaagctaagagataaaatcaaataaggatatgaacaaataacaaactgatcgatcaaaccttatctgcaacgaacttgacgcggaggaaacgacgcgcggacgcggtgagcaccgaccccagacccctatataaggcgtcgacccctcggcagccaggggcattcacgaactcatccacacattcattcaccaatgcatctagcatccacaagccacctatcatcaatgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgcgcacggtgatccgatcatcagcaagcgcaggagaggagcttgatggctagtccaggtaaaagctagcaagattgttttgttttctttcatatacagcacgcacacatccatgcatagggatccatctgcacgtatcgtcgtcgccggggaagtcgcggtggccgattcatctacgcatcacagaagcctcatcgatgccggtgtctgttcaagccgacgtagtgctacttgtccctggactcgacgctgctaattcaagccgctggtgatgcatctacccgaagctgcgacctggccgagataccagacatccttgatttgcaagcttcaccgcactggagcgggctaaccatggaggaggtcgtcgggaagccgccctgccggagcgcgccgaggatcgccggagctgctgccgactgccaagacttctatcagttctcatgccggaggtcaagcatcacgcatggcgtcgaaaccagcggatgacgatggaggcaagtatggctgcagtacagaggaaggacgacgggaggacggcgagccagtgctgttggatggcaacaagctagctaatgcatgttgattaagttaattattgtggcaacgtggccaaccaatcggaggatgacatgtcatcgctgctacagttccatgcacaaaccaatgcgtgggctaaagaagtcctgttggtttttcttatttgtcccaaatgagatgccgagctttgattaaatccggccgccatctacatcaaccatcttcaataattcctccctaattcttctctaatcgaatctcgatgcaactgctgtgacgtcaagtcgttcaagctacgtaactccatgcatgtcttcaccaacaatctacatcgacacgttattcaagaccgacgaggctagacgacggagggtgggcgaccaacaccggcgcacggaccgacgaggccatggatcgctgtcggcgctcacacacacacacacatctacatcatcatcacaaccatgcatggagaacgcgaagcgaagacgacgagacgaccacaagcagcttaatcggaggttctcttgcaggcctagacctgcggaggtaattaactgggagcttcttgaggccccaggaaccagaagaccacatcgcacaagtcagatctgtccaatgtcagattatggagcgcgcatacatatatattacattgggaatttgtatttatgatcttttaagattaataaagagcatgttccctatgttttgtttacactgtgtatttaggtacactggcacgcccgcatatatatgtatctctaaacaaacgagatctcagatgttattttccaccctaaacataaactttaacaagataaattaatatatgatagactactttacaaatatacaagatcaaatttctacaagctgtaacgaaaaaaaaattaaccatgaatatacgttaactatatatatttaaatttgtttttttataacttgtagaagttgaattttaacttgcatatttgtagagtgatatattacatattaatatattaatatatgttcttaagtttttaaaatttctttagctagctcagtttgtttgtatcgatgggcttagtaattagccggatattgctcctgcgagatggggcaaagtatcgacctgggatccgcccaaagtgggtgcacgccgccgtcagcgggtccaagtcgatcgggtcggcgtcgaggaggccaactcgtggggtgtcttcgccatcgcagtggataccggcgatcctggccgaagttgacggcactgcacggcaccacgcccaggcgctcactcatcgatcggcaggtaactgtcaaaaactccaacctgcagcttctcctgctgcttactgatcgatgcatgggccgatgtgtaagagtacgcgccacatcgagatagctagctaactagagcttgggccctgaattttcaggtggttgaatgaatcggttggcgaagacgacgatggcatcaaaggcagaactacctctgtcttgaaaagtatatgttcccggtttagatatggtacttcatctgtcccaatataaatgcatctaggagaggaggtggtatattttataactacgaatctagactggataagcagctatctagctaaatttgtagttcttggatatgttacatctatactttgacggaaggaatagtaactactacaccggccggccagccgcaggagaagatcgacctcgtcgctgcagaatcctcctgagattctgatggaataatttcgtacacagttcaagattgttcatatatacagtacgtgcaaacggttcaagctagctgctgcctttgatggaagtgaacatacaaatgtggttggtcgttggtaattaagctgttgccttcttctactactactccagctgccgtcagtctcactcagtcctgtacattcatctggcgggcagcacaggctgtaacaacataaatagtcaagcacggaagtaattgaaccggcgaaaatattgcgaccgatgttgaaagattgtgtccattaacaaaccggctaagtacatactataccgtatgagataatgaaagtcctgacctatttgtagtaggaaagtaacatgagctgcaagctttgaagggaagtgggagtacacataccttaaacttcttcttttattatcctacagtataaaacactgcacaaagccgaccagagtgctagcttttgcatattgcaggtagtacgaaccaatggttttcagatgaaaacaaccactcaatatacatctctacagtgttttgcagcgtttgccacatctcaatcgctttgattgggacaccactccaactggcctgtaggcatagtagcatacacctgaaagttttacattttaaccctctttaaaaacataattttgttataaacctcaattaaggatacagacccctctggaggctcatctgtgccgaggttaaatgtctttgcgccaaataagttggtgccaaaatccagccctcgaagctagtgggtttaggtcacctgcgaaacaactttcctttctcttcccatctctctttgaattgtttgctgtccaattttgagaaaactgacaaatcaatgtgtcctattcatttttgctattttttttataattacacagtataacgcagatactcacaatacacgcacactcatccctctgaatgcacgcacgcaaaccctacccctatgagtatcttcgaaaactggactggcaaatccatcttggagatcaggtacgtcgcctaccattgaaagcacaaggccgttcaattctagaaaatttgcttctatgggagtcgaatctagtacctaaggtgctaccgaggctcttgtaaccactaggctgtatgctctttcgcctagtttgattttattgatagaaaacttaatctaagaggaggatgtggttccctccctcctccacgcccttgttccaattatccgcggctaaattttgaaaaagagttgacaaatcaatgtattataattcatttatgataatttatttttatttataggggtaagacttgaatttgggataatatagtaagaagtcagtgaaagaggctggcaccatggaactggtgccaaggctcaatcccagagactgagagttttgcattgagatgtctaacatcagcgacaatcgccgagagttaggtccatttctgtaataagttttttaatacgtctgcatatgaaatatgtttttgaaaaaaaagtccagtatagagcacagcaacaaagaatcaaatgtgtactactactctataccgtcatatcgtactactccctccgtcccaaaataagcgcagccatgagtttccgtgtctaactttgatcgtctgtcttatttgaattttttttataattagtattttattgttattagattataaaatataaatagtactttatgtgaccgatgctttttagatttctcaaaagaaaattaaataagacgaacggttaagttggacacggaaactcatggctgcgtttattttgggacggagggagtacttgagattcagtggcactgtttcctctcctttttgcgacacagccattcatatccttggcgtgaacgagcaaagcatggcttctgaatttgtcagtagtttatagtgcaacaacgtcgtccttcatctggatctgatccctgaacccatcaatcatactctcacgcccccgtagtacatgccaccactgtggtctaggagtactgttcatcctttactactccagcttataattatcatgcagttcatgatcagttcatagacaggacgtgtgtacaggtacagcaacagtggcgagattttagccggagaaaagctctatatcgagagaggcaaactgtggccatcgaccatggatggatcgtcgacgtgacgacagtaacgagagaacacacacacgagctgctgctgctgctaggatcgatcgaatggtagggatcgggcactaactgaggtaggtgaatcaggtttaaggattcacatgagcgttgctgccgccataactgtccattctcctttgtagatgcacggtcccgttcgtcgtcctgtggccgtcagcgacaccggcatggcgcattcaaggcctaaagcatggcgctagctgagggagctagctaccacagctagaattcgatcgcataaatgttcaggaaatgatccagtggttggggacaaaagcatgcatatactagccgctgcatttgtctagctctacctgccctcatcttagtttcgttcccattagttaattattagattcgtttatcaatattcagattagttcgggtagcaatgggccctggtgtttttctgggaccatatatattccaaaccccaatcaactgaatgctgaaactggcttaatggcgccaagccgattctaatttgtgaacacagtagtatgcacatatcacatgctaaaattttggcatgcaattgggtaaattagccttcaaacatagcagtgctaactgggatggattttacattcaagagggtgttctctcgttttttttacatgtcatttaaatagttatatatatattttaaaaaagacaaatagattaatatgtaatatatcacttgataaacatgtaatttaaaatttcacatctgcaagttgcaataaataaacaaattaaactattgcaacttgtagaagttaaatttgacttttttttttgtgaagtgatcggtcactattaatctatttcatcgattttttttataactattttaatgatatgtaaacaatgagggactggttgcttgaaagtttaaaatagtttctcctatgctagctcatccaaggtggttggagaatgttttgtctttcttgtcttaaaaaaatattaggtagttgaattcaacgtggatcctatttagcacagctgtgtcttcggcacacactttgtttatgaaaaaaaaaccttttattgaaaagttaattttcatctgaaaatttccatcttagactttaatttggcatgggttttataggccaaaagtgtagtatgcagcgaggcacgactgtgataattagccatctaaaattgattgttctagtcaaattctgcatacccatgattgcaattcctatacatcaacgaataccagaagtagtagttccaagaaagacaatctgagatctactagctaagctcgatcacgtgcagcggttgcccaaaaagcctagcagttgagacagccacaactgcaaggaccttatcgtcctagctactgcatatgcaaagctgatggctacgtaagcgcgacctgcatatacgttggcgcctgcctcatcatcatcagcaattaatcagctcgcctatttgtggcaagctcggatggtcagagatcggtcgagtggtacaagcgcgcacgcggcacgcatgtacgaacggcccctccttgccttcaaagcgatggctccatggcacccgtccacgacacgagctcgatcagctcgcccccatgcaggtcgcggatggcgaccttgatatcacctgtgctcggaattaatcgttcaacatcccgctataatgttactaccattaccattacttatatgtgatcaatcccaccattctaattctaacatgtatatataatagtagtattatggtagaggatatgaacccctctcctgtgaccctgcctccggttgcctcctccatctatctctcccttcatgcacgcacggcacgatcgatcgatgaactcgagatcttaagatctcactggtgaaatgcctggtcccggcgaagaaaaatctcgagcttttgagattgtgttaatctccctcgatcgcactgtatcctctcatcggatctctgagcagccaatcggaagcgtgggggcatcgggacgcatatatatatatatatatagacgaataatatgatcgatgtaccggcactctttgaattgaattttggctctgctaatttaactgaagtcgtagattcgagggatatatatatgcacatacacgtacgaatatacgatcgagcgtgcatgtgatcgtaattgtaacctggtcctcccgtttttatggcaatggccaggtttgcattttttgtgccattcattgcgctggtggctgccatcgatcgatcggatcgaacgaatgcgagttcatcatgtgtacggttgagcttttgcttcccctctgtccggtctctctctagcgatttttttttcgcgaaaatacaaaataattgcacgttaatatattagaagaaaattaaaaaattttgttgcatgacgcaatcaaccagattagcctatgctaagaaaagagaaaaaaaaaacacaaccaagaaaaatggaagagactactacaatgactaaacgcaactccaatcagctaggaggggggcagagccacgctacgctcccaagaaatccaaaaaaagcttctctctcgcgatggttcagccccgaccgcgccattcaaatcaacggatcgatgcgcgtacggacgtgtccgtccatccatcggttggtcagggcaggagcacgtcctcgtctcgtcgtcggatcaacggcgatcgatcgatcgatcgagcgcccgggcgagggaggaatggcggaggatgtggtgagccaggtggacttaattcggttttttgctgtatagctagcgttaatggaagacgtgtgacctgtaactctaactcgcggtgtatttggttgattgatgggattgaaagctagctagctagcgaagcgatcgatcgattgcaatgttgctcgctaggtaaccagacaaatatggggcctgctttgttagcttgtccggtttacagtcgtacggtgtacacgacgattttaatagtgtttcgatcaacaatattatactagtactatctccgtcccatattacttatctttttgagtttttgtttgtcaatgtttgatcattcgtcttattcaaaaaaaatctagaattattatttattttgtttatcatttgctttattatcaaaagtactttacatatgacttatctttttttatatttgcactaatttttcaaataaaacgaatggtcaaacgttgcaaataaaaagtcaaaaacgtcacctattatgagacggagggagtagctagcaaccccgtattgaacacatactagtgctatgaccttagatacatgatatgcatgttcagattcgtagtactagtatgtgtcttatattttgggatggatgaataattaaattacttgcttttgtatttaaatatatgatgctgttagctttattcagtcaaatttgtcgaactttaattttgcacttagaaccatcaataattctaacaataattggtctgaaaatataatccaagtaaatttacagtaattttattatttattaccgttgttctaaacttctaatcgaaaaatgatgatcagagaatcagagttacacaacaaagaacgaataaaggtaaccgtgccatctcgttcctagtagtaataatgcacagtaattaaatccatcatgccacaggcctagcagcctagctatatgatcgatcagattaaggatcactggtgtctcttgtgttaaagttactgttttatctctggggggagctaggtatagggagataatatcgctagttagatcgaggaccacgtacgagtatacgtaaatagactgcatgcatcgatcattcaaagatgggcacgaatgcatgccaatggcgtggtgcgcggcttctgaaatctgaatacatagtaagtctgagctctgaccaagacatgcgcaagagtcagcgtgctcagcgcgggggggggggggggggggg

SEQ ID NO: 64873 - DNA, 24167 bp, Oryza sativa
acaaaaatattctgctgaaaaatttgtacatatttttattttataaaatttaaattgctgggcaaagtcctggcaataatttcagtcaaaaaaatattctgctgaaaaagcaactcgaaaagaaatagatgtttcactctgcctttttattccccatctgaatggctaggctgaatttatgtttttatttttataactgatagcatcatagtatatgatttttagagttcttatgtaactatttgcatttgcacccaatagagatgtcaaactgccatttcttgccatctaaagcagactagcaaattaactagaaggttggagtggagtagctggcagtgaacatggaagctaggatctagctactaagagcaagtttaatagtatagccaactactggtatcaaatcatctatagtcaatctaatagtcaatttatacaatagttaactataaatatatattacatcactaataattggtcccgcatgtcatacacacacaatgttttggagttcgtgctgcaggtggctacaaatctgtaacccgcttgtcttctctctcctctcttatctcctccacgtaagcttgtagccgacttatagtctattattatatatgctctaatataggcaaccacgtgccaaagtaggtcgtgaacaagtggtgtgtaattaattgccaccacctatgtttttttatttatgatatcattgattttcgcataacggttaaccattcaccttaactaaaaatttaatataaatataagttgagattatagttttccaatgataaaacaagtaaaaatagatatttatattttaattaatatgaatggttatatgtgacgtcaagactcaattacgttatacattaaaaaattaaaaaatagagggaatacttattttgtttcgtattataagatgtttcggattttaaacatattcatgtatgaatccatgtatatatgtgtttcatatataaatatatgcataatcatacagatgttaatgagttagactataaatcaagagaccaaaacgtttataacgtaagacatgggagtagtatattaatgtattatcaagagatcgaatgaatgttgagtactgagtacagactacatgcacaaacaaattcagcacgcatgcaacgttggaaaataaaaatatcccagatcgaacaatagaggaagaaggcaagcaagcgtatgatcctgcttagctcaaaaggatgcgatgaacagtgcgacagcggctatcagcagtaagcacgcatcagcaaacggtcatctcgcccctagcaagttgcagttgccgtagtgcattgactacacagtggagatgtttttttttttagtaaagaccatcaccggtctctaaacttgtaccgctgtatcatcgcggtccctaaactcgtaaatcgaccgttcaggtcctcaaacttgttcaactgtgtcatcccggtccctcaaattgcatatcactcgtttagattctccaacttgttcagttgtgtcacctcggtacctaaacttagatttgaatatcatctgggtcaaataggacggtctaaagactttatatttaaaaataattcataactttttcatgtgaactctaataaaaacaaactttatatcaaacttatagccttgacgcgatctacaactttatagttgattttttttattttaagtcattttttgtcccaaaatgtaattttaaaattaaaatttcaaaatctataaacatacaagttggaggacctaaacgagtgatctgcaagtttagggaccgggatgacacagttgaacaagtttgaggacctgaacggtcgatttgtgagtttagggaccgggatgacacagcggtacaagtttagggaccggtgatggactttactctttttttttttctcttgaaaaattgtcccttgttcgttacatatcacctaattaaatagaatttctttataaaaattcagcaaagtaaatcaattatatcacttcacaaatatatatagatttaaattcgacgtatacatgttaaaaaacactctcactagtatgtgaactattcatagccatgcgtgtttgtacgttttttttctaatttgtattatttggacttgtctgttttattgagttatggagtatgtcacatttatctatggctgtgtttagttcccttcaaacttctaattttttcatcacatcaaatatgtttggacacatacatggagcattaaatgtggacgaaaaaaatcaattgcacagtttgcatataaattgtgagacgaatcttttgagcctaattacaacatgatttaacaatgtcatgctacagtaaatatttactaatgacagattaatttggcttaatagattcgtttcgcagtttacatacagaatctgtaatttattttattattagtatatgtttaatattttaaatgtgtgtttgtgtacgtcaaatttttattgccacatcaactaaacacggtctgtgtcaacttatcaatttttggacatagaaaaacaaagtgacaacggagaaaaatgaaaaactcttcctacgcactgaacagtgtggcagagagatggaagaggttgttgatcaagcaaccgccgtagcttgatgtgaacacgaagcaatattgtcagttggcgagggatgcactgatgactatgctagtgcctactagtaaccagtatactcaatgatacttgtgttataaaatccctaatgctaaaattcattcgagcacaaatcttaaagcaaatcgaatgctgaaaatttatatagtgaaaaagaaaatgaaataatagttgtaagttaggattaatctcacacaaaatctatatatcgtgcactgtcgtacaagcaattccactgcacctcttgtgttagtaaaacccctaatgctacacttgtgttataaaaccctgatgctagaattaatttgtccgatcacaaatcttgaagcaaatcgaattttaaaagtttataaactggaaaaggaaatgaaataatagttgtaagttaggattaatctcacgcaaagggtctcatcttttcgcttattcttatacttatcagctaaaatttaaattttcaaccttaaatttggagctaatttaaggtttttttcatcgaagtttattttttagtctttgcttttttattgctaagtacacgtatataaaagttttatttacaaattactttttttacaaatataccgtttaatggctccggaaaaatatatatcgtgcactatcgtacaagcaactcctctgcacctcttttctttaaaaaaaaaaaacaaaacatcatctgcgtgtttactcaacgtgccctcgcgccatcaacacaaccaacgtcccattgccaccttttatacttctaccttcttcagtagttcatcaatgtcgcgagcaccccaagaaacgtaggatcatccaagcaaacccgccaccacctgccggccggccatgggcggcggcggcggcggcacgccgcgcagcagcatcggccacatccttcccggcgccggcttcgtcgccgtcggcgtgtggcacctgttcaaccacgtcaagctcttctcccagcgcccggacacctacgtcgcgccggcgtggttccccgtgccgggcgcgcgctacctggagctcgccctcatcatcgccggcagcggcgtggagttcgccatggagatgttcgtcggccactcgacgctcctccccttcgccgccgacgggtccatcccttccgaccgcctccacaaccacgagcacgccatcatctgcctctccctcgccgtctacgcggccgccgcgctccacctcgaccgcgcccgcgccccggcccgcggcacgctcggcctcctcctcgtggcggcggtgttcgcgcaggagctcctcgtcttccacttccactccaccgaccacgccggcgtcgagggccagttccactggctcctgcaggtggtcgtcgccgcgtgcctcgccacgtcgctgctcggcgtcggctacccgcggagcttcgccgtcggcctcgccaggtcggcgtgcgtcgccttccacgggctgtggctcgccgtcataggcgccatggtgtgggtgcccagcctcgtgcccaggggctgcgagctggtgcgcgaggacggccgcgacaccgtgcgctgccgcagcaaggagagcctccaccgcgccaaagcgctcgccaacctgcagttcgggtggtacctctcgttcatgacggtgttcgtcgtcgcactctacctgtacgtgagcaacaggtaccccgccgcagaggaggcggcgtacgcgccactgcagaaagccggcgccggagacggtgacgacgacggcgatgacgacgcgcacaagggtggcggcgccggcgtgcatgggttcgctgcgttggagatagaggtttgattggcaaaattgtaggacagaggtttctgtgtgaagaggattttgatcgctcgggggatatcccttcgttttttacatgtcacttaaatggttatgaaaaaaatttaaaaaaattgagaagatgtattaacatgtgatatatcactctataaatattcaagtaaaaattcttctacatctcgcaacgaaaaaaaaaataaatttgactctgaatatacgttaagtagctccggtttaatttgttttcttcgttacaagatgtagaagttaaatttttacttgcatgtttgtggagtgttatattacatgttaatacacattctcaattttttttcaaatatttcataaccatttaagtaacatataaagaacgaggggatatcccctcgagggattaaaatagtttcccgtttctgtgtacagttgcttgtattgatcgatcaaagtgcaatgaatttcgtttgaagaatggtgaagctcctataaaaattcatgattggtttggaatttggaaacatattgtacatatatatgaatgtgtttgtgtcgtgctgagatcatgatttttgttttttggcgaaagagagataatgaattatttgtacggagtatgtgatttgctatccatcatcatgacgtgtgcccttagaaatgtgaaggtgtacgtccttgctccgaagccaagtcatatgatgaaccatcgatctaagaccatattagttccactgggcactactaatgcttaataacgaggaaataagcaatatatttgttagccctctgaatttctgaaataagcaaaaatgcatcttatacagtaatttttttaattactggattttacatggatttttcttctaatgtaaaatgtcataaaagtttgttttttattgctagtaattagtggatgactcgattatttttctagattagcatactgctgttttagcaccaatcttgatgtcaattcaatgcaccacaaaccgacgtatttttaaggaaaaaactgtcgccactattttagcgtttccgtttgagaatagggttagcgaaatatgttaaaccaataggacgcgtgggagagctcagccctacaattaattttacaattaatttatcgaatatctcatatccctgccgtagaaaatagcaatgcctcagagtcacttgtgctatatactcactccagtttcatatttttttttgatgttttggataagattaagatcaaaattttctaactttgagtatcaataacttcaaaaatatatttaatttaaaggcactagaataacatatttgtcttataaactactacaataaaattaaaattatatttatttattgtacataatataataaaaaatagttaaagatatttattttagagactgtgttattatttaaaacgttaagaattatgaaactgaaggtaatatggccatgctaacactaaacacattgcaaattacaataggcttgcatggccaaggaacctttagctaatagctttctgaatggccaaggaacctttagacgagtaggttcgctcctacatgaattccacaacaccctccattcctccaataactagtagcttttggcggcatactggcatgatgatatccatcgttgatcatgatgtgtattctttattgactccccacttgtagtcattcatatgtgttattcttcatttctttccataaggcctgtttagttcacaccaaattcccctccaactctcaactttccatcacatcacatcacatttaaaactttcctacacacataaactcctaattttttttccaaactaccaatttttctcaaatttctccccaattttagaaactaaatacaccctaagagtatttgtaacactacatcatagactatagccatgcatgtagcgtccccttagagttgagggatgcagggcccacagcccttctgggcacatgtcagcctccagtactatacatacaatactagggatcttaattcagagttgagccttgttggtagaggacaacacacacaaagagcaagggggtgtcatgtctcgtgtggtcttagagggaatcagcatgccttgcagaggagacgaatgctttaatttagtgagattaggtggagagatcgagcatggctgagcataccatcacaaaatgagaaatgttgtgtagaacacatatttaatcatgatatgtgtcacagatgcaatgaaagaagaaaccgaaggcaagccaagttaaaagaagaacaaattaaatcgaacgcaaagacatgaaaaatcaaagacaagtaggagctcataggccaaatctagtaaggacatggttagatgcagtactacaacgccgattgcgagaagtgatggatgagaaaagttcacggtaaatcatgatgggtgatggaacttgtaaagggacgttctcacctaaactagcggttaacggtgtagccatttagggggcgtggagaaaaaacaatgacaacacgttgaagctagattgctttactactactactccatctattttatattataagatatttaattttttcttagccaaacttctttgaatttaactaagtttgtagaaaaaatatattaatatttttaatacaaaacaatatattaataaaatatagttaatattaaatttaatgtactaatttagtatgacagatattactattttttttataaatttgattaaataagtttgacaaaaaaaaaaagaaacggagggagtacttcacaatgccaactagagccgtgtttagttcacccccaactatcctcaactttcaactttccatcccatcacatcgcatctaaaactttcctacacataaactttcaacttttttttctaaaattttaacttttttcaaaaactaaacacaacctagctgtacagcaaaggttagcttgaaaggcaaaataatgtgtcgttttttaggcggggaatgtgtcgtgcccagaaacgtctttcatactgctgtctcacatgtgatctgtactccaaccgtgtccatcctgaattttgttgctactaaaactcgtaaactcggcagcaccggaatggccaagcaggacacgcatgacgcagcacgcccacgctgagagtcgtgcagtgcgcccaagcacgaatctcgagggtggtgcatagaagctccccgcccaatcaccgcccgccacgtcgcatccccgttccacacccttcccttcccttcccttcccttcgccaccgctttgcttcctcctctcctcctcctcgcttctgcttttatcccactcccactcttcctcgcccccaccccaaaaaccctagccgccgccaccgccgccgccgccgccgtttgctcgagcatgtactactactcgctgcgaggtggcgcgtgcgtctaccttgtggcggcgtgatacgatacgacgcgtgcggggggaagggaagccgaggtttgacttgagtggtgagccgggcatggaggagaggccatagatcgaagggaggcgcctccgccgccgaaggaagcggcggcggagaaggtggatggctccccgcaaccccagccccaggcggagctgcggctgcggctcccggcggagatcgactgggaccggctcgacaagtggaggttcttcgtcctcggcgccggcctcttctccgccgtctccaccgcgctctaccccgccgtcgtcctcaagacgcgcctccaggtcgccccctcgcccgcgcacgccgcggcgtcgtcgctcccgccctccgccgccgccgcggccaccgccatcctgcggagcgaggggcccctcgccttctaccgcggcttcgccacctccctcgcgggcaccgtcccggcgcgcgcgctctacatgggcgcgctcgaggccacgcgctcggccgtgggcccgacagcgctcgccctcggcgcgccagagcccgtggcttccgcggccgcgggcgccccggcggggctcgccgccgccgtggcggcgcaggtggtgtggacgcccgtcgacgtcatcagccagcgcctcatggtgcaggggaacccgtgcccggcctcccgctaccgcggcggcctcgacgccttccgcaagatcgtggccgccgacggcctccgcggcctgtaccgcggcttcggcatgtccatcctaacctatgcaccctccaatgccgtgtggtgggcgacctactcgctgtcgcagaagacgatttggagcggaattggttgctacctgtgcgagtacggtgttggtgtccaagaaatcgatgccggggaaggggattcctccctgcagccgggttacaagactgtcatggtggtgcagggagtgagcgcggcgatggccggtggcgcttccgcccttgtgaccatgccattggacaccatcaagaccaggatgcaggtcatggatggggaaggcggcgagccgattacggtggggaggacggtgaggaggctgatcaaggagggtggatggggagcgtgttacagggggctcggcccgaggtgggcgtcaatgtcgctgtctgccaccaccatgatcaccacgtacgagttcctcaagcggctctccgccaaggggcatgagagcagcctcccctgacgagacgaatagatgatgcaaataggtgaccttgctttgttactttcattcctttccaatgcttgtttcatcttttaggtgttgcaaagagttgtttgtagatagtctttgtttgctcctctaattaagctaagcaaatcaatgcaatccactctttcagaatgttttctgtgctatcaataggttttgccttttagcttctgaatcttcacaacggagtaattcatgtatactgaaaaattcctgtccatctatataaacggctggttctccatgctgcaatgttttactataagaaattaagaatcatgctcattgtattatagctacaacctaaacaagcgaggtgatttggaaattgtgatggcactgatgtggccactaacagtgttgcacgttaaatccttaactctgttgaataacagtattgcattagcgagtttctttaggatgacaaattgaattattcaatcaaatgatttgcaaagacgctgctttgttactgaatggtagagtaaacatgtttaatgttgccatccaaagctggagctgattctggtatagtggcatgggctattgttgcctattcgctgctctgcaaatccaacttgtcatgcaggcacctgttccatagtccataccactcttggatggacaaaagctcatttcattctcttttctctgtccctattctgaagccacaccaggaatctgaatacgttgagtggcacacatacagactaggatacagtactaacttacacagatgcttttgtgcagtaagttgcaagtgatctctattccacacatagcaatgaacaataggcacaaggtatgcatggattggattggtagaggtgttctcatacgccctagtgcattgctgctcctggaaacatggaagatctgctcatcctttttcaatgttctcccatttgatgttttatgccttttctgatttgataagtatgctaaagttagtgtggctgaggaagtcttttcttcgaattaataaatactcgcagttgatgctgttccaactaaatgcattcttgcccgtcctagtttaatgttgattaggaattagtacaagcaaatctcccattttaataattataaacttttgcccatgatagtgaggcgtgtgtttatccattgtttatgctatcattatcttgatgatgggtaggcagaaaattaggtagccttctttcctattaccctgtttcttaattgttgctttgatttggatgagttcctctcttggttcctccacttctactcaagtctactactccactccgtactacatatcagaggatactcttggacttagattggtaccgctgccttatcttcatctgctatcaggaatagtaggatatgccttatgtttctgtatgttttgattagttgattaccacagtgccccaactctgtaatcctccaaatggtgcttttgtatatggtaccgaaccaaaatcttttgcttgacgaaaatgtgtggttgttggctaatgaaaacggctttgatagaggataatcccactactactttaaccatccttgctgagtgaggattagcctacccaaagtgattcgcctgctgagtgctgacctagattaggacatgaaatgtcagtacttaattagtactactactacaaccactatgagccgttcaatggattccaatgtccctttgtccactgtccgtgcaattatggtataggcatttggcttacctatgcttgattctgacaactgattagcgtaaggtagaggtcttattagcaccagctaagcttggcttgttcatgcacaagccctttccttttcatatcttttctggatcaaagcaagatgagtttagttctgagctgacaatactacaatcactgggtttcagaccacagaaaatttttttcaggaaacattgtgcttgcttccatcagtgatcagtcaccatgattagcaccaggaagaagccgataatagggtctccgactccagctccagatgtgcgtgacatggacgtattgctatctgctgctttgccttttttttctcactactttttgttcactcgcgtagccatcaatacatcacgaagtggttgcgagccactggagtgccaacttgctttctttatctgttggccaagccacactgagcttgtgcaattggtcagtttattaaagagaaaatttgcatatggccgatatgatattttgtactattgtaataccattgtctagctaccatctaaaaacttgcgtttggtgggcatgacatttcaatattccatatttcacataagctcgtgaaatgggacaaaaaccaatttcaatttactgatgaagagaaaaaaataccaagtactggtgtatggaacttggaagaaacacttttggttttgcaaactacaggttcagggaatatggaatttctaattattatttttctaggctaatcactctacgatagtcttgagttcctcaacaaaagcttcctgtccaaagcaaaagccaaaaccatgaaaaagaacatgtgaatttgccacaacaagagcctaaggttagtagtaacaaagctttaaaattaagctcacatgcatgcacaatcagtatcaactgagacggctgctgctgcccgcaaagggcgtactgttagtgccaaatgtacaactctggattcattgttcgttgaagaaccacttgtgtgtgtcgcgaggacaagttctttttttcatctcagagatactgttcatgtatcctcgctcggttttcttcccaccatagcctggcatgcatctcgctgaacctctctcggctgcaagcaagagagaataattaagtctctttccatgatcatctgctagtagctagcaattcagttgcttccaaattcttcgatcatggagattcaagcaattagcattaggctgttcttgaaatcagattactgaccttttctactttgtcaatttacggattaccaacaagacaatcctatttacaaagaaagacgttacaagaaggatgggagacaaacctgaatcgaacacgccggagttctctgataccaccaggcaaagcccggatggtaatatatacaccaggctcgtcttcctcgacccactcccgctcttggtcacttgcattgctgatggacaccgagagctcaccagatctgtcgacctcttcaggagatgagctcgtcctcattgatgcgtccattgacgaggtttctgtcttggctccacttatacttgacagcttcggtgttgagaccagccccactgaatcatagcactggtgtccatggtggtggtggccaccattacagtagtggtttgaatgatgctcaagagaatctgatgaagatgaacccactgcaccaccacctgacaatggtctatggaacgaacgaggtaaccgttccttccccagtggtggtgtcaccgggctgtcctcctttgagctctgtaggaaaagaaaaaatagacatggaatcatgtcaaagtcacattactaactgcaataactagaatggtaacttgggggagtgctagtgtcgtcacctcgtcttcagattttggagtagcaggaagaggaacagcttgatggttaaatctctgtacattgtaaagctccataactttgtcataattttcagcccaccatctttgtgcttgccacttgttgaacatctcacggctataataaaacaattttattcaccaaacagaatcagcaaggtaatgttacagctacaaacaatttatatatgatttttttttcagatatgataagaaagcattcatacgcaaatatagattgccttgcttacatttggattcacatactaattagttatacattatctcatttagactagtttcctgcaagccacgctattatacgaagtaaataaatgatgatgtatattgtgaggactgatgacattctgtgcgcataatcaaacaatgagttaagagataaacagcatggcataacttaaaactactaaagtacatgatcagtcaacaagtagctggaaggttaaaattgtacgaaaatcaaatcagagaaatttatacacaatcagcctacaacatacatcaacgaaacaatgattaccatgaccacttgcattagtttcaccaagaacttatgcagagaataatttacaaggaacgagctttgaatggcctgaatagaaaaaggaagatgatatttaaaaatcaattaggtgaatcagatgaattcattttcaatagtacagtccaaaatcgatgacattccacgcttcagttttctggctcataatcatgatttaagcctgccttacagtttcctaagttacatcttgctctacagatttctaattggtcatgtataatttacttggtactgtggtgactatgacagattcaactcagactaatagttgcaacagaaatccgcaatcaactgcacaagtggctatgcccaagaggtaaattggtagtctaaaagcacattaatcaactgaccaaacgtctatgacaacattagcagccaaaccaatgttaccaaacccaaccatggatccactcattaacaaattttaaaatgtccctacttgccttagatctagaactaataataaagtaaataacaagaacactgcactcatcttaagatccagcttgtgttccatcaataaagtagtattctatatctaataccagtgggggctgatcaacgtagctggccatgaggaactccctccaagaatattattttaacagtataccctgcttatagacaaatcttaaaacaaccattctaaactcaatctgaacactacaaatttataatgggcatattttcacatgcacaattttcttttatagtgtccagattaagtctgcagtggtagtttttaagatctcattacaagtgcagcagcataagaaccaaaagtccatccattaggaaagctgctgctaatcagaggtccaggttggatggttcccctgataagccggtgtggagggaccctattacatattaataagaccagaagcctccaaccatttctcaataacaaacggccaaagaagagagagcagaagaagttacgcttctttgtgccattgctctctttccatatagcttctttattgactacctagatgagatgtggcttgtgggcctttgctgtctctatcccatgctaatactacctcttcctggagcagaagcagcccctaaagcaaatgaatgatatagataaagtacaaatgtgtgagctggacttgcccccacatagtactggtaaatttaaagtttcatagagcctgttgtttactagatcttctagccctataaaccctccagggtgaacaactgacatgatcccctaactttaataatgtatggcttaaaattctgagtctactaactggacataacatgcatgctgacacatcaggatttcgacctggctgcagcacatcaggggttaaatcttaaatgaggtccattgtcatagagttgacaatcaaggtatcactttctaatgtaatctccattaaccctacaccagattgttcccattatgagcataaccagccgtaaaatctaaaataataagggatttactatttagcgaatacgtaacggctatgaggttgcataggagtgagggaaaaagtgaagttaatatacagggtagcatatccaatggtacgggtgtgctttttatccaccctcgagtaaaaataggattccagttaagtaagaaattggggtgtacaagaattttaaaactcacacccctccatccagtgtttaaaattgacttacggcaatcagtataagctacctcttaatgaaattttccttttcaatagataaaacaaataatacaaatagaatgccacaaagtgtgaccagtagtaaactagaccacgaaaaattattgcaaaaggtaaagaaggaatagcaatgttgacagagcaatcggaaaaaaaaaactaaaacatggctagttgaagtatgaagatttaacaatctattgtgctgttctccataaattgccagtgccccgaggcaatgatcaatgaaaatttactacctcatccataggggcttgggagaaattactgcctcatccataggggcttgtttgattttaactggctatcaaaagtcaaaactactcgcttttgtccagtttgcttcttgactaaagaagcaggttcagaacaaagctcctaagcatgacatttcgcccccatttacaccgcaaagttactatctcaattcaatatactttgatctaatttatatttagcacgaccagaattcaatcattcatacgagcgcaaactaaactttcaatcatatatgctaaggactaatgcaaataagtagaattttcagtctttcactgatcaaagaaccgagttatgcactggaaatgcagaatttagctcgagcatgctcaagaacacacctgaaccggatgcgtttgaggtcgttgccgccctgtggcagcgagacgaaggttatcagcacgccgggctccacctgcgccacccactccttcgcgtcctcctccttgccgccgccgccgccgccggttgacaccatctcgtcgtcgtcgtcttcctcctcatcctcctcgtcgccgatggggaagtcggagcgggcgctcatggacggcgtagcgtccccgctcgacagcgcgccgccgccgccgccgccgcggaagcgcggcgtcgaggccgccgagctcgtggcgcggcggtacgcgtagtggaaccggtcggagcccgaggccgcgtcggggtcgccgaagccgccgccgccgccgcggtggtggtacgggtggtgccggcgcgaggcccccgccgccgacgacgagccggcgcagggcttgcagtgccggtacgcgcccgacgccttcaacgcaatgtccttgatctgaaacgaaaccccaaaacaaaaacctcccgtcaaaatcaagcccgatctggttgattacgacctacccgaaccaaagattcaaacattcaaagagcttgaacatcccaaaaaaaaattatataccacgatcaaaacgaagcaaaatctgaacagaaaagcaggaacccttcagaaccaaaaccatcatcttctcttttcttttctttttcattgaattaatcaacaggataagaaaagaagagcttcaagcacacacagtgacagtctcgactctcgagagtgaagtaccgagaaccccacctgcgcagtgagcgccttgatggccagccgcgtgctgggcgtcgccccgccgccgccgccgccgccatcgacggcgtcctcgtcctccggcggctcgtgcagcggctccccgccgccgccgccgggctgcttcgagcacgcgatgcacgtgagcatcccctccgcctctccggtgacagcaacagcaaggtcacaggtggcagagccgcccgggcgagcgccgcgcgtgagcttataatggcaggggagggaggcggcggagccgtactactcctacgcctcttcttcctcctctgatatcgagcttggagttaagggcattaaaggcggattaggatctggtgcttaatggcaggaagaggcggaggagcccaattggggggggggggggggggggtttatttatgagcggcgcagcggctgctcacagacgttactgctgcctccattaaacagcggtcgatcgatccatcgatgcagagttctctgacacatctcatctcggatgcgtggtggggctcacgtgcgcgcccgtgtggactgtcaaacaggaagttgtgtgcgggttgtgacagtaagaaacctttttgtgtttgcaggtctcttgcacgttagtgaaaaaggaaagaggaagggagagaaattggtggtggtactagattttggtttatatggattgagtcactgtaacaatatttatctccttttggagaagtagatcctctaatgtgatcatagacatgtggttatgtggatgatagggttcacgtgttaacgatcacgtctctccgatatgagaatgtcactgcatccccatccatttcatgtttggcctaataacgtgaaagaaaatagagataacgatgaagaggatgattctagcaaaggcaaaacttgaagatagcatcttcgttgctgcacacatctctaacatctttgctgctaagcacgtaataatcgcacggtttatcatggtttttaaaaaccgcacgtaataatcgcacggttccgatggaatagttaatatggagtagaagcatcagccgccccgtaaacttcagaaatactactccagtccggagacggcctaccgggcggctggccaccgcaactctgacgtctcgaccaacaggattccttcggcaacgtccctaactcccaagcggccaagccctcaatcttacgaccttttttcttttatctcgtatcccgtgtgcccgccgcccgcgcgtgggtggtcgtcctccatgctcatcccatcatcagccccgtgcgcccgcgcgcccgccgtccgcgcacgcaccgtgtcgccgccgactcacactacccgtcgccgcggcagcgcggcagccagccgtcacgcacgctaccggccatcggccccctcgaaaaccgaccgaaataacgcgcgtcgcgtggtcgcagcccacagctaagcgcgcgcggctccgccgcgcggccccatcgcctcgtctcgcccacacgcggctgacaccgtaatcctggccctttttcctggccgcgcgcgcgcacgcacgcacacggtgggaggcgaatgatcgacggcgggcacatgcgcgcgggccgggaggcggctcgtgccaacagcagggtgggctcggtctgtctcccctccccagcttgcgcttgatcaggagcagcggctgccgctgctctagtggtgacaaactgatgctccaagcgatcatcgctaatgatagcgctccaaagctacacgctgtgagttgttaacgggttcttttccgggtggggttaggtcgctgattgaaggctaatgcagctctaacaactatgctcattgctcgctgcctttctcgtcttatttggaaattattttttcgctcatcttgtctgcggctaggcgtgcacgcagacttcttaactaaaagagtgatactgcgacactgcgcgtgtttgaattattgattggaacgaaggtcatcgatcgattgatccaacgaaaaggagagtttggtccgttctggagtagtagtttttagctgggcatgtaccgtgtgcaggcaactttggagttgtggaggattcggcccatcatcgcatgagcacagccgccgaaaggccgaaacaaacatcgctagtctttgggctgaatttctctcctgtctggattagccatgatggcagcgctctctcagtctctcgttctctctctcgatctcgacatgctacgattaatctaccagttaattaatgaaactatacgattaatctactagaagaaaatgctctagtttgattttttttcctttctggaaagaagacataatgccctgaaagacttttcttttttcataaaaactctttcatgtaaccatattcgagtaactagtatattctagtcaaaatgtcggggagatcatccattccaaacttctagtactagaagaaaagctaaacattataggcaaaataaaatatgacttagcaattagtaatcctcaagcaaatagaataatagataacatgtctaacacaaactatttacatatattcatttagacagcaacctgatcacgccaaaccacacatttccagaaggttgcttacccataccacacatttttagcgaggatgaaatatccaggaaactatcagaaatgtgaccaaatactgcgtcataaaaaagaatctgcaggcagataaatggaaacgaaaaaaaacttccatcagctcaattgtaaaaagaacttattccagacagtggtgtcagtgttcccctaaaataacctaatcatgttggaactaggatcaatgctacaaggccggcccactgccgacgcctttgtaaatgcagacatgctaacacttaacacctttcccgtgtggaacaggcaacaacttaaaaaaaaaaagaaaggtctttttcacgtcgcaaccatggcttcaaattttgctccctagaaaacgatttgtgtacagtgcatgacagggacagccaagatatgagcattaaaatgtggaatcgactggctcacaaatcgtgtttatgctctgaaactgtcaataaaatcacgaaaattttcaggctaataatgtaacgtcagtgcttaggagaaaaaactactgtacttttcgggtcagattctttcgctgacggaatcgccattattatttcccccaagccaaccaacgctgcccccaccgcctctgactgacaacctggccccacgaccccagtcaccccatccgatcccaggtcccccctgtcccctgcaccgagtctttctgcaccgccccctcactttccacctccgggcccacacgacagtaacccaggggacccacgtgcaccgggttcacgggccccggtcgagacccccggtgcgccggtggcattcgaggaggctagcctctctctcctccccgacctcacaagcgcgaaccccgcggagccgccacctctctcgcctccccgcctccgccgcgccgcctagggtttccaccgcccccgggatgcgcgcgccccctcgccggtagcctcccccccggttcccgccgcctccgccgccgccatgtcgctgctgcggcgccggaagcagccgcagccgccgccggagcagccgaacgaggacagcagcaacggctccgacctcgacgagaaggggaagaagaagccgggatcgtcgtcctcctcggcggcgcctcctccggaggcggcggcggcggcggcgaaggaggcgacgaagcggacgagggccaggtggtcgtgcgtggacagctgctgctggctggtggggtgcgtgtgctcggcgtggtggctgctgctcttcctgtacaacgcgatgccggcgtcgttcccgcagtacgtcacggaggcgatcacggggccgctcccggaccctcccggggtcaagctgcagaaggaggggctgcgggcgaagcaccccgtcgtgttcgtcccgggcatcgtcaccggcggcctcgagctctgggaggggcaccagtgcgccgaggggctcttccgcaagcgcctctggggcggcacgttcggcgacgtgtacaagaggttgccttccctctcctccgcctcttctctctctctctctctccccctcaatctgtctctcttgaattaccacgatcatttagtgcccgtaaaaattaatttatgcaagtaacgttggaggttttttatccgagttatggagcattgatctttagttagtttgtcattggttgtgtctatatcggtttagatgttgctttcatcattcgtgctctactttctgcttttgtttgttcgtcagtgttagttttagaaatttaatgctgtgatgctttaatttgagaagtgtctgttacttttttgggtgcctttgttgtgtgacttgtgatttacgatttcgggaatgagattagcttatttcaatcattcttggttgcaaaatactacactttctaagtgttacttttaagtgttgtatttcgtaatatctttgagctgaggaataagtatttgtcccaattttgttgaaatatgactatgttgaatgagttgggtgctaaatacaaagaatgagtattcatcttcctggtcagctttgtactaattgcttgagatatctcaaattttctcgaccaagaaaaaaattgaaatgttggcgtagctgtttctttcatagtttcatttgtcttcaaatgttgtaaataatcagtatcaggaaagtaggatggtgaataggcaagaggtaaacttgtgaaactggatcatattcttgcttttctttcaccatttgatttcactgtttactattaccagcaaactcaaagtggtgatgatttgaccagatatagaaacagaattgatcaagagaaacaatatgcttctatattgcgtgctttcagggtttttagaagagaactgcaatttgcatgaaaaaaagaacttttggtatggtttcttacaggcacgccttataggtttcaactgagggaatctgactgttccgttatttaattattcttttcttgaaagacccatgttgcctactgtctgttgaacaacttgggatttctgaacaattttcctcctagtccttgcttctaagccttgtgttgttgagctagagctgtccatgtatatatattgacagttagtgaagttgataatttacatattaaaaacaagacctaaatgtttatactttacggcgtagcttcggcctaaaagaatccatacaaagaatagacaatataggacaacacactgcaatatttagcgtaataacacgacttgactccttcatgtggtattacttttgtaattattttttattgtcataacagcaattttcgttgctttgatgtttttgttgatggttacaaaactacaatgatatatgggtaagtgattatgcatcatggtgtgtttaccttgtttgatacagtattacagtcaccagtacagcctgttaattctgaagattgtttcttttagatttttagtttgtctttccgcagcccgtttctcaagaaaacctctagctaggaatggcatgtctcattgttaggcttgcatgctaggcctaattgaagtgtcccttggccaaagtggtgtgattatgccatcgtgatagtcgcaccacaaggacgaggagagaagggagaaataagtacttttgtttatttcttgcttgccggtaatgatcacagtagactcatagtgggccttttttcctaatatatatagatatcgatttggttaataccctgtctagctaagagataatataccaaataaccagatagacatattcctaagtaataaatatgtccctaatccttgcatggtgatcacttaaacatggtacattaacaccaaccttaggaaggcatgattactattctattgctccatcacatgggccttaataggttgcacacggcattgattagttcactgttgctctttatgtttcatcctttagtcattgaaccattgttctttagtctagaagttgggatgccataatgacctattcttcttttgttagtgtaatgcacttttgctacgtgtgctgcacactaatacttgggctgcgtatactcccactttctcattagttctcttgaaatattttcaggcctttatgctgggttgaacatatgtcactggacaatgaaactggattagataaaccaggaataagagttcggccagtcacaggcctagtggcagcagactattttgttcctgggtattttgtttgggctgttttgattgcaaatttagctcgtattggatatgaagaaaagaccatgtacatggctgcatatgattggaggttatctttccagaacactgaggtagccatatttaatgcacttagatacatggatttcctttgatgcttggctatgttctcctcagaggtttagactgagttaaatgatgcttgtctgtaatgtaaattaccacctgcaggttcgtgatcaaactttgagcaggataaaaagtaacattgaactcctggtagcaactaatggtggaaatagggtggtggtgatcccacattctatgggggttctctattttctgcattttatgaagtgggttgaggctcctcctcccatgggtggtggtggtggtccaaattggtgtgcaaagcacatcaaatctgtaatgaatattggcggacctttcttaggagttcctaaggctgttgcaggacttttctcatctgaagccaaagatgttgctgttgctaggtaattgaaatcaaaagtctgcaattctactgtacaattgttagtattatttgaggttttactatgttgaaaccaaattagttcataatgcagttgtttataggattacgtacttgtcaattcaatttataactgttatgtgtaacaacatcctctagcttgaatataagtttgattaatgctctgaggactatcagttcacaacaggatttggcacctctgcttgtggcaatccagttacctaaccaatggagtattttttttctcaaaccttagtcacatatataatttgcttggtatcatcggaaaatctcagagttggaaaataccattatacgtgtcactgacatgtgggtcccacatgtcattgtcacatactccatccgtaccataagaaaccaacctagtaccggatgtgacatatcctattactacgaatttggacatatatatgtccagattcatagtcatagaatgtgtcacatcctatcctagattcattttttatgggacagagggagtacgatggtattttgcaactcatgtatctccacgatggtatcttttaaattttctccatataattattatataactgtgctaataaaagaattttagtcagtactgaagttgtcaatactgtatacactactctaggtactgtacgatttgattataggtcaatacctatgatctgtgataaagtttgtgggaaccattgaattacttgatttagcttaaaaatgccattgcataaatcctttcggtaattgtgtaactatcttcttgatactttattgaaggtgaaatataaagaaaacatgataccgttttcaatatatcaatgaaatgatagatgatagaactaggcaccttcttaatgctaataattatgcttgagattgagaaataagtaactgtcgaaaatgctaatatagagatgtaacactattacaatgtgccatctgaaatattgtccttagttcaagattagagttgtaaaaccattacttgtagtaatatttacttctctggtttcacttgaactataaattttttgctgtgta

SEQ ID NO: 64874 - DNA, 1271 bp, Oryza sativa
acacaaaacattggtttgtaaatttaattcatttttagttttccatacatattataacatgtcaccctttgagcatttgctcgggggccatttctatctaatattcttttctgagtgttgatttcatgaaaattctattcgacattgtcgaagactccatgtctctattgttctacaccaagatcgactaaggcgagtatgacaaatgttgacaaggtttcgtcgcagactttgcgccttctcgaccatttgagaacggctggtggatctcaacaaggaatacggaatgaaaagatggtgtacccgccgagataaaatttcttgacttcaatccaaattctcgattacagcaagacaggaaacttagtcgtatgctctgtaccttcttagttgacgtcggagattgactcagacaaaccctatacggtgcctgcacaaggcttataagggaagtctagcgttatctctgaactcaccgagaacggtcacgtgacctcgacaacagttattacgaggtcttcggattgagaatatgtactcgttcatttgcattaaagccgggggctactgtcagggttatggataccacatacctaaatagaggtgactaaaatttcgggacgacccaacacataccaagttttatacgaaaacaaccttcgggtatagaaggagttccagataaggaaagataaatagagttctatatggaaacgacaaggattactcagattgtatccatattggtttccctagttctacttggaaaaggaaacacctatgggtataaatacaagaccctctaagaggagaggggggatggaacaatagatcaagacacaagatcaacatacaagccaacatacgccaagacaagacgccggatatcgacttcagagataagcatggctagtcccttacggtgtctagggatactgataggagagacatagcgctgtctttgatcttgctggatgcggattcgagaaggaaggctaccctgttgtcgactacgagtcagcacttcagaccgccaagtcgacaacagttagataggctaccccaaatattgtactggtgtgattatggtgaataagagcaacgaccggcttcggccaacaggagtagggttattaattacctggcaattcagggaaccgaacctgtataaaaatcatcgtccccatctcttttacctcaatctcacatatatcctagtaccaacgatccccatattatacaaataccgtagacgtgacatcaaacgtcga

SEQ ID NO: 64875 - DNA, 3222 bp, Oryza sativa
  unsure (1)..(3222): unsure at all n locations
agagtgccacgtggcgatgggttttgcgattagggagaaagagagaggcatggacgggagtgggctcatcggtatcgcactttggtagcgcgacactagcgtcggtagcgtgtttttagagcgcgagagcgttggaaaggagctcgccgccgagggactggatcaccagtggagtcgtcggagacgaaagagtttttgcgatggagcacgtatgaaagacttagccggaaaaaggggatttcaaagtagtggcctctacagtcaaaacagaaacccctagattgatgcgggttcgagaagagcaaaatccgccgcattatataatatacaacggaattggggggctgctgacgagaaatccgcgctcagccgatggtgccggaactgtgttggcacgaactaagttgatgaacacaatggcctgagagatctgcttagctctagtgcaggtccaaaacatgatggcatgcgggcatgctagtcagtttgatcctacaactgacaagatatataaatagtagatcaaatagccgatcagctgacaagccgctggagtagttccggtcgatgccgatactagccgatagcgataaggttttgagctattggctatacgtccaatgtgggatctgatacttgagtaaataatgatacatagacaatcggctgataataatgtaacaatacaacaatataatccaatagaaaccaatcggctaacaatatgatagaataagtattgatccgaaggttaaagcatacatcggctggaggtctgatgtcattaaatccacaagattagataaacaacgaaacctttgttgcgatcggctaaatctaacttgtatgtaatccttataagccgatgcaacgtccagataactcatcagctgaaaccccgatgaaacccttattataatcaaaggcaggttagcttttccgattcaagcacgactagggatgatatatcgcaaagtatgcaaagaagcataaagtctaaacaattaagtctttgactaatcttcagggcagtggatatcttagctaatctaatatgataaagcaatttagccgataccagcataaacccctaaaacaaatcttagccgatacaagtaaattgaactaccaaaatagattaactaagatatatgatagataggtgcttacattgacaagattagagtgtcgaagccctagccccaccggtgcaaacagccatgagaagtataaactcgtcgaaaaagtagaaaagcaaaaagagtagtgatgctccgagagtagttgtattgatcgttcagatagattacaatgacctcgggtgtacatatttataccnagggtagatgctagtccttgttggaaaagaaagaaactttcctgaggataaaaggaaacttacatactcttccgaattaatagataatctgcttgtcgcatccttctttaactcggtctctcctggataaacttcatttgattgattaatttccttaaccgaatatagcaagaatccgactattaccgacgtgataatttcatcggccgattccaggactctgaagctgaaactcactctaggccgatgatgacttcggggcttaccaaattccactgttaaaacatgccccccaattttggagtatgagaactcatgcttcaaaattatcttctttttgatcttgatgactccaaaattgatcctcttctgtatctcgcaatccgctttcaacaaaaaaagggggaaaaaattgaccacaccaacaaaaggggaaaaaaattgactaccaacaacggagtagttgagaagactacaaaagctaagcttagttccttctgttgaatcgggaaatttgggccgttgattgaatcgttcaataattaattgttcttacaagcttccaatcttcatcgtcaagatcggtgtgggaaggataatgatgatccgacaagtgtcccaaaacctccacctgtgtttccttattcagcctaatcgcgtcctccctgttggcgaaatagtcatagtccacctccacgaatcctttgcgagcgtactcgccacaaacccaggcctgcaacttggcgaacttggcctcgtcctcatagaagtcgtgggtccacttgtagaggagcatggtgtactcacccttctcctccggcaacggcaccagggaccactagaacggataccctcatctcaatcaggcagtaagccccatctcaatcgggcacggcgtccgtcataggctagaagttactgatgtgaaaagtaatctcaatcgggcaaatggccgtcacagatgaacctatctcaatcgggccctaattaaagcccgtcaccgatagctttgacccagtctaccaagcgtactatagcccgtcacagatgacctatctcaatcgggccacaaatagagcccgtcacagatgactactaacctcaatcgggcctaaactagagcacgtcacatgtgacactcatctcaattgggcctaaactagagcccgtcacagatgactgctgacctcaatcgggcctaaactagagcccatcatagatgaacatcatctcaatcgggcatttagttatggcccgtcaaagatgagtataatccacaaaaaaaaataaattttgtttttttggctagcctcaggcctttgctagccatgcccgctgcaaaaatgacagaaacaaatacagatatctaatatccccagctccccagcatcacccattcatacatatgcattcacatacacagacatcaatatatttcacacaaccacacattgacagccatctcatatttcatatccattcacatatttcacatccatttaaatatttatcgtatttcacctgcaaaaccgagttaattggatcaaatatttatttagcaagtcttaacataaacatatgaaatatatacataaatataagcatcacagttacatcatcacagttgcataataagtgttcatcattctctagacataaaagttcaacattgctcatcattttagtttaagcctaaacattcctttggggttaattatttcacggaggatgaagctggctatctcctcacgaatctcctcaaagctggtaggcagagacttggttattgtgccctacattgtcataattccagattacttgatcgatcatatataagtactaaaatgtagttagtctatcacaattgagaccaccgacctcaa

SEQ ID NO: 64876 - DNA, 559 bp, Oryza sativa
ccgtcgccgttcgcagtcgtcttcctccgcgccggccaccctcggtgaggtttcctctcccatctattcccctccctctccttcctagccgccgcttagcgcagccgccttcgcgtcgcctttgcgccgtcgcctccgccgccggttgccgtcgccggcaacgcgttcgcgtgtgcgcgcgccgtcgccgtcgccgtggccgcttggccggtcttgagccgagccgggtcgccaccgcccgtccgatcagccccgagggcgatctgggccgtcggtcccgtggaccggcggtggaccacccgcgtggtcccggtccacggtgaaccgccccccctgagccgctgaccggtgggccccgcatgtcggcgccgcgcctccttcccccgtgctgacgtcagccctgggatttattgcgcaatgaatgatttaaggtttttcttttatagtaataaacacagtgaatcttctaaaattcataactaattcatccgagctccgtttaagcccattcaagtctcagtaaatcaagaaaaatgtgtagaatccattaaaaatggtt

SEQ ID NO: 64877 - DNA, 3816 bp, Oryza sativa
tttttcttacttttaattcccttcctttcaccaccatgcaacaaaatttgctctagtaaatgctaagagtcgattttgagccgttgtcatgcataacaaccatactcctttctctttcctctatgtcaccaaatttacttgcatggcaatagagagagaacactaataaacaccgttgtacatgcccttatacatgacaacggcttaacaacgactcttacactataatatagaaatatggttgcatgaggataaaaatatggaaagaatattaacaaaaggaatattttttgagttaatgattagagtctttgtcgtctcaactattataaagacatggtctctaaatatcttgtattgtttaagagaccatacctgtctctaccattgaacatgcccttagagctaagctagatttgccctcgtatgagtcgatctttatttgttttctttctatctgctttcagccattcggtcaagttccagctttccaagatggcgatcttatccttttcggtaagatatctctaggggaaaacttgtacatactctagaactgaatagaacactacttaatataaagaatctaaacatgctgttttgtcatgattcgttgtaatatatggtgttctatctaatcctactgttagagatatttgtgtgcatgcatatcttattctgtttttgccgtttatctctcacaatctattccgattttgtttctataagtcggttgagatattgtggagaggtagaggctatatgtacacatgttgcgcgatgaatctttttatcgtgttgagctatccctgctttcacctacattgatatattataggacggagagagtaaatgttataactttgatgaaataatcaaaagttcaaaacataagcatacttgtagggtattttggtaagttttagtctagactttggtactttccaatacctaagtcaatgagaaatatcaaaatttgtattaaaaaatatgataaccttttaagagatagggagaatacgaaaaatgagatacttagggtatctacttatataatccactcgtatatttttacgcctcgtaacaatacaaatgaatgtgaatacgtaaatttaactaagctgttgtcttctctgccatcgttaccaagttgtcactttcttttgtcgattgacagagtctcgtgcaattgcaaaatatatactccacttcgcaaaagcgcatcagacttgctgaaggaaagcaacctctcgcagtctgcaataatggtcgatgtgtggctcgaagttgagtcccaaactttcgacactgccatgtcagcaatcactttccaatgcttaacaatacccactttcatgggcggaattgctgacgacaaaatcgtggaggagaatttggggaaactgaagaaagcccttgaggtttacgaggcacgctcgtgcaggttcaggtacttggccggtgatttcatcagcctggcagatctcagccattttcctatgacgcactacttgttagctactcctcatgcatcagtgctcgatgcatacccacatgtgaagtcttggatcaatgatttgatgaagaggccggctgtgaagagggtgagagagcttatggaggcatgatgagaaaaaggagatatccatcaattaatcatcagtctgtaggtatgaaatgtttgtcatttctggtggggctgttagttaattataatggcttaatccagagaaaggaaggaacgacattcattatcttaattaaaacaaaaaaatgtcacgcctccatgtgtccacgtagcttattatgcagctttgagttgagagacttaattccaagttgtttcatgatttgatcagattatttaaaaaaaaaaatctctgctgttgagatatgcatctccggatctccccatgagttgaccactacagtgctctgatcaactcgctataaaagcgaccaaccccttcgccttcgcctcaagtcacacgacgccatcaatcaccatctacacctctagagagctaattaagctaaggaaagagaaaaatggcgccggcgaaggtgtacgggccggcgatgtcgacgaacgtgatgcgcatcctggtgtgcctggaggaggtcggcgccgagtacgaggtcgtgcccgtcgacatgtccaccggcgagcacaagcgcccgcctcatatctcccgtaacgtaagtacaaacgtcgcgcgcgtgcgtcttctcttgctcttgtgtaatcgatcgcttattaccggagttgcaattgcacacgatggtagcttagtactaggtactagctaagatagtattcaaagagagtaggaatagctaggcagctagtgacgtttcttagccaagtttgtatgatagcgtaaaaaaaatcattaacattaaattaggtttattaaattaactattatatatactttttactatatgagcatcttatattaaaaatgttgctatatttttttttataaaactggtcaataaatttgacttaaataaaaccagaacatataacagacgctcgcattgaagttttggcatgctcatcattagttacgaagagtagctatatttttagcatcatattaaaaaaatattcaaaacgtttttatatgataaataattacctactcttacattgtaattacgatgtaaattttcaatcttaaactgcaattatattatacgatttaatatttacatttggatttttcctaatacacaacatataagataattaggattaaaactaatttattatctacttacaaaataagaggacataggacagatagaagcatatgcttacatatagaagagagcgggaaaaaataaatcaaatcaagttaaaaaaacgtggcaccatatttttaataaaaccgttaattattactagtttcgacgccatcggtgttatctttaggttctgttaatgttaatcacgtcttttgtatctctctctatgtgttgcagccctttgggcaggttccagcgttcgaggatggcgacctgactctgttcggtgagatagcatcgtatactgcccacttgctttgtgatgtgacattggatcgatcaacacaaactattattgtgtgtgtataataaactataaataattttaacttttttctagtcaaacttatcgaagattgaccaaatttattaaaaaagattaataatattttcagcacaaaataaatatattttatattatatttaatgaaataccgtacctgttatcaaatttttctataaactaaaacaaacgtaaaataaaattaactagaaaaatgttaaatcgacttataaaataaaacggagggtactattttacttgcatctttgctattttcttggaagatattttagataactgttccagtgttccattatagactttagtaatttaaaaacgagaatacaatagcaagaaagtcaaacactctgattcctttcggagtagtaatatattgttctcgctaagcacatgttccgaattcactaggtgatgcttgaccttcaaccactgcaatactcttgcttcctactactatcaccaagagtagaataaattaaagtatatttttgacactaatttttattattacattcgtttttaaacaactgacagtgaacactgtttattttaaacttgaccattcatttgtttttgaaatatttataaacactaaacggaatgccatgtaattaaagtctacagtgtcgtaaggataaaaacgaatttttggttcatttaatctgaccatttaaagttccaatagtatatttgataca

SEQ ID NO: 64878 - DNA, 1999 bp, Oryza sativa
tagtgtcatcaaattaatattgaatatattttgataatgggttgaaaatgttactacttttttctataaattttcaaacttaaaacagtttgactttgaccaaaatcaaaacgtcttataacttgaaacggagggagtaggtaaaatacttctcatactatttagagtttgatttgttccttttttccgtcaatatatagatcaactttaaaatatgcagtcccatcgtttcatctaaaactggttaaaatccgtaacgtttgttaatgataaaaaaaacaatttatatggaaaaaatttatatactccacccatccctaaatatttgacgccgttgacttttttaaacatgtttgaccgttcgtcttattaaaaacttttgtgaaatatgtaaaactatatgtatacatataagtatatttaacaattaataaaataataggaaaagaattaataattacttattttttttaataagatgaacggtcaaacatttttaagaaagtgaacagcgttaaatatttagggacggagggagtgtgttttcagcaacttaaaaactatgtaaaaaaataaaataagatgaaagttataaaaatcaactttgagattatgatttaaattttaaattttggatgtgactgataagctaatagggaaatctgagctaaatatccctgtaatttcagggtaaacgaggaggaatgtcctagaggtgtacatatctagctcaactaaacttttttttaaaagaaaatcaagttaagaaaggcacttgaagttgcccgaaaattaccgttttccttttgtactgaagaatgtagaactcaatgaacattggtcaacaacgaatgtacggtctgcctagtggcggaagctagtatccttgaagtgtcccagactttccaggaaataactcggtagaaataaattcagactactaaggccgtatttagatttagattttttcttcaaactttcaacttttccatcacatcaaatatttggacacatgcatgaagcattaaatatggatgaaaaaaaccaattacacagtttgcatgtaaatcgcgagacgaatcttttgagcctaattacaccatgatttgacaatatggtgctacagtaaacatttgttaatgacagattaattaggtttaatatattcgtctcgcagtttacaggcggaatctgtaatttgttttgttattagtctacaggcctgttcactttgatgaaaaaaatcttacccaattttagcaataccaaaattttggcatagttgccaaaattttagcaacttaccaaattttggtaggatttcttatatagttaacaaaatttgacagcaaactaaatgtaaccatttttttggcaactttaccaaaatttggtaaggttgaaaatggcatcaaagttaacaggtcatatatttaatacttcaaatatgtgtccgtatacttaaaaaaaaattggcaaaaaattggcaagagagtcttgtattcttgtcgcctgcttctgattgttgattttcaggcagctcacctggtcgacttccacaccgcatcatattctctagctccatgccttcatcttgttcaggttcctactgataataattaacaaggatataccgatcatatcgatggcgcctgtgaaggtgtttgggccggcgaagtcgaccgccgtggctcgggtgctggtgtgcctggaggaggtcggcgctgagtacgagctggtcggcatacacatccccgccggcgagcagaagagcccggcgcatctcgcccgcaacgtacgtaacgcgatcttccctcttcactctcgtgcaaattcaaaacttctatgtagctgagaaagagtcagaaccaatctcagaagtagtactacttcatgtagcaagattaggatatgtaaaatggttgttaacagtggtctcttagcgttgctaattaggaatacttgttgacatggaggaaagagaaagaggagagacaaa

SEQ ID NO: 64879 - DNA, 1672 bp, Oryza sativa
gcccacgagaactccagctcgtcggagacgggcggtgccgcggccttgaactcctccacgagcccatgcgcagggtctgcgtcagtgcccggatgaagacaaggagcagcttctcggggcaggcggcaccctacgcacagagcccctccaccaacgctcccgccgcggacaccctgcccttgtcctgcgtcaccgctgccgtcgcgtcgttggccgttgccgttggacctttctgtgatgtcgtggctcctggagtgaggagaggggagagaggggagatgggaagagaggaggaagaattaagaggaggggtgagtatgacatgctctccccacatgggccccaccatttttaattcattctttgggtgcaactgacatatggggtcacgatttttattattttataaatcaaattgccacgtcaattccacgttagatgaagaccgagtcaatatagctacgtaggcgccacgtcagctaaaacggtcatccaaactaccatgggacctatatttcatcggttttgatagttgagggatccgttgtatctggttttctggttgaaggactaaaatcggattcgttgacaagttaagggacctgagataaacttattccaccacagaaaagatgacgagagattagctgggcctaggatggtgcctgccatgcgctgttgctcctgcggtgtgtgttagatgggctctctcatgggcctaatacagcagtagctcatcgatgagccttatgctctctctatttacttcttccccgacaaaaatcggtttggaaatttccgaacgtaccactccataaaactaatataataataatattcttaccgatattacggtatccaaaatttaatttttctaatttctatgtattgaagttgacactaaataatatccataaatataaaaatttctcaactgttttcaaccgtttatgtaaagtcatagaaaaatatcgtttccggttatttctggccgttttcactcctgtccataggggccacagcactttctgctgatcagggaagcaattttggagcttgttcattagctttgtttgtttgcttcgttgcatgagaaatttgtaatgtcagacaagttacgttttccgtaagatgatttatccccatttcaccctttctttctttctttctttctttctttctttttaaaacacaatacaaacataggagcccacaatacgcgtacactcacctatacgaacacacacgtacatcctatctctatgagcacccccaaaagactgggtacgtcacctaccactgaaagaataattaaccgtaaatagaaacaccccatgtcaaatctaggatttgaacctggataagttgattccaccacaagaaacattaatcggttgaaccacgctcacatccgccatttcgtcctttctgaaagacgtgtcgtcagagcaagcagattatatttcagaaaaaagatcgtcggaaagtgttttatttactcaatatctcaagagtgtcaacccaacaatcataaaaagttttaaatgaaatcaacatcatagttgtttcatgttgcattaaaaatgaactcctatccttccccatccttgcttcagatgctgccggagcgagccgtcggcaagccacgtggcgagctaggagggaggtggcg

SEQ ID NO: 64880 - DNA, 743 bp, Oryza sativa
ttgagggaggagaaccaatttttatcaccggtcatgtgccgcgaacaaccggaatccacgatccacacgttctccttccttgctaccaaaacctacatacaagcagaagtcgaagcctcagtactgggttagatgataataaaaatttaggaatccagtactaagatacacgaccagaagatccaataggcatatatccacgtgcaaaaacagtttgagaattttcagaaaaatttctccgaggccggtctgaccgaaggggtactgccggtctgaccgggggtcggtcggaccgccgctgcaccgccggtctgaccgctgcccagtagccggtccaactggtcgccggtccgaccgctggacccactgcagtctgaccggtttcctcgagggaaaaccaaatttttgccactttgaatttgcaaaatcaatctctctctccattttctttttatgagccaatctgaaacaaaaaccaacaatatatccatctttcccacaaaacgagcaagcatatttttcacgatgattagaaacattggtagactcagatggcttagcaacacaagcaacaacatgagattttgcatgcacaacattggattttgaagatgatgcactcaaggtagacatgatgccaacagatttaaacacagtgtaaatagtttcatgtttaaccaaaatgtcaccacttactagcactaatacctaacacagtaggaggatgggtaccgagctcgaat

SEQ ID NO: 64881 - DNA, 653 bp, Oryza sativa
aacattccaaaaaacttgatagaactcagcaggaaatccatcaggacccggtgctttattatgttccatttggaaaatagcctccttaatctctttctcattaaattgttgcgttaaagcttcgttttcaaaatgagaaacttgaggaggtttttttatcagatcgtcttttaatagactgagatattgcaaacgtatcatgtagaatatgtacgtcaaaagaccagggcatagcgtatatgtatctataggtatactagcaaaatacccgtgcttcgctacagtgtattaaaactaaaaatatttatttttagccaaagttattttcacactgtttggtacttttgcttgataggaaaagtctcaaatgataggtgacgccgctttttttttcttttttttgggattatcgttcggtttttatgttgtgatttgtactccgttcacgattaggattttgtatcatctttgatttttttcaagaaaaagtgccccgcgccgtttgcccaacccgcggggaaaaaggaaaaaaaaaaaggggggatgagaattgggaggagtaagaaagattacttaattactaaaatacaaatttctggaatacttgtattttttaagtattttttaagtaggtaggtgtttaaattaattga

SEQ ID NO: 64882 - DNA, 25580 bp, Oryza sativa
  unsure (1)..(25580): unsure at all n locations
gagagagagagagagagagagggagagcgcccggaagaaaaaggggggcccgggggagagatgggccgagctggattcggcccatcgaacccgggggaggcaaactagacttttgcggaggaaattgattggaaggatttggattcggaattgaactcgacgatagatcggggattgagatcttgagatggcacagacactagacaacaagcaaagaaacaaatttcgcaattagggtttttaagagataattttcccgctaggcgccacgacggaacgggcgctacagtgaaggattgaatttataaaatatcaaaaaaaaaaatcattcgcgcgtgtggaaaagaaagaagcgattaaaaaaatctggaaaaaagaagcgatttaaaaaaggaaacaaaaaagtgacgttaaaataggagatcttaaaaaaaagaaacgcgtagggatgcagctggtgcgcgcgccggctcctttcccttgcgcgcacgcgcgctagcatcccccataagtttaacccataaattatatttgcttcgttcgtttctcaatggcttgttagtcataggtcaatcaatcagagtctagaaaaagaggtaattttttccattgttgagaagatattaggagatactatttttttagtgtgaaatttgatatctatactagctatctcggtataaaaattactttaaatgtaaaatttagatgcctcaatatatatacttttttaagaaccgtaaaatttctcatagaaaaaagcaatgaagacggacatgactctcattagtagtgttcttttttttttcctaatccactatatagtgtaccattatccattaatttcttttatcttttacaactttgattttgagggatttgcatactgttttgaaaggttgattgtggttatttctcacttgattagatgcatgagtttttaaaataatttaatttcaagtagatacaatactcatgtatagatgatataattgtgtattattccctccatcctacgtatttttagtgtttaaaatttgttagcatttcttgagtattattttcctaacccacctaattaaccactgaaattatttctcactagtttgcatcgctgggcatgatatttcttattaaggatgtgtttagttcacattaaaattggaagtttggttgaaattgaaacgatgtgacggaaaaattaaaagtttaggtgtgtaggaaagttttgatgtgatagaaaagttggaagtttgaagaattattttgaaactaaacacggcataaagtgaactctcgggaggccgggggcatcgtgaaataaaaaagaaatgttggatatcagagaaggggctctcgtattgaaattttgttaagaggggtgagtttcgaatcgggatcggcgagcccatactttaagaggatatcttgaaataatttcaccgtaaccttaatttacgctaaaatccctaaacatatttatattcgtggacatggcgagtacatgccacgtttcttctgctagtaatttttcacataaatttttttttctcagcaagaaaggctggctatatactccagtgcagaaagagtgaaaaagactacaccaaacaagcatgaggcgtgtggaggcatgaaaacagtacgtacccagggcacagcagtgaaaacatcgatctcttcaccctgcatggtgtctccttaaaatctgatcgatcgactcccaaaaatataagtaaaatactcgagtcaaaatgcatcagtttgcatgcatagtgaaacagcagcaagctggtcttccacaggatactttttgacccattcctcctatacatgcatgtaattaatcacaaagttgcaaaaaatacaatactatgattgtgtatttgtgtgtactatatataaaacaaataaattaacctagtagtaactgatcagtatcgatcgagagtcaacaaaatatatgtagactacgacgatacgtgtgtgccttcctgttttcttttgttcttatctttgggccgcactatacgctgcatctatactaaacagtagtgaaaaatctacctctccaccactcaattattacgccggtctataataattcgttgtataaattacggggcaacagtgaattattcatgtgctcttgcgtgtaggattgccaaacaactgtttcatggtcagataaatgaaaaaaaagcgacaaattggtaacaataaggaaatgttaattaatttatgacatgtattactttcattaaaaatataatagtttctgactatacatgtatctcggaggtacataaccaaaaattcttagaggaagtataaaaaaaatgttttcttgttattggctacgaggtctcccaaaaatccaatgttgtacaaatactatattacatgtcaatttgaaattgtgttaataagtaaaaaaggacactccaatttctccatatcctcaattgaggaaatataaaaacaaaatttgtttaaaaaaatgtttcaggaagtataaaaaatgttttattgttcttggctatgaggtctcccaaaaatccagtgttgtacaaacactatattacatgtcaatttgacattgtgttaataaataataagtcaaaaaaggacactctaatttctccatatcctcaattgagggaatataaaaacaaaaattggaattgaaagttgaaaccatgcaccactagtctctctctctctctctctctctctctctccccttccatctctttctctcccctagcaattacactacgccttctccataaatgcgattgcaccctctcaacactccgcggcaataactccttcgcccccctctccacattctcttccacctgtgttccccttttcttctcctcttcttcttcctctcctcctcctgatcctgatcgagaagatctcaccttgatctcttgccgtgtgatctctagctctcgctagccctctgaaccttgcagtttgttgtttgcacccggtgaaacatcttcttttgtgcaggtaggagagacagcaaagcagagataagagttctatatttgcatgtagttcttgtcttggatctcactggctggctgtctcctctctgcagcaaggttcgttgggctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccaggtaaagaatttcttttgtcaggaatttgagctgaaaagaaattaatttcaaggggtggcctgctttccttttattttcttgaaaaatccaaagacttttgagcgttttgctgtgctagatttttaccttttgcgtcttctttctctttcttgtgtttgattaatttgaggtgttactacttgagatgaaaagctagaagaggggaaaaaaagcaatacattcagttctgaagtttctgaagataattagtcacactttcttggaaaatgagaagtttcagggttgtggagagagagagaaggggggctatatagaggggagagaaagaggttatctccagtacttagtggttgctgttcacacatattaggtcataagattcagagtacatgagagcctccctttctttaagactggcctactcctctccctactcctatataaggggagcagatgaacaggtcagctgatagatagatagataggactatggagaggagggagattttccaagttgctgatcttgcacacatattgagagggaaacctgtagatcatcttcaacaggtttgttgttgcttgcttccttgttcttccaagctttttgggtctttgtgttgtggcactcttgaagaagaaacatatcgatctagctaccctttctttcttattcctctttgcaagcttgctttcacatcttctgcatataccaaagggaatcaaaaaaggagaaaagtttcttcacttagcttgtctcctcatcccttcctgatttaaagcaatcttccattttatccccaaatttttttctgtgtttttatgaagtatgaacacaccagatttttccttgcagaaatgagaaagttatcaatatgggttgtttttgttcatgcatacaattttttcttctatcttttccacaaaactttgaacttctccactttgtctagtatctatttaatgcatatgccatgtataaaacgcacggaataaataggtactactactgtaaaggcgtaatctgtggtaccaaattggtagctaagttttgctctttatgtagcacacgcatactaatcctcaattaattcgatctgctccaaaattcgcagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcgtaataacactcaactcatagctatttacttaattaattatgtgttcttgattccatatagtatatactttgtttgattgtcctagaaatgtgacatatttgagttcagttcagttttgccccagctagcttgttcttggaatgttattcatgggtgttctaattcagaaaattacgcatgaaatgctgtgttagtctactgaaatcaatgtgaggagatgagtacaaatggaacagctggttaattatactgtctttaattaatttcccatggactgatgtaagcttgcgtagaagtcaaattgatttctcttgcccgtccatttcccctggacgaactgcataaagttgactcgttgatcaaaaccgtttttgttcttttgcactctcccccaaacaaaacggaagacgaagcattcaagaacgtagtacgaattttgcgttcacacgttcaaccgaacttcaaaaatttccccttctaatttatttttcctggatgcattaattcgtacgtactattaacttactgatgactaatagaattaaattaatctcggttcatctgttctaaatctatctgatctgatcagattcttcaaggaatgtccacacccagatgataagcagcgcaaggagctgagccgggagctcggcctggagcctctccaagtgaagttctggttccagaacaagcgcacccaaatgaaggtgaaaaaacctaattaatcacccaaatagttgttgattctgctcatcattttcacctttctttcacctgtgttcgtagcagtacaattcttttttttaggaaacacatgtacgtgtaattaatcaggacgttgcaacctgcaagcgagtgcaaatgcaacggattctttggatttctggttgagaaaatttcggccggaaagaaggcgagcttgcgagatagagagaagagagagagcgtcgtcttcttcttcctcctcgtcgtcacaaccacttcatttaagcctctgacctagctcctgcaggacgcattcatggcgtattactataactggacaaggcttgcccacgcacccccatgtccgcttctgcattgcacactgccaaatgtggcagttgcaggcctacgcctccgtccgtcctccatagtcaaacccttcccctaccttgctgacctagctgcatacgtgtacagtgattggaattaacagtttgcacgaacgaacacactgtcatagtgtcatcgtcaatccgttgcaaagattttcgaagtttttagcttgaaatttgagtaaaaatggtgtgtgatttgatgtgttggggagagtgcagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagaggtagttttcaccatatctgaacaatcgatcgatcatggtgacaccgccattgcatggatcgtcgcacgctgatcgtgtcgttgtgcttgtcagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtggcggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcggtaagctcttggttaattttctgtcagtcagtgcgctattcttgtctgaatgttttttagtttggtgatttttatgatcctgtttgattgttggggtctgaatttcgttcaaattttgagtgaattgcgcagaatcagtacgcggcagtgttctcgaacatcgtgtcgagggccatcacgctggaggtgctgtccaccggcgtcgcggggaactacaacggtgcattgcaagtggtatgtgttcatgcttgtcttaaaaattttgtctcctttctgaatcttctgtcatattcggtagtaccaaagaattcgaagtgtgtacatgttggtcactgaaatgggacaaaattgtgttggttttggccgttttctctgcagatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgaccatcatcagctcatcatcatcatcatcacaaatcaaatctgaaattctgaattcaagatatattgctgttcagaaatcatggaaaactgatgaaattgttgtatgatcaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcggtaagtaattgatcgagcatgcagcgaatttcaccctttaatttgatccaaaacgaaattaaaattcagatatgttcaatcactaaaccacgcagtggatttaattgtgtttgttgaatgaatgaatataattgcagtgattacgagctcggaggggaggaagagcatgctgaagctggcggagaggatggtggtgagcttctgcggcggcgtgacggcgtcggtggcgcatcagtggacgacgctgtccggcagcggcgccgaggacgtccgcgtcatgacgaggaagagcgtcgacgaccccgggaggccccccggcatcgtcctcaacgccgccacctccttctggctccccgtccctcccaagcgcgtcttcgacttcctccgcgacgaatcctctcgcagtgaggtactccctctgttttatatcataagtcgcttttacgtcaaaaaaaaagtcgctttgttttttattcagatgaattttgtaaaaaaaaacatagtagcgcttttaatacaaagcaaacacattttatcacaatatattcaatattaaatttaataaaactaatttaatattttatatgctattaatttttttaaaattttatttaacttaataaagtttgactaggaaagaagtcaatacgacttataatattaaacagatagaatacctataaatccatgataaggttaacaagaatacaattacaaactcttagttcgcgaaaaaaattacaaaatcttaaactttgaaaataaatttattttcagtgggacatcctctccaatggcggtatcgttcaagaaatggcccacatcgccaatggccgggatcagggcaactgcgtctcacttcttcgcgtcaacgtaagcagcaattcatccaagatcaaaacgcaagatatatacgagcatgcgataatgcgcgatgtattgatcgatcccgtttcatgtacaaatatatattgcagagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggtacaaatgcaccaaattacttcagaactcttgcgagattaattgcatcagttaatgagaggtatatctgtaaaatttctgatgagtttgatcatgtttgtgtgcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttatacttttagttctcttcagtgtttgatcagtgctgtttcaatccaaaattgtgtgtgctgtgcttgttattagttcttccttgctgcttcaatgaaggcgatgttaatttcagtttccagcagttgcagagttgtgtaagatgacttgcatttcattgccttcaacagtattctatcagaactgtcgcatatcccccaaaaaacagcacaatcaatttaatactccttgataaaatttatgccactcttattatttacatcactgattacccttcaaaagattacatatatacgacaatccctacatggaaatactcgagtgcttctgccataaccttcaccccatgaacaaacatttcagttcccagaaactatacggtctcatccaaagcaacttagctcgcctttagactgaataatgaactggataaactcataagagacgccacttggatcttcatgattcatgacattaccaccaaaagcctcggcagtcagcacagatgatgtccgcgagggaatcattgtatgaatccattgcactcatgaaagtacatcattccgtggggacgagatcgtcaaacgaaaaatcatggatcggtgcacctgcaaaacaagttgagttctggagtaactcgtgtgttcattttacaaaaggcttattaacggaaacacattttaatagttttctcaggatggcatttttcaaaacaacttgattcttaaatatatcacttacatatggagtttgttcctagcaaacatgtttgtgcggtaacaaacatgaaaggatgcttactccacatttaacaatataagtttgctaaaagagttttttacctttttgttcagctaacaggtagaacggaatgtgagctaccatctttgttcctccttcactccagttgacaataccaggaccatttccttgtgcggtggatggtcctagtacagataaacaaatggccggttcattcaatagacctaaatagtcacaagcacgttgccacactctcctgtccgaggttcgggaacgagcgacctgtacgaaagtaagttacaagctcaaacgatgaaaatgagtggtgacagtaatatatcaaaccttaatattcctcaaactggaaggattagggcctaccttggccaatgatacacgtgctcttggaagcaactcattatggaacgttgctagctttgctatggcagtcaccacaaagcagaggagcctagcttgagatgattttctagaagatgcacccataggatcaaatcctgtgtcctgacttaatcccaaacgacttcacaacaagagataagaggtcagtcaaaagagatgccatgcaagtttagaaaaaaaagactggtttaacagggcccacctggtagccagattttcatataacagcaactccaaattttcaaacagttcacgagctacatctttgcgattttttcctccagctccatgctcaccaatggcccaacacaaatgcaatgctaattcagtctgtgtaaataaatcacattcgatcagaaaactcagttgatgtggagaagagtattaatcatttaagataatcagaactaggataagagagcaggtgaaaattagcagtttggtgaacttataaaatcaaaatgtacttaaaacatatacttgcctttgcaggattatcatgagcctccccaagtctgtctgtaatgggcttctgtagaatggtttgaaattatagtgcaaaatttttagtggaaccagaaaaaggagatatttactttgttgcttaaatatgctacaacattcactctcagaaaaagaaatgctacaaacatggtatattggttcagagaattgacatgtatatgcatgtctagttatatgtatacccagtacctttagcagtgcaatgatgtcaggggagcgctggaatgcagccaatatgaaatctgaaagtcttttcctcacctacagcaattttattgcaaggaacttgtttgaagggtgatatagaattgtggaaataaccaaacataaatccccatacgaacatataccatccttttgtactgaaggtacatatgatgtgaagaaaattcgaaaacatgatttacttcttccattttgttcgttagacactccaatgtaatgtatacgttccacaaatttcaacttttaggatagctttagcaattaacaattttacttaaaaaaaactatataagccgtatatctaaatagatgggtgtatcatcaattgttttcttgaggaattgattcttaattgctgactaaaatttagtttcctatgcaagtaagcacttcggttcaatcatcaagtaagcacttcaatgatcttaccgtagtactgtagttactactccagtattagacgcagtattagacgcaatgggaaaaggacacccacttgcctacctcgaaggagtatactttgtcagggaacattgctgcatatcttgacataactacaggaatcagagcgcataggagtgctgaagtgacaaatagtagagggtcaaatcaacaatatgttggtcatcactcatcagtatgtatagcaattaacaaagataggcaacatacagtcgttaacgtcccgcaatgctgtagcaaaatataatgtaagaaaacgaggtgccattttcagtgactgtttcaatctgtccgattgtgggctattaactgctgcctgtaaggttgaagatatcgtaggagatgtccaatgttttgcctgaggaaaacatcagaaaatgagaagactagatcaaggcattcactgaagaacatggaacacatacttcaaggaactacttacagcaataccatcattctcatcttttagaagatcaaggaacatcgggtcagcaaggtctagaggaccactatcatccgaacctgcattgccaatggcatcttctatagcagaaccagtgtatgcttcatccattagtgcaagtagcatctgtacgatagaaaaagattagcaagcttattagttttgataggtgacatttcatttacagcttttaggtcaaatcattacggaaatcaacctcaggagcagcactcttctgtatagtagctatactactaccgatgagagttccagaacttctttccaccttttccaatgctaccactaacactgttttgttccatgagtaagcaatagaacaaatgacaccaattagtaaaaaaagcataatagtacaggataagcatcctcagtagcagcatgttatacacattacatgcatctcgcatgttggaagagatgtgccccagatgtcagcagtcagcacatgcaacagtttaataacactatcataataaacttggctaattagcttctaaaatcatgaagtttacagccttgcacaatctaaagaagctagaggaaaattctggaagtctggaatcagaaggcttacttggaagatccataagggacaggaagagaggaagaaaagatcctgctgacatcattaacggaagcacttctgagaacttcctctccaatctaaaacaaaggaaacccaagttagataggtcaaatcattgctggaaagaggtagaatgaacttcttcatatttacacagtaaaatatcagcaaatatgtgaggagttcatgagcaattaagatggcatacctctcaccatttgatgcaattagcttcagcaacaatggaaaaaactgcacatagacagcatcacgaaagcattgccaaatattaacatcattaaatagtaatttggaaagagaacaaaacagaaaagtcaaaaaagaaaggaggaaattggattgagatcttttcaagaagtatgcttgattcattggcccttgccagtagaagcctagagctacatttatgcaaaaaaaattctaactgacaatataaagaatggtagttgacataagatgtagatattttgataattctagtgctgtataacattatatggtatggcacctgtggaattaatgtgggaaaagagctcaggatctttgtcttattcgctatcaggaattcaagtgtacgttctgcgacaataggatcagcgaactccctatcatcaagaaagaatagccaagtgattgagggtaagcaggaaaataaaaataaacaatcgcatacccaatacatcaagaaaaattattacctacttaggcaagagcggaagaaggtcctcaagctaccatcagcatcatgcaggactgcctccccaaagtccaggaagaactgcagaatggtctgggtagggagcagtaatacagtatgtattattagacaggtttttcttcaaatatatgatgactaaaaatgtgtgtacattactaatcaaatctaaatgattctattcaccaacaattgtccacagagaatgattatatggggtcaaatggggatcataaggttaaccattaacattagagcaagctcgcccctaaagatgcaaacatttcacaaaactaccaaaacattgcaacgatatcgtcctccaacctaacatgtaagaataacaaccatttgcagccaagatgggggaaaaacttcacatcagtgaatcgaagcacagcttacgagtagcagcacgccgctggaggccacggattgggtcggcgcggcggcgcagcgctggaacagcttgctcatcacagggaacgcccgggccaccatctcgtcgctggcccccttggcctccttgcacatctcgcacaccctcctcaccttcacgccgcaaagcccacacgagtcaacaagccaaaacgtgagcacatcccaccccccctgattcgaagaccatggaaggggccagggttgcagagagatgcgcttacggattcgaggaggttggggtcggaggcggggtcggcggccgcggcggagtccctggatgcggcggagagggagcggaggtggaagttgtagctgccatcgccggcggcgagctccggcgaagccatggccgtcgcctccgacgaacgagtgagtttacagatggggacgtatgatgggcctcagccgaattagagcccattaaactaggcccacgttgcactctgggccgttggataacacgtacgaaatgtaactcctatttaatctgagtcggcttctaaaaaaaaaaaaattaatctgagtcggtctcactgctgatttttcaccttttggtcctttaaaaaaacttattattcacgcagtgagaggtgtctgaataagtttagaaaaacttttggtcttttagaaaaacttaaggccattttggtttgaagctaaaatatgtgctatcaaattgtttggcactttgaatagtatatttttaggcctcttcactttgatgacattttcaatattaccaagttttgataaaattgtcaaaaaagtggctacatttagtttgctgccaaatttttgtaactatataagaaatcatgccaaaattttagcaactataccaaatttttggcattgccaaaatttggtaaggtttttttggtatcaaagtgaacaggcctttattaatgtttgatttactatcaaaatataccaatagcacaaaaaatttggtagtaccaatattttagtatggtaggaaaccaaacatacccttattctctttttggtccttaaaaaaactttttcatctttaaaaaactttttgagatctatttataaaatatttttttctaaaaggatcaaaatgtgaaaaattcagcagggagaggtgtctgtccctcccacagtcccactcccacctcccctcattgcctcgccgccgctcgccgtcgttatccaccggacaacgagcatcccctgacgagcgcagaaccgagctccggcgccgccgatctcggatgccaaggcgggctacaggtaggtgattttctttttgttccctaatcagttttttttcgatttaattatttcggcctatagtttcttattcgttttccatgttgatatttttcgccttcttttttttcagttttgcctctcccgattgctccgtctctcgagtcggtttccgattcgaacgcaggatgccaaattaaccgctaactccttcaaaatctgaactcgggaggcaagagaagaagagaatcaaacagagcgcctctggattttgattctcaacactacaagaggcatttttttttttgccggtggagtatatgaacggcaagcggaagagatcgggtggaaccatggagactcgtgccatcaagtgcaggacgatgcagcttctccatgaacttcaaataagtatgcttccccgtcctcaagtctttgatctaattcctatacagagattgttgattccgctgtttctagggttcatttcatatgtctgaagaagaaaaatctgttccttttttttcctgggtgagacgcctttttaatggaggggcggcggttgaaaaaaaaacaactctttttttttaataacctggttggttcttcacctaaactacactttttttttcttaaggtgctatctaaacagaaggcaattgttaactctcgtctggtctaagctcaaatattaactttattttagagtaaatttcacaaaactatacgttttgtggtctatgttgcagaaaactacacactttgatacttggcatttaagtacatatatttcggtagtgttgttttataaaaccacactatcaatgaataaatccaccgtgagatgacatggctgttccacctaaacgaggacgtggcatcctatgctattaattttttgcatgacctcctatgcttgtcagcgccggcgcggacggccgttccatatttccgcccatcgacgaccaccgaacaatatcgtgtagctctcaccgccttcggcctgcatctcgtcgtcatgtcagccacaagccagcgcctttcctctcactgctatcccctcgccgccgcgccacgaggttcctcgctaggcctcatcatctctcccggcggcccctcaccatcctctggtcatctctctccaatacatgctatgctcgagatctggagttagcaggcaactcgctggctacatgcctcttcgagtactgcggccccttgtgtctcattccagtactatggtggctctgccattctgctactaacaggtatagtttggttctttttttttggtccaaggaatcaatcaggtgcccatttcatagtgagttttctaaaaaatctagtgtgaatgagcaagttccaactgaaatttcacataggtttgtagttttttgcctcactgttgattgattttgttaaaaaaaacagttaattcatcaaatatggaggtttctaatgcctctgaaatgaaagtagtacaaaacatgggagctataaggggaggacagggaactagtattctaaattttacagtcagtccactattgtacttaatttcaggtagataaattacgcttcagtggaaaggatcactgagtctgaagtttgtggctataaccccttgagttaattgattgttccattcagcttgtagtactggaacttgacaagagaagcacagtagtttggctgtagatagtagtaggtggctcctttcatgtctgcaggaaagtgctcctaaaccaagcacaaccttcagttgtggtaagcacaatacagacctaaactcatggaactttgaaatgaaataaaaatggtataatgctccattagacatgttcacacatctagtttgatcaacaagtattcttaataaccagctcaacaaatagtgcaagaacaataaactcaaaacaaccatatagaaaggtgatcactgaccagaaaacaagtcacagaataaaatccttggtaacatatcgtgctgggattgtgtagcgcccgttccgtcgtggcgcctagcgggaaaattatctctgaaaaaccctaattgcgaaatttgtttcttcgcttgttgtctagtgtccgtgccatctcaagatctcaatccccgatctatcgtcgagttcaattccaaatccaaatccctccaaatcaaattcctccgcaaaagtctaatttgcctcccccggggtcgatgggccgaatcccgctcggcccatctctccctccctccccggctctccctctctctctccctctccccgctccccctccgctccgcccgcgcgccgcgcgcgcgtgcgcgtgagtcgcccgcgccgagcgccccttctccttgctctccttctccccatccctggcgagctccccgctcgcgaagacggcccccgcgcgccgttgttcgcgcgcgcgcccgcgtggttccccgcccgagccgtgtcgtctgcgccgtccgcgtcgcccggtcccgctaccctgccgcgcccacagccgcgcagccgctcggcccggcgagccagcgcgcgtgcccagccgcgccgcccgttgtatcccgcgcgcgcgtgccgagtggccgaccgcctggtcgccgccgccgtcaccctctaccgcgccagcccgcgcctgtcgcccgtgtcgtcgcgccgctccaaaccgccccgccgtcatcgccgtcgtcatcgcctcggccccgccactccgcgcgcaagccgccaagggacggaggccgagccctcctccctctgccgcgacgctcccgctccctcctccctttttcccaaagcggcaaggggcaagccccctttctctccctctttttccttttcctcttcctcgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctatttctcgcccgcgccattgccgtccctctcgccgaccgccgccgtcgcgtgtgtgccggaggagccggtgcgcactaggacgcggaaggggacttcgggcgcgtcctcttcttcctcttcctcggcccgaggccggagagattactcccgcgccgtcggcctctcgtcactgcgccccgacccgcacggtagtgcctccctccgttcttcctcctcgctccatcttccccccttagttttcggtggtagcacgagtagcctccccgtagctagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtagccgcgtagatgctctcgccgccgggaattggcccctcgtgacctcgtcgccgttttccccttttcccgccgccggttgccgccgccgcgattcgccgccgtcaagctccctccggcgaatccgaaccgttggctcgtctcccctcgtcacgtgcaaccacccggtgtgctcgcttttgcctgtatcgccgtggttcgctccgccgctcgccgctgtcgaccaccgtccgttccggccggcgtcgtcgtctacctcccgccggcccgcgtgggagccacgtaggcgccacgtcggcaccagctcagccgaggtcgggacgggccgaccccggtcagcccctcccgtgcgcgcgttccaccgcgagccgtgaggctgcgcgtgggcccgccgcatccgcgtccaccgcgaaccgcgcgcgtgcaccgagtccttcccccaccctagcgccgcgccgcgtgctccctccgcacggtgagccgagccactgacaagcgggtcccacccgggaccgcacgcggtgagcccggtccaccggctctctctctcctccctcccgcgcgcgcgcgtcttgggccgctctaggccgccttcttgggccggccggcccgttaagctcggccgagccgccctttctctcgggccgcgccctagccgcccgagaaaagtctataatccctccctcttttcttttcttttctttttcttttccaaaaaggatttaattaaatccttttcctttagaccaaaaatccaataatcttagaaattcaatatcttcccatccgtaaatccgtttgacaccgttcaacttccaaaattcctcaaaactcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctgtatttgaaatttaattatgttgcttgaaaaatattatgcattgttaggatcgcacttaatctgttgtctcgtctgcaaggcagattggcggacctacctaatttgttgcatttgacccttccttcgttaattgttatatcatgaacccttgtaaccatctagttgcgtctcgatattcgtgcaccctgtgcgagtatcgacggacgccttcaaacttaatatctgaataacaacttgggtaaaacttgggttttacaaaatacttggaaaacccgacacctgggtcggtgcttgcgaactaaatgaatttccaaaaccgcggaccggggaacataccgggtgtacggtttcccactctcgcacttaaggaccgattccttggaatttcatccaaacataaggcaagtacgaccacatgggtggaatgggacacccctggctgagtaactagcttatcaggggagccttgatgccgagagacttgtggatttgccggggtggtgtcagggaggacccctaggcttcctggcacagtatggtctaggacctaacctgttgttggtctgggacccctctcgtcggcatatggtaaacctgtgtcggctttggaaatgccttgtcatgaaagcttggaggtctcccgacgtggttgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttggggaaaggagttcgatgtttgaaaaatctgcagctgatgggatcagctaagcggatcctgctgatgaggagttcttccaggagcaagccggctacgatgagttttagggtttcggcctagttcccaagtcgcgcctgtgatgtttggtccaagtcctggcttccgtttcccttttgtaatgcagttgtgagctcgggatctgttcgcagcccaacatgactgtacctctactctataataaagagacctctgttgctgtgatattctgtcttcctgtgataccagcactgtatcctgggactggtatcgattaacaggttaatttggagcgtcacgggctagttccggtcggggctagttcggggcgtgacagattggaaggcacatatgtgcgtatatttagttgcagcagttttagtgggccatgcgcatagaagtccagcttgtcccacgatgccacgtccttgtcctaggtggaacagccacatcatctcgcgtgtgaattcattcattgatagtgtagttttgtgaaactacactatcaaaatatatgtacttaagtgccaaatgtcaaagtgtgtgtagttttctgcaacttggaccacaaaacgtgtagttttgtgaaatttactctttattttaacgtaactccagggtctttgactctgtgctctcttcggtcttagtggttctagagtccatcctttcggagggccggctgtggtcgttagcggccgtcgcttcctttggggaattgttgggagcgtagagtggctctgccctctcccgctgtttggagtagagttaccgttgtatcgagttcttttttcctttccttccttgttttttttatctttgtttttcttccttccttggcataggccgatctggctgagtgcgtcgtgtaacaaaaactctattcttctaatatattgacgtgcaatccttttgtgcgttcgtggaaaaattaacctttattttggtttgttcaaattagcagttcttgtctgaattacattatcaaattcggaatctaatagttggtttttatctccagacgaattgggcacatctgcaaaaataattgacgcaccaccgcgacgaggtgatatttctactggcataatgcgagaactcccgctcgataaacttccagaggtatggattgctaagaatgttttgattactatcgttgaaacttctatgtcttcgtgtgcttggatcgtaggatttatttttcctcgagggattgattgtaggaatttggtggtgaacacatatttaaacaacaaatcaacaatgtttgggcaaactatctaccactcaatgatcctgaattatcattgttacaacctttacagtactactagcagaacaaactgcatttctttgcaccacacatccttttatccggttgatttaaactagtcatcgtcttatctgagttgggtgaactattactgatcttcctgtgcagccatgtggtttgctcatgttgattcattaatactcactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagagcggttctgcggcgacgtcgacagctgaggcggagcggcgacgtcggacagcggaggcggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggatgtaggatcaacagagaaggatttggtgctattggctattgttgtccgttccagtggtggtgactttggtggtgctgttgctggtgctgctgctacttgagaaggtgaggatttggaggtgaagtggaagcttggtttgctgttgctgttgttctgatttggggaagaaactgtgtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggcgttaggcataatgggttgtggtatctggatagaagagggacggacaaagcactatgtagtgctttgttagctagcacaagtgaagaggaggctaaattgattctaaaacattgtcaattgggacatatgtcctttgatactatgtctaaggtatttcctgatgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgttcactcatgtatacgatgaatgtaccaaagtttctatggagtgaggcagtcatgacagcaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggatcatcaggtactgaagaagacacataatcaagaagcatgaaatttgtggttggctcaatcccatatcctgttagtgaacccattcatgagcaaaattggagaaggccatgtgaagaagaaaatctacaagtttatactaggaggaaaacaaggtctttggaggcgcaaacaatagggcaacatgagtctcctatggatgggatggagcagcaacaatcttcaattgttgctgaagtaggtgataaaccatctgatcagtgtgatactatacagatttcatcggatacggaaggagaggagtttgaaacagggggagaagaaactaatcttcctattgctataagaaagggggtaagaagcaatgcaggtaaacctccacaaaagtatggttttgcagctcaaggtgtgaatgatgatgagaataacatagccaattatgtctcttatgcttctttgtcatccacatataaggcctttgtgacatcactaatcnaagtggaattccaaatgattggaaggaaaaaaaccaagacccaaggtggcatcaagctatgctagagaagttagaggctcttgaaaagaccaaaacatgggaccttgtaccattccctaaaggaaagaaagtggttacctgtaaatgggtttatacagtaaagcaaaatcctgatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttg

SEQ ID NO: 64883 - DNA, 37940 bp, Oryza sativa
tcctccgccacaccccgccgccgttgccgccgcgctcccctcctccgccgcaccccgccgccgctgcactcgcctcctcctcctctgccgccgccgccgcctcgcctcgcctactccgccgcaccccgccgccgctcgccgcctcatcccccgccgctcgcctccaccgccgccgccgctccctgtcgcccgcctgcctccgtgtgcgtgagtgagaagagagtgagagaagagggagataagagagagaggggaatagttggataggagtatgacaagtgggttccatatttttttaataaataaaatactgactggactaccagcgtatgccacatagaccaaaaccaccgcggattaggtcgaggggggtaattcgtctgatttacatagttcggggtgaagaatatccagttttatggttcagggaggtaattcagacgaccgctatagttcggggggtgattcgtactttttccaaaaaataaataataattaccgatcgattaattcattcttatttaattgtggtattggttggtctcaatctacccattgactgttcatgcagtagtgactgcagatctgtggttatgtttccaactgttcatgataagaacaaacacagttgctgggattaatacacagacaaagtggccacaatctttgtgtttgttcttcatgtatcctaacaaaactgaggttcttttacatggttcaattatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgcgccgccatgtcgacgtacgcgtacgccaccacgtagcactccggctccagcccggcgtaccggtgcacgcgctccagatactgcgccacgccgatgcgcggcgccggcgcgcccctcgccgcctcgaacgccgccatccctgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtagaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataacaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactagacaccacgtgggctgcacacgtggaaaccacgcggctaccgagcgggcacactaacacggtcaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtttcccaatttttcatcggggggttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtggagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgccggcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcaggtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatggtcttgccagtgagggtcttcacgaagatctgcatacctccacgaaggcgcaggacaaggtgcagggtggactccttctggatgttgtaatctgcaagggtgcggccatcctcaagctgcttgccagcgaagatgagccgctgctggtctggtggaataccctccttgtcctggatcttggccttcacattgtcgatcgtgtcagaggactcaacctccaaggtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccg

SEQ ID NO: 64884 - DNA, 8284 bp, Oryza sativa
tcaggtggcaacccgtaaagctgtaggaggtgacttggattttgctattgcaaagggtgttggttggctcaaggctggattgatatggctgtacaactttgtcctgctctttgtccctgttgatttgtaagttgatggtttgggaatttgacattacaaattactagattttcttttcttcactcccctgttataaccattagtttcctcttcttttgcaggtcagatatggaagcatgcaaagatgactggagaaaaattgttgacgaagcgttcagccatcctacatacaattctgctctggttactgtacataatacttgatgtcaggctacagaagcctttctccattaaagaacattcttgtagcatgtcatttcacagtgtatcaccttaaatgcctaagtaaatatatctcggtcgcaaattatacctctgatctatccctcttgattcagaaaacctattttgcatttgaagaattctggaggcgacagcagttataacaaggcggccacaaacttcagcagtaaattggtctccttataacaatgtccaagctatcctttatttttcattttatgttagctaatgttgcaagagtatttgcgtaacaagattttggcaattaaaaacatactccctccgtcctaatatgtagtaatctatgtccagattcgtagtcttaagatgtgtctaatcccatcctaggatgctacatattgggacggagggagtatgtcagagtataagcttcattcggtcttctcattccagagagaattgggctctagcttttctcagggttgaatttaaccattttcatatgcatcctttcaatcatttttattttttattttaatatttattttttgttttatcatcttattaaaaatcaatttgtggattctgttgttccaaaacaaaattttgtggattccaagtccttccaaatatttattgacttgtccagtatgcatacagtaaagttcattactaacattgaataatattgaaagcactattcagaaaaggttagtcttttaagtgatgatggattaaaattggactaaccatcttcctttctcattttgatacagtaaagtttaattgttgatctactgtgtaaatatagtgcgtgcgtcatcatgtaaaagaatgcagctttaccctctgagttgtcattcaggtaatttctcatatatttcttctattaggatgactttcaactttacatgattcatatggatacattatcttgacagattaggggttaatttagtgattacattgccaattgtgcaggcatgtatgacctagttggctgggaggctatccaactagatgcatcaactggtgtctgcctggctgcctgaatagttttatggtggtgcagttagcatgtctgatgatggcattggcaggtgagtttccagcgtcactcccatacaattattatcgttatacaaatatttatacattggcaaaaatgtgttgtcggatgcagaacgccagtactgaggtagcatcgttgcatgcatcatccttaaaaatgccatatgaattaaaaaatgcaatgcacatatttgcacagtggagaaatgtgttgtcggatgtacaggaagtctcttgtaatagaaagactgcatcaccttaaaaatatagcctgaatttaaaaaatgtgttgtcggatggccattggagtagaaagtagcgaggtttgcatcatcctgtgaattatagaaagaggggtggttaggaagatatcacgttatataggagaaagtaacctatcgttgcttaccagtttcctatcgatcgagaaatgctgttaattaattgcctctttttgttgacgtttttccctctgagaagaatatgttcggtcctgagatatttgctcatgtgctgtacacatttcagtttggaatgtcctattatgagaaagatagaacttgtgaattacaagtcctaaggccgtaaaaaaatattacaagtccaaaagcatatacttagactaaagttcgcagaactttgtcaccaacctgtgaaaacacttgccattacatatatactccaaatccaagagatgccattcctctccttttatgtttttttcccttttttatgaaaaaaaaagtagctgtctttcaataaagatggcatttgaaaaaaaaaatgcacagttggtgacagtggcggatccccagccctgttaatgcaattttgaattcatgaattcggctcgtaacctaaagacgtttggaacacaagatttgcatgccttcatgaatttgggaacccagccgtttggaacataggaggtgagaaaataaaggttttagaacttctcctcttattattgttctaacctcttatcatcaaaaacaaaaaccctaatataaaatgtttaatttgtaatgagccgggtttaatctttcgttttcggcgtttgtatcggagggtgccgatgtgcaaaattttaaacataatttgattaaatacaaaaaataaaaaataaaattttcagccgaattaataccatatcaagaagtccgatagaaccaaactttccgaatacataaagagcaatgatgtcagtaatttcactgcctaaaaatataaatgtactactcggtttagagcatttaaaccctcttaattactactccctcccataatataagtcgtaactactttttttttcagatgttccataatataagatgtgcatgcatacaattaattagtacatcttctccattaaattatgattttttaaaatcctctacccttaaaatctctaattctattgggtgcatgcattttatttattagggtgatacaaattaggaggtcttggtctttgaattaagggtggttatgacttatattttggaacggaaggagtacagtcagtggtgggcaaacaaattaaatatacacaagcgtacactctaaaatcttctattttctggctgatgaaagtacaagcacagtattcagcatttttgccggctagtggatctgctgtgtgctggtgtgtaacttgatttaatttatatttagaataagagtcggattcgttgctttttaaatgaagggaagtgagatttgcctttggaaagcgacacttgttatttttcttccttttgttaatgaagagggcacttatcattttgctttaatttggaccagagattccgtgattgtgggagtgccaactgccacagagagttcttttttgttcttttggaatggcaacaagagcatgcatactgatattttaaggtagtacaactctgcatacatggagcaattaattaagtatagcatctctatgaactgaggtgacattgaacagactaattaattaataaacctaaagagagagagagagagagggctacaaatatttgtttgaacaagacatgctacatactctatacgattgagatgtgtagaaacattttttttccatgtattttgaggaacatgcacatatcaacatacatgtaatacgatgttgaattaagcaagcaaatttaagcatgcagagtgcactgcttagcacacactgcatgtgttgctagctagctagctccatctagttccctctcttctcatcatgattgacacttgataaaattaagcaagatttagctagctagctgagctgatctgatcaccatgcatgcatgcaagcaaggccaattcaatttcaagctcgccggccatacaccacacagcacatatacggtgggtaaaacaaaaacaaaaaggaaatcatacacaacattgattcattcatccattctcttaattaattgacttgaggttgaggagcatatatatacgtgcgtggcatgcatgcatatatatggtacggtggtcgacgacgacgacgacgagcctagcaagcttggatgtttgtcgatctcataattaattaatttggatgggtcgatgagatgagatcagatcttgccgatgaggggtatgccgacggcggtgacgatgagggtggatgggacgccgaagacgatgtgctgccagaaggtgaggtcgtaggcgttcctgggcgccctcctcgcctgctcgcacactatcaggttcgccgccgaccccagcagcgacaggttccccgccaccgtgctcacccacgccagcagcagccacgacgtcgtcaccgccgccggcgatatcagcgccgccgccttcgccacctcatcacccataagaagcactgcatgcatgcgcatatatatttttgtatgttaattagttatacttatatggagtagtatacattaattctggattaatagaatgtataattacccgttggtacgtttgatgcgaggttggagaggaggaggatgatgacggagaggacggagatgccgccgacgctgttgaccttggagtagggggccatgaagtcccagatggctcccgggaggcccgtcttgttgaagccgctgacggtgatgaacatcccggagaagaagacgagcagcgagtaggacacggtgtccaggcacggctcggcgtcgcggaagtcgaccaccaccagcgccagcgccgtggtgatggccgtccacgacatgttgagccccaccatgtaggccaccaccatccccaccgtcaccacgtacgcgaagctcttgaggaacagcttccgccgcgcctccgtgcactgcatgaaccatgggtgcttggtcgttatgttctccgacatctccagcgacatcatcgtgttgccgttgccgttcagctgcggcgtgctcttggccgacgccggcgacctgccttcctccaccgcctccatctgcttgccgtcgacgctgagctcggcccctccgcccagctccctccagtacatgcagagcagcatgaccatgttgacggccatcccgacgagcatggccgggaggattcccatgaggaacttggggaaggtgatcttgctattgaaggcgatgaccaggttctgggggttgccgatgggggtggcggcggagccgatgttggcgctggaggcgagggcgaggaggaagggcttggcggggaggttgcgctcggcggcgagctcgaggacgaactcggtgaggacgacgcagcaggtgtcgttggtgaagagggcgctggcgagggcggtgacgacgcagacgcggcacatgaggtcgcgcccgccctggctcttccacgccagcagacgccccaggtgcttgaacatcccggcgttccggaggtagctgcccaccaccatggtggcgaagaggaggcccaggattgggaggtcgatggaggcgtacgcgtcgtcggggctgatcacgtggaatatcaccatcagcaccgcgctcagcagcgaccccgccgtccgcccgatcggcaggaacggcaccgacgggaacaccgccatcatccagaacaccgcgaacgcgatcgatccaagcgccaccttgggcgccgacgcaagctcactcatcttcttcttcttcgatcgaccaccacctagcaggtaattaagtgtctgatcgagctagctagcagattatagctagcttagctacttgagctgatgatctctctctggtacgcgcgcagtagctaagctgctagtgcatgcgctgctgatgcttcctctcgcttcctccatgccggctataaatactactcgacgtactctcgtctgcctagctagctgatgtcatgaataactaatacgcatcaacatgtagctagctagctagggtttttattcatttctaattactactccctccgtttaaaaatgtttgataccgttgactttttagcacatgtttgaccatttgtcttatttaaaaaaaattgtgaaatatgtaaaactatatgtgtacatgaaagtttatttaacaatgaatcaaatgatatgaaaagaataaataattacttaaattttttgaataagacgaatggtcaaacacgtactaaaaagtcaacggtgtcaaacattttgaaacggagggagtaataatcacctctagctctgtccgaaagcaaagctagctaggtagcgtacaaaccctaagagtcaaagccatgagatcaaaagggtaatgtaaactaatcgatcatcccctctcgtcacactgcaacccggctttattattctcgcttcgggacaaattaataaccacatgtgtattaattaattttgtaatgcaaattagtgcatttaatttgtacacttaactgcatattatatatactagcatatatatcgcatacaaattcatatatgtacattatcaatctagctaattctctctcacacaattcacaagcatacataatgctagctctgcgcgtttctgcattgcatgcatgccaagtagaatgtctccgtcgatctacttgtggtctcactcaaaattacaaaaggttaattatacgacttaaaatggattgtcgtggccttccaaattaagcaagcatgattagcagtcgatcgagagttggcacgcgcgccagttagaagcgtcggccggccatagctaccttggttaatcgcgagctagctgcaatactccctccgtttcaaaatatttgacaccgttggctttttagcacatgtttaaccgttcgtcttattaaaaaaattatgaaatatgtaaaactatatctgtacatgaaaatatatttaacaataaatcaaataatatgaaaagaataaataactacttgatttttttaataagatgaatagtcaaacacgtactgaaaagttaacggtatcaaacattttgaaacggagggcgtatattaattcagtctcagcgttaataacaagtacgtatgcacatgtgacatgtaggattagatatatccatatcgatatggagcagttaaatgttgccattatttaactatttaattaaatctaacatacaataatcagcttgcacactgtctctttcagatcatgcatcatcaccgccgcgcccttaactaaactagctagatatatacatatgtgctgtatatatttatatctgttaatttaaatatctttctgttttctttggtttctacatgtgtgcatttaggcatctcacacacacaacaacaacaacaaccacaacaaaaaaattagcaaaacatctacaatacctaattagtgttactaaatctaatatttgaattattttaatactatatttattttgtgttaaatattaccgtgttttttagggcttgtttggttaatttgcaaccatgccaaactattggcaatgccaaatcatagacaaatttttgccaatgccaatctgttggtaatatttgtgtggtattagcaactattggtagcaaaccaaacattgccaaaatcactatttaaaatgccgatatttggtatggcaagtttaatttgacttcaaatcaaactagcccttaataaattttgaataggaaaaagatcaaactgttttataatatgaaggaacggagggagtacatcagtgcgctgctatgcatgcgccgaccattggtcggattaatttactccgatgatcagcaaagtagttagcaaggcaggtactgatgagcacatcatataattaacggtagtaaataatcatcaaattgccgatcaaggcgatataatgcatgaaactatctatgaacagactgaaaaaaatatctacaggtgcaacgcatatatgaagcatgcgtactctcgtatatgactatatgactatacgatatcgtcatatatcaaattaactccctgcaggccactcaccttgatacatgcgacaactaatagttcggtttgctaccaattaacacaaatcgacatacacatacgacgctagaaaaaagctaaggaattaattgtgtgtttcatcaaaagttcagatcataaaggctagtattagctaaagccgacgagtcagaagccactactaatattacatcatattatatccgctgcatgcaggaggctgctagaatgagccaggccagctgatgggattccatattcttaattttctgtaattttagcaactgcgacatgatcgacacgtcactaattatatttaactacttaaccaaaagcaggcatgataagacattcttcttttaactcgatcgggatatgtatgcatgcatggctggatcgattatcgctcggagatgcttacctcatatacatttatagcttgatcaatctcatctatccatggttatatatatatatatatatatatatatatatatatatatatatata

SEQ ID NO: 64885 - DNA, 3797 bp, Oryza sativa
cttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccctctatagctgttcttggtctttcaggtttggatataatagtcctcacaggtgatgcagaaacccagctatcttcttgttgagatctcaattaattcttcatcaaatgatatttccttccctctcagaaagtccattgttggttacaaggcaagtgtgtggaaggcttggaaaactaggcatcaatgttttacctgcccgtgcagtgtttgagttagctcgtaacaataaagaagttcacttaaacatcaatgggatttcagatctctttccaggtcaatctttatgttccaagtgatgccatacttcatgcctcacctgtcgctccaaacgaagtaattaattgcaagaagttcttgtttgacagtggcaaacaccactgctactacactaccaacaatgccgctttaagatttatgcaatttagttatttttgttaagcacagaagcaccacttttaccattttgctcgctctatttgttagtgcagaggacaacagtgatatagtgagaagactcagaaattttggatgtcgttgtgcaatggttgggcatgaatttcttgatcatgattccataggtgaaagtcatattggaatatcagtagctgatgccactgattacaccaaaagtgagtccgatcttgttttgactcagcctgccctgatacctatttcttcagccgtgcaaatcagtagggaaatttgtcagatgatgaagggctatatggtaagtcaattttgatgcagttcaagagtttttgttgctggcaaggcatttgacgtgtagatgacaaaatgggtagtcagttgagatgcgttgcttttgttgcagatctacactgtctcatcaactgtccatcttgtgagtacaaacagtgattatgttttgaaaactacagcattatgcaatgctaacattaataattatatttattgaagttcggtgtccatgccattttacttttatggaacttcgacttaccaagtttcttgactctggtgattgctgcttttaattactgtgagtttcagctacaaaaggccaaccttactctacaatatatattgtttgtgcccttgtttcttttcatgattagtaagtattacttgttgcttttatctgatttcacgggatacactgagagttaagaaaatcattgctagcggtgctgcttttggtagctacattgttctgagtacagccatttttttcagggctgcaacaatgacaggcttcttttcagtaagcaccttttcttcttattaaaggagattattttggtctggaaaattgaatgagctgattatttaggctgtggacagtgcaaaattgaacataaatcactgatggacaccgatgaggaaattagagctgctttgttccttcagatgagcattgtgaatcaggctgttgcactgtttgcttattcagatgattgctgccatatcagatgtcctggacctgttgtaacatttgcctttatttttacccagatggtgagatcgttaacttttctctttctgtttttgccgagtccatccttcgtttgctgcttgttgatttcacggaacttctacctactggtcagaaccataatttagcaattggccactttgtttgtggctaggattctagaaataattgcctaactgttattttaccagcatcgtctaat

SEQ ID NO: 64886 - DNA, 2192 bp, Oryza sativa
gccatcgcatgcttcctttgcttctcatttactactccatgtggggggggtctagctactcctcacaagatagctagcgtgatgtgtctagtgagactactaccttaattaatttgcatatcaaattttggataagggattatctacataatgccaaaaacaccattcattagcgaagaaaataaaggaagtactgaacacttatttctactctactccgtatcggcgatattttgtctccgctgtacctagagtgtggtgtgtttagttcacgccaaaattaaaaatttgattgaaattgtaacgatgtgacgaaaatattgaaagtttgtgtgtgtaagtaagttttgatgtgatggaaaagttggaaaaagttttattgaaattagaacgatgtgacaaaaaaattgaaagtttatgtgtataagaaagttttgatgtgatagaaaagttagaagtttgaagaaaatgttgggaactaaaccaggccctattactgcaccggttggcttacgtggaattcaattgcaagtttgagcatgtatatagcccctagctgaccaatcctagctagtctttgcgggagtgattgacaagaacaacgcataattaatcaatcgttaaataaccagtactaatactaaccagggttaccagacttggctaatgcttgtcttgtaagctggaatccccagccttaaacctgtatacagacatcttatgctttctcagtaaagctgggcggtagcttcttgatccaaaatactaacctgcagggcgtcgttttaacatattttaaagagataaataaatagagagaagagcaacgggctacagatgtatagacagctgcagcatggactataagacgtaatgtgcgtatgacaggtcagaccatatattaatagtatagtaagcaactattgtataaattggctattacattggctatagatgatttggagctggtagtgggctatattatcaaacttgccctaattattggtatacgactggagactaaaaataatacacatgaaatcgagtggagtacgatacgcatgcatgtgcgtatatagggtgtgtttagtttacactaaaattagaagtttggttgaaattgaaacgatgtgacgaaaaagttaaaagtttatgtgtgtagggaagttttgatgtgatagaaaagttggaagtttgtagaaaaagtttagaaataaacgagaccataactgggcaggaatgtatgaccgtgcgaaacagtgacaggtgcgtatgtagctgatccgatccgatcgagtgatgtagaaaagcatcagcgagcgaggtgcaaattaaagccatagagacatagctttgcttagacgaaacaccaaggtagtagctagctaagtatccatcacccgctacaactggtatccctccttaaggggttcgtaagaattccaaatcaaaggaatataaaaattaaatgattagaatgtcacactcatttcattcattacgatttttaatttctaagaggtctcacatcatgctaagaatcatatggaattaacctgtaacactataatctaatttattcctataaaacgaataatacatatattaaaaaattctaaggattcaattcctacgataattctatgaaaaattctctaaaccgaatgagcctaaaagtaaattaaattatactactatcagtcgtatttagcactgctataactatttagtggaggagtaattagttttactaacctggtggctctattaagaacaaataaagacgtaaaaggcgctgtttgggagcaagcgaattgaagcgaccgacagttgttggacatctgcccgtgtactactactgtgcacttagtacaacggtgaaaacggtgctccccacggggtaaaacggtgaaaagaaaagaagaaaagaaaaagctcttctggtttaattcctaactttttcttgtaagtaaaacggtgaaaaaaaagaaaaagctcttctggcctggtttagtttctaatttttttaaaaactgttaatttttatatcacatcaaaacttttctatacacataaactttcaacttttccgtcatatcgtttcaatttcaatcaaattttcaattttaacgtaaacaaacacaccctctgtttctctttttcatcgcgcgtatacgtatctacggtggtgc

SEQ ID NO: 64887 - DNA, 9705 bp, Oryza sativa
  unsure (1)..(9705): unsure at all n locations
tctctctctctctctctccatccacatctctgtctgtctccgctttaaagctgtcaccttttcccatctctctctctctctctctctctcccgtgctgctctcccttctcctctcctcaattaccacgccgcagccgcagccccccaaccctagctagtacggcgggcgacctgagggggtagctgcctacctctatacctgctatctccgttcgatccgggtcgggctcgtgctgctgggggcgggggcaatcaatcggcgagctcggtgatccatggccgtggctgtggggtggctgtgagggtgcccccggcggcgctcccctccgcgcctgccggcgagggggctcggactgaaggtcgccacactctaccgccccacccatgctccctccgcgcgcgatctaagctaggcctaatctagggttcctgattgcttttccattttcgcccggacggaccaaactactactgtctatctatctagcttcttctgctgcttctcgtgctgctcctgcatattttttaaaatttttatttcatctcatttccgggttactctcatttatcatctactccgtaccactattagccaaccaccccattttcccccctttttttcttgagatttttgtgggcgaattcgagtaacctttactccccccattctaggaagcggtttcttttagcatggctttgtttttttcttttcctctcccgctttcttagttaatcaactttaccatatctgttgcgtgcacttcaatccctgtcatttgtatccttcccctagattttgatgctcaaacgattgttttcaccaaatgctgagtcaaaagaactctccttttcttttttcccccagggatctaggcgagctgaaaattgaagtgcaggcaaggagataagagcagcgtccaaattgtgagtacttcattagcaggaggtagtggttgtgcttgcttggctcctttgcaatttggctttggcgaggtagcaatggctgcggcagtggcaatgcgagggagtagcagtgatggaggtggctatgataaggtttccgggatggactccggtaaatatgtgcgctacacgcctgagcaggtggaggcgcttgagcgggtgtacaccgattggcccaagccaacctcctcccgcaggcaacaactgctgcgtgagtgccccataactgctaacattgaccccaacagatcaaggtctggttccagaaaaaaaggtaataataatagaatcgaatctttctacggtagttttttggacaaaaacttgttatggcacgtttccctgaatgtttcatctgacaactgaaataacaatttcgtttagttccttttggggaggctatcggtcctaatatgnctgctttgctgtggcgatgataagcggaattttgatatgaggggagctgcaatgccaattgtttatcatttcatttgtttgcgcaccagcaaaatgtagtataattactttacctgacggctctgcatgtatatgattttttcgtttttcatgttcgctgaagtggatacttgtgcttgtgttgctctaggtgccgggataagcagcggaaggagtcttcacggcttcaggctgtcaacaggaaattgacggcaatgaacaagctacttatggaagagaatgagcgactccagaagcaggtctcccaattggttcatgagaatgcccacatgcgacagcagctgcagaatgtaagctcttgatgtgctggtgctgatgttgtcccccatgcataaacatgttctcactgaaatgctatctattctttgtgcattttgttatacgcatggcatgtccggggatgtgttgttctgtactgtatattgtagattagtataactttaaaatttgatgtatgtgtagctataccagctggggccatatgcgtcagttcctttagaattgatatatgaattaatcctcagaatgtccatgagatcgctagatttcactgataacaccacttgcttgggtgcagactccgctggcaaatgatacaagctgtgaatcaaatgtgactacccctcaaaccctttaagggatgcaagtaacccctctgggtaagtaaatagttctgagtgactcaggtagaattattgttggatggacttgctctttcgatatcatgctatcttaactgccttttatcttgttctaggctcctttcaattgcagaggagaccttgacagagttcctctcaaaggctactggtacagctattgattgggtccagatgcctgggatgaaggttccatgctagcactgtttgtttttttgttctgtgatttgtgctaagaggtttttacttgaagtgcttactacccttttgttttcatgatgtaagcctggtccggattcggttggtattgtggccatttcacatggttgccgtggtgttgctgcccgtgcctgtggtttggtgaacctagaaccaacaaaagtaagtgttgtagctatttgggtacatgggtttggtatttttatgttacctcagtattccctgtctgtatgttttctgaagcatctattttgggtgatagcaagcctatccaccagtcacttagttttctttgtgtgcaaatggttagaaacctactacctccatcccaaaatatagccaaaagttgctatatcaaaaatcctatcagaagtgcctcctgaacacattgctgccgagtgtggaattaagacacactgtaattcactttaataaatactaaactttgaagatgtcactttagaggtctaatgatttcatgtctgccaactgttatcatcaaatttaatcgtgaagataagcagatatcttgctttttttgttactttattcaggagattttgtgtctcatagaactttgttacgtaggtggtagagatattgaaagatcgtccatcttggttccgtgattgtcgaaacctggaagtctttcaatgattccagcaggaaatggaggaacggttgaacttgtctacacacaggtgaacactgtttcatttcacatggtataatggtatatcctcagtgttctctatcaatgcatgtggttcatgccatgaacattattacttgtttttgcttacagttgtatgctccaccacctttagttcctgcacgagatttttggacgttacggtacacaaccccaatggaagatggcagtcttgtggtatgtatgaacatgaacactgttttcaccccacaatgagtctcaatgtgatgttacccttgctaatattcctccatctccaaggtctgtgagagatctttaagtggttcagggggcggtccaagtgctgcctctgctcagcaatatgtgagagcggaaatgcttccaagtggatacctggttcgcccatgtgaaggtgggggatcaattgtgcacatagtggaccatctggatcttgaggtatttttcacacttttgtacagttgaaccatgttttttgtcctttgatgtaggaccatttttgtatcctgtcaaactaataatacaatttggtttaatctttcaggcatggagtgttcctgaggtgcttcggccactctatgaatcttcaagggtagtcgctcagaaaatgactactgcggtaagctgtcgtgaaatgatattcagctcaaatttcattgatgtgattacaagttcatcatttcaagtgaaacttgtttttaatgaactcttcaagtttcataacattggatttttttttagaaaaaataaaataaaaatccaatattatgaaacttgaagagttcaagctaatgataaagtttgtgttttggataaagcttataatattggatatgtggtgaaaatgatttatatgggttggtacaactaatgataaaatttgccttttggatatgttgaacagttcattttctgcaatctactttatactaaccttttattgtctatcctatatatcaaggcactccggcacatcagacaaattgctcaagaaacaagtggggaagtggtgtatgccttggggaggcaaccagcagtgctacggacttttagtcaaaggctgagcaggtgatttttttataaattattactcagcaattaatatttttttcacctgtttaatctaacaccaatattatgcttttcttagaggctttaacgatgccattagtggtttcaatgatgatgggtggtctataatgggcggagacggtgttgaagatgtagttattgcttgcaactcaactaagaaaattaggagtaacagcaatgctggcatcgcctttggagcccccggaggtattatatgtgctaaggcatcaatgttactgcaggtaagggtaatcattatcagctcattagggtgcagatgacccctctgtatgtagcgtcattttccaaggaagggaaaaaaaaacttttttagtgattcaacatatgcaagcacataaataaattgctcggctgtattaacatttgatagtgagatcctaatgagatttttgatgttttgcctggtcctacacctgatgataatttgtttgatttatttcattactttcttttttgcggagaaacttatttcataaaactgctgtcatcgctggtgtgaatataaaagcagtgtcacaaaagttttttcctcagagacattgaacacacagaatgagttctttggaactagatttccatgttcaaaacttgtagctgttaaatcatgttaatccatacgtcttcttttccttctttggtatttcagagtgttcctccagcagtactggttcgatttctgagggagcatagatctgaatgggccgattacaatattgatgcatatttggcttcaactctgaaaacaagtgcatgttcacttactgggttgcgacccatgagattttctgggagccaaatcatcattccacttgctcacacagttgagaatgaggaggtatattttcctgaatatggggaaagtctgttttttgtgcgcttgttgctgttgaactgatttgagtaatggttatagcaaactacttattttcattcttgctgatctgtttacattgtcatagtggatagtgactatctagttaattccattgtcggacatagttttgttattattgatttattttcattaacttgaaaaaaaaacgaacagattcttgaagttgttcgccttgagggtcaacctcttactcatgatgaagctcttctttcaagggatatccacctgcttcaggtaagacactaaatgccattgctatgttttttgtctgtatatgtactgtgttgcttctcaattgagaaaactagtagcttttaatacatgtaatttcttgcttaatatgttgatcattgtatctattcgtgagcatctttggctctatttcatcttatcaaattattgtagagttaaatatgctgtgtaacaactaccaacccataagcctatctttatccgggcatattaagtttgttgctacacccttttttcccccttcgaagtacagtcaaagatgcaaagctttttatgaggcttgtaaatattccagtttgctaatatacccttatcttttgcagctctgcactggaatagacgagaagtctgtgggatcctcctttcagcttgtgtttgcaccgattgatgatttcccagatgaaactccattgatttcttctggcttccgtgttataccacttgatatgaaaacagttaagtgctgccaaattccaaattacattatccattacccttttgactgttccctaggtccatatgtgctttatttgctgttgcattaatctgtgatgagtcgtgaatgtcttttagcttttctaggaacctcagttttattcatttgttcagtgagttaaccctggccaattttaactcttcataaacaattgttttggttgttctaagacaaataatctcttggaaatgtttcatttattctcccctctagtccgctttaaatgttccagctctgtccacagagaccccaaaaaaaagctattttgtaaactcccattaaattgagaaaaaaaactgttaaattggttatttgcatcttgattgtatcaccagttagaactaatagaggcatttggtttcaaatattcccttggaaaaataaagcaagtatgtatgaaccaagcttgctaaaatgtttatcctttttgaaccagaggtagtactatatttttggtcggctgccactaaatttttaggctctgtgcccaaaagtttaaccgtcacatttcatgcaggatggtgcatcctctggtaggacattagatttggcatctagtcttgaagtaggttcagcaacagctcaagcctccggagatgcatctgcagatgattgtaacttgcgatctgttctgacgatcgcttttcaattcccttacgagttgcatctccaagacagtgttgcagctatggctcgccaatatgtccgtagcattgtttctgctgtgcaaagagtgtcaatggctatctctccctctcaaactggtctaaatgccggacagaggataatctctggtttccctgaagcagcaacccttgctcgatgggtttgccagagctaccagtaagtgtactcgtagtttcttcctgtgcagtagtgatgatatttaataagaataaatttgatagttttccatgttggttgcaagctgacaaaatattattatgccgtcgctcagttaccatctaggggtagagttacttagtcaatcagatggagatgcagaacaattgttgaagatgctatggcattaccaagatgctattttgtgctgctcattcaaggtatctgatgaattcaactcgatcaatgttccatcatttgatctaatctcatttagtctattaagtactattacagaccactcgatcaatgtttacccatgtattacagaccactcgatcaatgtttacccatgtactctaaaacttatcgcttgtccagctgacctacaatcttttcatgcatttttcaatctaacaaaaactggctctgttaataataacctaatagttagaaagaactggctctgttaataatgacctagtaatagttagtacttagtacagacctaacgagtgcttagaccctcaaacgtgttttcaacagggtgattttgctatatttttccctttgagtaaatgctctcaattttttgtaaggtttacacttttgacactaatgcgatcatcggaccacaatatttgctatcttgtatgacagaaatgttttggtttctttcaggaaaaaccggtgtttacatttgccaacaaagcaggactggacatgctagaaacttcccttgtcgccttacaggacctcacattggacaggatctttgatgagcctggaaaagaagcattgttctcaaacattcccaaattgatggagcaggtagaaactccttttcgcttaactcacacccttaagtgcatcatatttcagaaatcgctgagttgaaataaattaaaattatgttacattgcttaccatttttttccctgttttgtgtttagggccatgtctacctgccatcaggcgtgtgcatgtcaggaatgggtcggcatgtttctttcgatcaggccgtggcttggaaagtgcttgccgaggatagcaatgttcactgcctggccttctgtttcgtcaactggtcctttgtgtgaccatcccacatccactgcgaagtgaagattcatttttgcttgttcaagactgttttgcactagatctagacctgagaatctagtagtatttgcgaaatttctcgcttatgtaaatgtaatctcgctcccattccatcaagtacccaagtacaaggcagtggccaagtggttttagttgtagggggatcggagcaatcctgacggttgggtacttgggttccttccagcaatgtaaaatcggatcctgtagggcgtcgaaaactgcattggcaagattcttcgaaatgcagaccaaatttagctagtacatcgtaactttggcattagccatttggctattgggtttttcgcttaggtgagatgcagcagatcatcaactgctaccacttctcatagtgataattaaaatgcaaagatgcccccccccccctccccccctgttcagtcactaacgagatgaaacttgtgcacgagtacgagactgaactagactggccgatacattcagcgacaggatttctgattctgaaacgaagggcttgattggtttgataccaatttattaccctaccaaatttttagtaacttcaatagtagcaagtgtatgtttggtgtgctaccaaatattacccacaatagtccaattgaatgctacctaatttggtagtgccaaaatttgccaatgttttggtactacctgttttggcactaccaaaattttggtagtgcaaaaattagctccaatccaaacaaacccgaactatcagggtaacaaacaaggcaggataaaaggcttgggctagctaaaaggccacaatcattcagttagccttgatcatgagtaaaattcctgtgcagtacttaaacttgagagaagatattacttaggtccgtacacatgaaaattacacgtctagatccatcatcttaattcaatgaatcaagccagttcaaaccacgtttgaccagggatgaccaccgtcgtggcgctccacttaggcataacttttgtacttatcgcctccacacctcagcgtggcggtaatttagcaattagcccctcattgctaccgtatcatcccaaaagcacatagtcccctcgtccctcctatcccccctaatacgacgcttccaatgcaaggtgatttgggcatcgattcgagctccgtaagtagtggcgcccgataggcatcacggtacgcaaatccatcgccggtatgtatccacatttcgcccctaccgccgctaccgtctcccgccgctatgtatccacattttgcccctaccgccactaaatcgccgtctcccaccgccttcatatgctgctcccacagttgcaaccctagccatcgggtgaaatgtaaggggccgaatgcaaaagtgatgcctacatacgtcggtggtcatctccagttaaacgaggtttggactggcttggttcattaaaccaagataactgatcttagatgtgcaattttaagtttacggatctaaattgacacccccttgcactcaaccaagataaaccaagtttgaaggatcggccattcttgatcaatcagctagcagtacacaacatcacatgacagattagcagtaataaatgtaatggcgactgacaagcagtatgatgcaaagagattaccacacgaacacacagaattagcaaggcaatctgaatggtctcatatttataaccaagaaaatatgatatccggtggttcttcgaatctttgaggtattacaaaactgcaatcaaaacataaaatggcttgtgtttgtccgcgagtgattacaaggaggaggcgaagcgatcacctaggcgcggtcgcggcggccgtaggggaggcggccggccccatactgctgcggggcggaggtggaggcttcggctggcccacgaccccggggaggtcggccatgccaagggaggtgagcatgtcaagggtctccttgtcaacgcggatgtcatcaacctcgaccgccaacttgtccgg

SEQ ID NO: 64888 - DNA, 40761 bp, Oryza sativa
gaagtagatccatcaaacggaagaccttttcacttgctccaacagactgcatcagagaggaccagttgtctccaatccaccatgttgacaaaattagccactcagcatagagtatgaattttgtcagttgctcagcagttagcttcccagccatgatggatatccctccaatcaacactgcaatgacctacacaaagcttatttgcaagaatacatcatcaacggtacaacaaattcatatcagaaccaggcattttatattttacaaaattgctaatttaaatatgttctgattggagtatcattatgaattgaacagaaacatcaaactacctgagtagaatggtatagatagttcaaactcaagctccagcctccataagccattgtttgccgaaagcttacatcatatagcttatctagccactttgcatatctatcagagtacaaggcatcgtgagattttgtttttgtgtgtatgtatgagcgtgtttgagatagagagagagagagagggaggtagagattgccttttaaactcctgcttttctgttccataaacccgtactgtccgaaccaaacttatcacctcttgagcaacctgatttagtttaatgtgaaaactgagatgaaaactttgccttatgaaatgctaccttcatccaaaaatataagggatttttcccatgggacagaggaagtagcttattgtaaagagtacaaacttacattgttggcacttgcagtgaactcctgtgcaaatttggctgctcttttctgatacctattaatcacagtatcataatgatttctctcgcatggatcacaggtgttaagcaacaaaataaaaacgtggtggtgcttccttgaactttcactactcaggtaatgtaatatgaaagacagctaacacagaaaagggagagacaatatacaaggtaaataagagtaggtttttaccgtccatgaactagcataatggtcgacaatgtcgcacaaatcaacatagtgcacattccaagtggccaagataagactagcagataaattagtgcgcctacaccctgaaataaagtgacaaaatggtacgtgagtttttgaagctactggttacattttcatacaagactactaaacaaccttttcacctgaagcaaattgcgtgagataagattaagatcattgccaatgactcgtgacacttgctggcagtcagaaccaagcctacttgtcaaatcaccaacagtttcttcatcaaaaaaagcaatgtcctagcataatttaaaatacagttaaaagcttcatacttgggtcaaccaaagtaaaacaacagaaaactttatgtacattaatgaaatttctttcagcagtaatattttttattccttttgttttacctgagaaagaatagaatcaaacagcatttctctcattcgtttgacctacggaaaattttcagatgatgaaggttagagactggtcaaacaaaggggcaatcgtgaggaataaacttggaaagttacattaagaaatctaacatggttttaccaatatcatgtttgcaacaccaaaacagcagcttcgcacaccactgcaaaattggataccagctagtaagcaaccacaattgatttttcacaaaaaaaaaaaaaaacatgcagaagacaaacaattttggtttcaatgcagattacggagtatcttgctaaatgcctatagtgcatttgacaggacactggtaaatgtagaaatttgtatttatgctaccctatagtgccatgagctaccaaatcgattcatcagcataatagaagattttcaatattcagacccattgaagctcaaagcatttccattcctgccctagatttggactaccaacacattatatgatattacattgtcaaccacaccatccatggaagtgatcttatggacctaaacgtctaacgaccttttcagttttcaccacaacaacaatgtgatcaggtacagttgtattgtggacagaaatacagaatgcatgcttgaaaatgcaggattaccaacttctttggtttttccgatgaatgcagcatcacctacttgttggcttctctaatgatcgcgttcacgacttaagcacagttttaacaaagcaaagaagcaataactgacctaaacactccggaaatcaaacacagaacaaccagaagcttagcgttccggtagaacacagcccctccgttctgcgccgagaagatggacgctgcgaggagatggggtatcgcgatctccgcgagctgcaaccacaaccacacgtcaccgcgttttagacccatcaacgagaactctgcagcagcagaggtcaaacccagaaatcgccattaccgcagcgccgacgagggacgcgaatccgacgaagacaacccatcggtcggaggcgacgagcgcccacatccgcctgagcgcggaggcggccgtggcgccgctggcctcggcgcggccgcccccggcctcctcgccgtcctcgaggcgccaccagcttcccccgggcagcacgttccgcagccgctcgatgaactccccggcgagggcgcgccgctgggccagcccgccgaactctcccccgatcgccgccgcggcgcggatcctcgtcggcctcgcccgccccggggccctcctcgtggccgacgccgaccgcagaagcagcgacggcgccctgggccccaccgacgccacgcccaccgacagcgccgccgagccggtggccgcggtgaggagcagcgccgccggagtcggcattctccactctcgtcaaaccccctctatccctcccctccacccccaccgcccgattcagattccgattccgcgttcgccggtgagagagtccgccgcctcggcgagcaccggcgaggtttaaataggcgtaggccgctgcgtcctcgccggagttggttgctctgccgtgcgcggcaccggcgccgtaacgtctctaccttctccggctaaattgtattttttccgcggcttttttaatcctttttctcttccacttttcgcgtgtgcttcttttttttttctttttcctaacgtgttttttttttgcgattttttctacgagaagaaatggatggaatgaggcgatgtggtgtggtggtggtattttgggggatttaaaacaattttctggaggagaataatcgtcgttggattttaggattggacacggagaaggattgaaagaacggcttcgtgcgtggtcgtggcattggaacatgaggtcggtgacacactgacacgggatgttagagaacaggtggtggtgccgtggtggtaggccctatatagactccatcgtttgtcatggagttgaggtagtgtttgtaaagtgctcccggttttaagctttaaagtagtgctactgttgttgtaaaaggtcaactaaccacttataaacgttgcagtatgggttagtataaaatattatctcgatcacaaaatatgaaaatataaccacatttaaatagattggatctatcgtactatgaatctagataggggatttgtatgattcacccgttcaaaggttgctatattttgaacgaacgaagaagtaatttaacatagagcatgatgatatatgtcacaccacaaacatttcagttcaaattttatcttcacgaggaaaaacaagttctaaagaaaagctggaattgaatgagcatgggggcatggtacgatgcatgggattcgatcttcgtcaagagcattttcttacaacatattccattcgtttcaatttgatcgtcacccataatagccctactcctattgatcagccaatatataagcgtggaactcgagcatagtggttgaggttagctgttgtaagctacgagattagaggtagcttgtattgtgttatctctgtttcttattggtggttccccactcttctcttgggccttgtatttctacactcaggtgccatcttatccaagtagaagtgtagaactaggatgcaaggatggatacgatccgagtggtcttggtcgggtcaaagtacgattgtattttttttctttatcggggactcctttattttctactacggactctaatataacatacttgtttccgtatatataggacttggaacatggtgctcccaccgaggtatgtacacgtatgtagaatatcctatatttaagaacagtaaaaaatattatgttgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcaactagctctcggtgacttggctcctcgtaagctccggcttcgtaggctgtggagattgtgttggctctgagattcaatgcctaaaccctccccggggggccccttttatatcgcagatctggaggtctccacatagaactcggagatatcagaccctatacgatacgccaacgacccagttctgcctaagtaggattcttcccatctgtagattccgtaaaaggtttccttagaatatacaggaaatatctgcatgcgcgtgggtatgccatatcgatatgtaacgtatatcgaagggtaaagggtatgcctaacccgtaaccttgacagtagcccccgacttctgcttaaaatgaactcgtgcaaccatttgcgacttcgggtgtcgagactattgtcattcccggtgcgaggaccgcggagatagaccgtagtcgagcacgccatttgaagcccaacggtcacgagcgaattttaaactgaagtccaaaaaactgccgcgcgtaacgggaccagaaatttccggcgggcatctctctctgttccctggaattcgcaccgtcggtagtgcgcctatttaaaggaattttgggaatccattttgaagtccgccaaatctgttaaacacacaccacctgcaagcactctttgccttctccgccgccgcaagaaaccctagttcatcaacctaggctcgttttccggcgaccttcgatcagcaacggacctcggcaaatcggcttccaccagtgcaacgttgaagaaactccaggaggatggcgctcttcctggccgtggaaccatggagagtgaagcaggaggtactaatcctcagcccatcttgggtcgcatggttgcgatcgaagattatgttctctgcggttttctccctcctccttccgaatttcttctcctggttttgaatttctatggtctttctcttctccatttgaaccccaattccatcgccttccttagcatctttgtgcatctttgcgaggcgtacatcggggtagagcctttccttgatctttttcgcttttactacgaactgcgttggatggaatccaacagggtatctggttgcgtcgggttccgacttcgggatggcctgaagtcgcgttacattcccttccagtgcccttcttctcgcagcaagtggaggaataggtggttttatcttgagatcaaggactcgaaccctgtcttcgtggttcccggagatcaaccggacaagattccgtcttggaccgccaagccccccttgaccccctctcttcagtcgtttattgacatcatcgacgatctccgagtacgggggtttttcgggatatgaagtcgttgcagacttcgttggtaggtggatccagccgcttcaggctcgggcccatccagcttataactattccgggccaaaggacgtgacccgagtttctcctcggggtatctttctcgcattcatcttgacatacttgtgttcgcattcctcttgacttatcgtaggatggttctcgattaacaggtctgagcggcgaaaccgtggagcgtcgcgtcggccaagtgatgatcagcgacccgaccacggcgagtgacatccctgtgcccctttgtgaaaagggggcagcagaacgtgatgaagccatcaacgtaagtatattcgatgaatatcccgcattctcctttcgaaatcactttatgacttgattgagcgtaggcccttcctttgactgatatcatcggaccgctcacggaccatcaggtggcgtcatctctgaaagtgaaggtcgtcaaggaggtatctgatgctgccaccactagcggtggcaatgttccaacaaagccgaggaaattctcgtctgtaagcggacaatgtcgcaaggtgtcgaccccctcggtaatttattttgttgttaaatcatgcagcaagaaggatttttccttactttgcgttgattgtattccaggcctcagatgcgtctcccccacctccacgacgacaacgcattgtgacgatcggcgagaagtaagtagatgaattcttgaatccccgcgcttcttatttgattgttgtctgactcgtggtcgtcctgtagggaggcgcgggcaaaggctgcgcaagccaagtccggaggagcttccagtgcgtcgcccgtcgtggcctcgacggatgtcgtgcccgcagccgggagccgggaggcgacgcctagtggccccgtcagcgaccccgcggcaggtcgtgatctaccagttgcagtcctcacctgggaggagctccaagtcgagatggggcgcctcctcgaagccggtgctcgcagcatcggccgcgaaattgcggaggcgaggtcggaagcggcgacggtgaacgtgcgtgctgacagactggtgcgcgagttggctgaagcccgtgaagacctcacgaagatgagggagttggcggctggcaacgagcgacaacggaaggggcttgaggaccgaatgtcggaactcgggaacaacctatctgagatctggggctcgttgagggtcacctacaccggccttcaccagctcgctggggaatgcggcgtcacgtccacgatcccggcgaatcccgatgagttttcgctgacctcctctctcgcggaactggcgacggcaatgggggaaatcccctccaagcatgcggccaggattgcggaggagacgtcaaacggaatctacaccggggcgtgtcatgtcctcgcgtgtgtaaggctgtcgcgtcctgaactcgatctgcgcgagatcttggaccagggggcggccagcgacacgcgtaaggaggtgatggaagaagtcggtgatctgggggagtctgttctccccctttttgaagagtaggacttcttgtatttcctagataatgtgtaaaactcgaactctgaccgcctttgtgagtgcgattactatcccggcttactttggtatgctgacctcgggaacttttgtcctcttgtagagatattgatgacgaggatgtccagcagcgcgggcagcccgagtcactggcagtaattccggtactcgagtttgaaccacacgtctcgcctgaccatgtggatcaaccccttgatatagagggaaggatggcgacgacttcctcaggttagtagtcccttcaccccttaatgcccatctgactaggtcagccatgttcccgaaagagatgtacagctcgacttagtgattatcacgtttagcagatctcgagggtgcccttgctagccaagatcgtcgtatccaatactggaagcgaagtttgaagtggcggagctcgagagaaccatgctggccgtgaagaaagagcaggctgtggaaacgctccgaggccgtgaggtatggtttaactcgtacttgaagagttgctgcacatccatggccagagtatgcagggagcttcgagtagtccgcggagatcccgatgagtcggcggccaggtacatctcgtggcttaatggggcctgtgcccaactcgatggaatcggtaagcgtatcgacgaggccttgaagcaggagtgtcgtcgatcgagccgatatgccggggggcatgtgttggcttgcctacgagatcatcgcccgcacctggacctcgaacatcttcgtgagggttttgctcgttctcggagggctccggcggagatagaccatctggcaaggtcaatgtcgttctcccatcttagcgacgaatctgcttagtgctgccatgcatccggttagcttttgtacctccttgagtcttgtaggcgacttcatgttctcgattgccttgatcttctcggggtttgcttctatccctctgccagagacaaggaatctgagcagcttgcccgacggtactccgaacatgcacttctcaggattgagcatgaggcgatatcgtcggaggttgtcgaacgtttcccgcatatcgtcaatcaatgagttgcctgtcttggttttgacaacgatgtcgtcgacgtaagcctcgacattgttgccaagctggttgctaagtgcgccctggaccgtgcgctggaaagtattcccagctgttatcagtccgaacggcatcttaacatagcaaaataccccaaatggcgtgatgaatgctgtcttctcttcgtcctcttttgccatgctgatttggtggtagccagagtaagcgtcgatgaagctcaataactcgcaaccggctgttgaatccaccagttggtctattcgaggaagtggaaagtgatccttggggcacgccttgttgaggtcggtgaagtcgacactcattctccattttccgttggccttccgcaccatgactggattggctagccactctggatgaagtacttctctgatgaagccagctttgagaagtttgtcgagctcttctcgtatggcttgttttcggtctggtgcaaatctccgcagtctttgctttactggcttggcatcgggtcgcaccatgagtttgggctcaatcacctccctggggacccccggcatgtcggacggccgccaagcgaacacgtcggcattgtcgcggaggaaggtgatgagtgcgagttcctatttctcgtttagtgtcgccctgatcttgacggtcttatcggggttggcactggagagtggaacaatcttgatggcgccgtctggtttcggcgtcttgtttgtcttggtcactttcttgggtggctcagtcgtggcgggtggactgggcgtttgctcgaccatgtcgaggctccgcttgtcacattgcaccgccagctttgcgttcccctgaatagtgattgttcccttcggtcccggcatcttaagcacttgatatgcataatgagatgcggccatgaacttcgcaagtgtagttctcccgatgatggtgttgtaagctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttcgttcgtctcgacaacgcgtactcgcttgcctttttcaaatgccatgtgcttctcgagcgactttttgaaaacaaggcaatcttccagagaatgtctgtccgtcttgtgtatggggcaccatgatttcgttgtgtcactgctttgtgggtctgggcgtttgggagggttcgcgtattctgctgcgaggacttccgcttgagctttccttttcccgtttttgcgatttttcttcttgcttgactcagatgtgtccatggctggtttcttctctcccccggtcttcggcctatcgttcttgcgtcttagcgcatcatcagcgtgggcgcatcgctcaacgatctcgaataatctccgagtggttgtgatgcgtcttgtcgccaactcctgggtagtgtagcgatctctgacaccggatttgaaggcgcgaattacagaagcatcgatgatttcaggaattgtgtttctgcactcgttgaaacatcgaacgtattccctcaatgattcactctagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacatggtcggtaaatagtttgctaacgcgttgtcgtctgcttcggcagcatagagtactgtggagtagacttgaagaaactcctctgggtcggtgctcccatcatacttttctattgctccgggtcagaatctctcaggccatcggacatcacgtaaggaacgaccgaaagccctacacccagcgttgggggcggtgggttgccggcggtcgtgtgtccttcgtggatgtctgtctgacgatgaggaggaggcggatgatgacgatgacgatgggtcgcttggttccggtgtacgattacgaggatgacggcctggatctcgacaatcctgtcgtcgtcttccgctgttgtctcggcgccgatctccatcgtcgtcgtcgatacggcggcgaccatgaccagtattgtctggcacccgtcgttcgcgatcgttgtgatcgtggtggttgtcgtggtcccggtcctcgtttgagcgatttcctcgatttccgttatcatggcgccgtgaagagacatgacgccgagagcgattcacgttgtctcgtgtgcgtcgtgcttcccggcggccgttgatttgatctcgaagatcgccagtgccgcgaggtggaggggtagcttgttgaggtgattccctccgttccggatcttcaccattggcctctccagttggtggctgctcctggtgtgctgcggtagcggcttcttcaaacgcgttgctgaggttagtcaccgattctcgtagacgttctgtccaacgctcgaggtcaacgttcagaacgggatcgtaaggagtttccctcagtatcgcttgaacggccctgatgtgctgggctggagtagtcgattgattccccgcttctgtgttggcgtgcgctgacgtgccaacgtcatcgatagccaatacctcccgcggcgcgctcgttgtcgatgacccatagtcctcaaggagatgtaagaccgatggttcgtgaggatcgatatcgattaccccaacgaatcaatctgaagttggagtcgctccttgttccttgccgttatccctgatggggatatatgacttaggagactgagctttcatggcgccgagaaagactttgcagctcgagaggacatgattctttgtcttgtgaataggacaatagacatcccgagttggagaagtacgctgaattccacgttctttgcaggcgcgaatttcagcacggacgttgaggaaaacccagcaatcttgcagggtgtgtttcttggttttgtggataggacaccaagaccttgtggcttcgtaagtcatctttgtcggctcgtggttcatgtcggaaggacaaggtttggccgtatcagaatccttcttgagcttggatgtcatcgatattccgttctccgtctcgacgggaggatttttcgacatggaatcgccttggttcgtagccactgcgttctcgtctccggtcattggaggaccggttgagatcggtgtcgtggtgtaaaccgggaagacgatttcgccgacttgagtccataccagcattgttgaagcagggagtacttggctgaggctggtgctgacgttgttgtcgacgaagctggatgacatagtagtagaaccttgagtaccaaggacccctacctggcgctccactgtcgacgggtgatacccgtagaccggatataaagggtattggggtacgttggtacaaggatctacgtagtacgacatcaagcaaacaaaagacaagaattatactggttcaagagacaagaattatccagttgatgtgggattatatggtagaaaacacaggttacaaagagaacaagggaacttgtcggatccggcgagattgtagtcgagttgattcgactagctctcggtgacttggctcctcataagctccggcttcgtaggctgtggaggtggtgttggctctgagattcgatgcctaaaccctcccggggggggcccttttatatcgcagatctggaggtctccacatagaactcggagatatcagacccagttctgcccgagtaggattcttcccatctgtagattccgtgaaaggttttcttagaatatacaggaaatatccgaatgcgcgtgggtatgccatatcgatatgtaacgtatatcgaagggtaaagggtatgcctaacccgtaaccctgacatattatttaaaagatattttacatgtatgatttacaaagtggatcatatataatagacttactaccgtaaacgtgtggatagccaaatgggtcgcccgactcggcccgagcacaaccaggccgaggctgagttcagtcaagtcggcacgacctgacctacacaccaggacgggccatgcccgtccaagtgttgcaccaacagcccatgaacgactagaaggcacgaaagcccaccatgctcctccttggaaaaagtctattttgtctccctgatctctttgggccaactctcatatggctcaaaataagtatattttgaatccctcatctctttgagccgtgtcgagccagcccatcgcgccgaggcagaggcccaagcacgacccaaaggtctggtcgggccaacaagggcctgactgcttgggccaggcccaaacccatgccattggccgagccgtcgggcctagggcgttttggtcaactatacttctttccacccgatgtactttgattttttttatttttaatatatttttgaaaataaactatttgaaaacttattttcagctctgaacctttttagcttgccattttaactgacatggtaggacaacgttttggcactttcaacagtggcgtatggtaatggcagtgaagggagaaaataaatcgcggatggcaatggccaaaagatttatttttaaaagtaagattttcatagggtttgttttaaaatttttagttaataatggttagaaaaaagatcgagctacttagccaagcctcataaattctgctctgttttctccctttagtgaatatactagtagcagctagcagagctcctgtttgtcttatgaaaaagaaaaaagaacagagaaacatccgcaaatgtaacatggcaagtttcggtgtgaaacgagttcaataggttaataaaaggaccaattggataaatttgacataagaacggttatggtcgtatactaaaccaagtgctagcccgttaattaatttggtcaaacgcatgcgtgtaagtactatgggaagatgctctctcaaaaaaaaagtacaacgagaagataagtttggtgataagccagctcaatgcatgcatacgaactttgatgccgaaaaaaaccttatcaaattgtcaaaattttggtatagtgactggcaggatttcttatatagtcacttttttgacaactttaccaaaatttgataaggttgaaaatggcatcaaagttaacaggcccgaaaattcccattagtggctctttactgaaccagtgtttttctaatgttgacttcttttcctcgactcaaaacgataacttcctcatttcttattactacatattctcgaactgctaaaatatacatcttatataaaaatcgttgtacataaaattttttaataaataaataaataatatttctaatatataatatttaatatgtaaacaatcatgcgctaatgatatgttccgtttgggagccacaaatagctctagccaaactacattcgaattaggactaacaaactttatatagcgaggttcacataggtcgactcaatctgtacgaatacaaacaggagctcatgcattcctacagaagagtgtcctagtctcttctctgatctctcttgtacatctgatcctctacatttttttaaaaaaaaaaagcagtgtaacttccggctcgaaaggagctccctagccgttgttgccgctgccttcccaaacatcttctccgccgatgccgctaatgttgttgtcaagctacggtggcggtggcggtggctctctctctctctctctctctctctctctctctctctctctctgccgcccaacaacatcacgaagcagataaggtcaaaactcggccatcaaaatacaaattggattggactacgttggcttcgctgccatgtccaacattacttgtcatggttgcctaaagccctcatcactaggtgtgatgcaaaattgattcaatctggtcgtgcttgccatggccgttggaggatggttgttggctttgtttaaaactgagcatttgatgcttccttcctccatgtttcaaatagaaagtgtttcttccattcacctgatagaggcaaataaaggaggccaaagctccatcctgatggctacactttgatactatttggtctttgtcgttggtgaccatatgaggatgcatgctactcaggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgtaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattcagcaatgtcagctcttgtttgtcatctcattgttgaaggtgtcgtttgaagtgttggataaaaatccagccctaaatcgatcccgccaccttcatttcactcaggtgtctcatttaccaccaagctagcattgtttttgtgttccaaacccagttacgtacaacttccagggtgtagttacaatgtaattgcttcgcaaaaaaaaaagttacaatgtaactggggtgtagctagacatttttttgccttaaaatctgttgacagcgctataggtagacccttggtaatgtgtgttgagttgctccaagataatatatgtctgtcttcgccttccccccccccccccccccccattcccattacccaaaaaaagttgtatctcctagcttctcaccaactaaaatgcagatatcataatttgaatatggtagatggagttatattttcacgactttatcatcgcaccagtgatgttttccccttccgattgtccactcgatgcatatgccatgataagatccgctttccactttttctctgggggatgaataaaccttccatatatgtcccaatgtaaggtatagctatagctagaaaccatgcgcacgaacgaaattaagaaacgaacgcacaagaggacagggcaccaatagtacgtaccacaccactaccaatcattacaaaaacatatcataatgtaggaaaagctacaaaatatatacactaattaatagcatctataatgttgtccctgtagatatctgcattatgttcgcgcaacagcgcaccacgggatccagaaagaaattcgccgaaacaggcacatcattgccttatccttcacgaacacaacacacacctaagcctctagatagctatatccgtctatcgctctacctatcctgtccccttctttccttcctcccataaaaaaacaaggaaacaaacaaaaaaccaaaagggaaaaaagtggaaaaaagagaaaggcagaaggtccatcaacatctggtcgctcgatggggtgatcgatcaagcgcacacagttccaatcatgcatgtgactaatgtctacgcgacgaggctctgcagtgcgcgcgggcagaagctaaggttaaaccctgtttggtagagctacaactcctaaattttgcttcaggagttgagtctggagtgaagttatagagctatctaaacccaactccacatctctaatttattttgtgagagaactccacccagctccgatcacattttaagtggagcttaaactgtttggctgagctctaactccaggagagatggagctagagctgtgccaaacaaacccttaatattatgagaagttagtatagttaagaatttggagaagctgacaaaccaagcttccagtttttgtgtcaatttctagattctactgctgtagttttttagaatccggataaaaatttaaaatctgaactgtttaaaaaaaatttcagtagctagagattctacgagaaattacggctgacagaagctcccaatcaaacccgagataagatgagaagatgcggggttacgtggcgttgtgagagagagagagagcctcgaagcggggccaactagtttatcataaaaccgagcgtgccatatcgccttgtttccacaagcccttagcacatggcgcgctctcgtcgctccagcctggcagagtgaggcgaagacaagagatcagaattcagaagcagctagctctccaccaaacaggctactcttttactttagcttggttaatttcgtccagatcaagaatcttgctaggtggagagatgcaccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaacgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtttcttcagatgctaaccgccatctggctcatggaggcggcggcggcggcctcctggcgagaacgccgcacgccgtgcggggacttgcccttgcagccgccgccgtcagccttgcctgccgccgccgccgctgcggcttcggcactgtcatcgccgccggtgccgtcctcggcgccggcggcctttgtattggacgagacgccgggtttctccggcgagccatgcttatgcttacctaccgcccccgacgagttgccttgctcctgcgccgcgcgcctcaccttcacaccacgtatcagctgctaataattaagagataaattaagattacggttaataattaattagctgctgcttgcagaaattaacagaagtactccataaacaaagatactgccaaactggtcatccgaattaaagacaaacagtggcatgcagcaactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgtgcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaacatagaacacgatgaatgcatgctcctatttgactcccagattccaatgatatgttcgtatgacccacttgcccaattgggaaagggaccatcccatagtcatttactatttctggttcagaggtttctatcccctcccaattaacaaagaagcaagtggacttaaacaagcttaataagcaatcccaaatcatgcttgatgcttcgatcgaatgttgattactcaccggtaccgcatgttccacacctgagacgtcccgatgtcttccatggggatggagacaccatccctcgtcttcagctccggcaggtgaacctctgcttccttctgaaaccatccacagatcaagaaaggggagactttttagttctaccatgatcggaaatgtgaagagaaggttcaggcaaattccgtctttgattaggggagaaacatcaagtatgtgagtgtgtgcaagtgggatccttccatggaatggatttgtgccaagtggggtagtggatttggaaggagaaggtgttcgagatggtggtgactgtctcactttggggagcacgatgcggccgaggctcccgacgtcgctctgcttcagcaccttctgcagcaggaaccgcaggttcttgtccgtcttcgcctgcagcaatccaatcgatgccgtttaattagctaggttgataaatattggagattctatccctggacagcgatgtgagtgagtgagttttgagtgtgtggagtgtgtgtgaggaggagaatcgagttctcactcgcgtgagatcctagctatggtggatagcgattgatgtcaatcgtctgcatgcatgcacacctgccgcttctctgaagccgtcgagcgctgaaggctctccgctccggccgtcgccgccgcctgcggcttcggcttcggtttctccggcgagggtttcggctgcttcgacgtggcgggaggaggattgggcttgtttgataggggattctggatgatctgggccgccggcggccagatgccccagctccggcagccggccgacgacggggtgaccggcgccgagtgcgcggcgcgaggggagggctcctgtggatggccggagatgtggatctggctcaggttgagctgctggctacgttgctgctgcaggcaggagaggcggcgctgcctcgccatccgcttcttccgggcctcctttgtcgaggacggctcgactccggcgaggcgtggagagcacatggcgtggccgccggagtactgcccggggaatccggcggtgaacggcggtggcacgaccgacggcatggtgtaggagctcgtggaggagacggggaacggcgcgaattgctgcggccaggccatgttccctccgcccgacgcatgcatgtcgcccgccgccgccgcggtcggcggggagaacggctggctgctcacgaccacgctgctcttgctgcagctctgctggaaagggaacgggccggcggcgcctgggtacatggcgtcgccgccgtacgcggctggcggcgtgaaggcctggtagggcatccaggatgtggcggcggcggagcccatctcctggccaccggaggggaactcgtagccggggtttgcgccggggctggggagctgagggtccgacgacgcggcgccgtcgtcaatcgccgtgcgggggcgcttcttctggaggtggtggttctgcacccaggtgaggatgagcttgagcagctgcatggtgccctggcgcccgccgccgagccgcgcggccgccgcctcgatggtggatcggcggaggcggatgctgcggaggtcgtcggcggagatgtactcacggttgctcgtgagccactccatgaagaacgccggcagatcgtcgggcgcatcactcccctccatgcatgcgtcgccggcgtcgtctcctcccccggccgcctccatcaccgccttcgtatcgccgtcgccggtacagtcgtccgcctgatgcggttgcccggacatggcgtcctctatcatcatgccaacgtcgtccgggaacagcggctgctcggcctcccacgggacggacagcgacgcgaggtcgaggagctggtctatgtcggcgagctcaccaaacccgtccgccgccgaggccggctcggacggctcaccgccgcaaccccctcccgccgcggtggtgaaagcgctggacgagttcgacgacgacgacgacgagaaggttgagcttgacggggaagaaaggcacgggaagtccgggagcaacgggaaggtatcgtcagcgaaaaagacgtcatccctcgccgcctcacccctgatctccgccgccggggccttcccccgtccgccgccgccgccgccgccgccaccctgcttccccgggttcccgtgcgagtgcggcgccgacgagccggcggaggcgtccatgcagagtggaggcgggcggggggcggagagcgcgagatgtaggcgaggcggggggtttggctttgtttgtctgtgtgcgtgtaggtgtggaggtgggtgcagttactgagaaaggagacgaacaggagaagcagcgggaggtggagggtgggagagtagagagagaagagatgcggctgcggcccacacgtggcggccgccgagggctgtgggaagcgctccaccgcccacgccagcctctcctcagcgaccgtacctttcgccccccgcacggcacggccacgtcccactgacccgtgggccccacatttcctctgggcccacttatcattgctgggggctgcgtttctggtgggtggggttccccttttttttcctgagttgtaacggtcaatgacagtggggcctacgtgtcagtgggaagtacgggatttcggcgcgtgctggttttgaccgccgcggcagagggggagggagaggagcgttcttgcctgtggtccaatgacatgtgggacccaaaaggaaaaccatagagtggtagggtcgtgtgcgcgtagcgatttatgcgcgccgtaggatgtccgtgtcgcgtccgcgccgactaaggggctacgcgtccggtgtttccgagccgtccgatccgaaccaccgcgtgatcgaacggacgccatcttcgggaggagacctgtgtgctgtctggattaggaatatggggtgcgttttttctacgcgcacgtacgaaacctacacgagctggagatgatgacgtggaggtgtgggtcgcaccttggttacgatgacgtgggattttaccattggttgcagtggaggtggcccgtgtgaacacatgcagcgaacggcccagctcgatcgatcaccagcagccgggaagcgtaagcgctaagcagaggcatggcaatgccatggcatacgtgatcttgttctggccgttgcgtgtggaactgtgggtggagcatttgctttgtcttgttcgatcggaggatgcggctaggtaggatacatgttttgcaggggtaagagcaaatttccactttctctttgcttgtttgcttcgcaacaaatgcatttgaaaatgacagacaggcccccaaaatcagattaaaaaatatgttttctttggtgtccttagtgatgaggagcacccaaataacccatgcgacatcatccaaggattttattttttttttgcaagtttgtactttaaaatgagccaataaatctataatacacatttacgactacgtgtccttttcaatatccgtggaatcaattgatatattgattcatggatgcaaacaaaaacaattgtaaattttgggtcattgaacgatatatatctctctaaaatattatttatatcaagatgacgatatgcatgtatctttcattattaattgttcgctcaagcatatcgtatcctttcgagggaatgaagcatcgaagctcttgactcacatccaatacattgtctaattcaataattggatttgaacatcaaatatattccatgcgttgtgcaatttacaaatcatttttaattagtattttactattctcaatctatattatcgataatatgtattttactattcgatagcaactgtaaataaaggtcgttgggtgttacaggtcaacaatcatttgagcgatatggtaggttgagtgtttcccctatgttgttttggcataactttcatattactatgacaacaaggttattttgaagagttaataccgccacgtccattgtgcatatttataaaaagtaactatcaaaacacaactaaacccgtagcaaaccacatgcatatatattgaataagtgattttgtaaaaaaatatttatagattttgatatatgagggatacttgtaaacttatgtatataactcagccatgtcatcatctcaaataattttagacaatcggattaatatatatcacatcatttatacactgaccattcgattggaaaataccggtttgcaacattggaatactactatactttagtcatgattgatacaaatttcgatttaaaagtgtagttgcatgaattttgattcatgataatctatactgcaattatcatttgcattgtgatatattcatgattgatgacttcgatgctcggccacagggtttgtagcgcgcaatctatttgagcgtagccatgtagcattgtaccatgaacatatcaatatgtggtgacttcatgcattaaaagaagatggacacgttgtaaccacaatacaactttcttatctcccaacaacttatattacgtgcggacgtatataaatacaagaggctgcaacaacattttggctctttgtgattcattgatccgaggtaaggtcataaccttacaatggttcaccaccatgtatttttcgaagtacacccatgactacatctatacacgtacgcacggtgtttcgataaaacaattttgctatgagtatataggcttatggttcactgaaagacacacactaataaaaagacacaagatttggctcgtgttttggattcacgaataaatctggaaaatattttcaatgacatataaaattttctactatccccataaaaaaatgtactaactttctttgatcatggaaattaaaccctacaacaagattaacgcatatactccatctatctcgatatatatatatatacatatatatacatatatatatatatgcgatgttgttaaatcttagatatatatttgattttattatgtatataacaaattaaagttattcataatatatcgtaataaaagtttgtaataaaataaaataataattatataattttagtaagataattgaaaatagcgtaactgtatcattcgtgttagaataaacagaggaggtactcctaattcctttcactggagaccaaactacatcatcgactcatggcgtcgtaccacagaagcactagctgctggcaaagccgtagatcagtgggacgtggcggaagccaagccgtcggatcatcccagcgaggaaaccacccgcgaccgcgacgacgcaacagcaggaaaacccaaaaccggtcggactccacagcgacccctccgccacgaagcagcacgcaccaaaaaaagaagaagaagcgaagcgggggcgaattgaggcccaaatacttgggtggggtggagggccgagcgcgagagatttcggagagcagcgcgaatcccccaaaaatccacccccaaatcccaattccaaatccgacctccctcctcggccagatctcgccccctctccccggggggcctccgatcgaatcggcggctgcaccgcggccggcgattcccgggaggaggaggaggaggaggagtaggaggaggggatctcgccgagatttggattgggtttggtggttgggtgggagggagggagctggggggtgtggccagccatggcgtcggcgcaggtgtcgtcgtcctccgccgccgccggtgcggcgtcgtcgtcgtcctcgcggaagaaggatctccacgcggggaagaagctggtatgtctgttgcttgcgatagacgtagtcgttggttacccgatgttggtagtttaaccttctggaaatgctggatctttttgtccagacacgtttgattgaatagggagcattgaccgctttgcgttagagatgtagttccatcgatcgttttgcttatggtagagaagtcaaatgcgcgcaaattacccccgtcatcagcacgctcagtttgaaatgttgaattttcgttacctagatcttgctatttcatcaactgatcctgagtgatgatttgatgcgaaattaagttcaagttggttgtagaataatgatgtcgtgttttctgatatatccagctggcggagtaccgtaagaagaagaacaaggcggcgaagaaggctgctgaaactgcagaccaggcaacggcgcctgttcctgatacactagagaaccctcctccaaatgccaccagtactaactcgggagacaagttggtatcggacgtggatgtgaacacaacaagcacatcatctgtgccaccagtctacgagaatggcccaacgagttattccagaggtgacgagcccttgtcaaatggacctgcccctgtaaatgtgccagtcagtgttagtaatcctgccccatcgcatgatgtcagtagtgttggagggagcaagatttatgggaacttgagcttctctgacttagttaatgggcataatgaggattggagaggcgatgctgctcggaaaagggaggaacatagtcctgacaaggacgtgactttaaaatctaaattgagtgcctttggaaactcagatgaggtctcccattcttcagatgaggtcttgctgagtcagggaagaaatccagtcttgagggaagtaagtgacactgagcagtctagttcatattcatctggcagcctttttggaaagttagaaggcacgcaaagtcagggttactctgcaaacaatgatatctttggtcggttccgaggtatatccaagccctttttcatattaaattatgctatctgatgagtgatgataacttgaatatgtggcacttttaactctttacttttgctgctatgcagccacctctaaagactcttcccaagcagatggcttagcgtatgccagcagccgggagtatggaagtgccttcaataattcttggaatacatcaaattccacacctgtttgttttgataaacaggatccttttatgtcatctggttatccaactacatacaatcgatctcggccatcttttcttgattctattggagtacaaagagctccaacaactgaagtcccatacgtggagcctgcaaaggctagtaaaccatttggcaactcgaattctgagagttcattttttcagccaccaaatcaacaatccgctggaagcaatgatgtggatggttctctaaaatcaggaagacaagaatataacaacgagaagggatcatatggaaattccattcgtactgattcctttccttccaaagatgaacggaatctgcaccatagtactcaaatgttccaaaacttcacaattcctgggaaagatgatgattttgctgcactagagcaggtgatgagtgctcgatctatgttttcattgtctgtgctttcttgaggatatataatattttatatgtatgtcaggaatgacctagtaaaattggacattggacatgatattgagagctgtgcatttattaacaaaatctaaacgcttatttatgtttgtttgaattgatgacgcttacacctgaatgctattgtacacaaaacaaaagtttagctgaagttatgtctgtactagccatatgtccaaaagataattttaaaaagtatatgcttcataatatgtaacaacttgtttgactgcgtgctgcgtatagttactgttctgcgtggtgcagcttctgggtctatattctagacagaacgtccaaatcttgtgatggacgtgccatattctactaaattaacagccttatccttgattatatatttttacttctcctgaattgcatgtactttttgttatttacgagtatccgcatcctactcatgtctgctctggtttggctgttagctcattgaggatttgacaaaagagaagttcgccttacaacgtactcttgagaaatctcaagaattggctcaaactttggccacagacaactcagctttgactgataagttcaaccaacaggtatttccaaatctccattttggtttttggagttggatctagtatcctcacaaacttttgccatttattatgcaagtccacaacagaaaaacactttcttcacaattaataaaccagtttctgctataacgtagtatttcaatgtcaaagtttcattctgcccgtttctctgtctttccttgttgctctgccttattcacggtgaatgatattcaactagcataacatgcttgcaaaagtgtctctagcaactagaaaatgctaaatgagaatggaatagctaagcaatcacccaaaatttaccttacagtcaatacttcttatctgatcagtaaatcatcaattcttttacagcattggtataaggacagaatcaatactgattagtcatatttccagtcacttattgtcttgtgtatcatatttattattttgtttgcaaatgcttaggcacaagttatcagcaacctgacatctgacatggagagattgcagaacgaaattcaagctcaactggttaggcttattccaccttttctagcaatcattaagattctgtaattccatgcttgctatgctgacatgcttttgttctgttggttttttagtagtactatcgctgtgtaatttggaaatataatgtgctagttgcaagacatatgttagcatagaatatgacttatgaaatgtagaatgtctccggatatgaggagctagggaatgagttcataagatcacatggttcactatgtacccagcatgcacaatatgtttagattttggtgtttgactaggcaactggctgaagtatggcgctgaactattgcttgctaaatgcctaattcatatgaaagtatctccactaaatgtttaggttacttagtgtacatttgacttactgatgtttctggtagttagcatcatctgtgcactcagtgctagtatctatcaatatgaaacttatgatttagggccagtttgaatgtgcatattgcctgagcttacttaggggcacgcaacacagaacatgttatcagtgcattattaattaagtattaactattataaacttgaaaaatggattttttgaagaaacttcatatactttttttttttgcataaaacacaccatttagcagttcggaaaatgtgactaacaaaaaacgaggaagttgtagtttggagttgaagttttctcataatttgtatagttttcttaccaactccaatttttcaacagctggcacttgagtctgtcagaacggaatatgctaatgcccagctagaatgcaatgctgcagatgagagggccaaagttcttgcagcagaagtcattctacttgaagataaggtgcttagctatatactcgtctgcttcctctctaatgttgcaaatcaacctaaccttcttagtgggataataatattgacactgtttatagtttttgaatgctcattattttgagcaatgtttttttggagtatgttattatactataccttgagtacattaagccctagaggtgtcacaggctcacagcaacaaatcaaagtataatgacagatatcctatacacctgcaggtaggtaatgcctattatattcaagttttaatgcatcagatgtaaatatataatatcccttgatatgccaaacatgcagctgctgtttttttatctaacacttctctttaaggcactatttatcaaaagcgcatgcagtttgatatatcgctattttttaggctcttagactgaggtcaagtgagttaaagcttgaaaaggaaattgagggtttgagctctgagatttcttcatacaggtgaggttttctgctatgagtgcatggtatgtgttttacaaggtggggagatcaattgataagtgaaatgggcttcaaatataaatgtgaaagaaagtttctggtttttctcacattggcattcttgaaattgttatgcgaaaaaaatatgtgagtcttgtgttaacatgcaaaaaacatgacatgagtttaagtttactgaactcacacactgatcatccgagggtactgacagtgtttcctttacgattttcttttactatgcacaggcgcaaagtttctagtctagagaaggagcgtcaacatcttcaatctactgttgaggctcttcaagaaggtagttaccgttttactctgatgtaaaacttttttgaactcgttctttatcccatgcccaactcaattatctggtgagtcctagaaaatcattagttgtgttcacatcttgcacgcacatttttgttccctattatttaagccccatactcacacatcctttagtgtcacttatttttggctgtcaaataactaaaactaaactagaaatttatctgtaatattctagttggaataagacttgcatgtgtgtgatagacttaatttatgcatgaatattgccggttgtaaacttgacttcacattgatacttttggacagaaaagaaactcctacactctaaattgaggaatacttctgtgactgagaaggtcaatattatagaaaaaccttcagctgataaaagagatgcatcaactgcaacagaagatctaggtatgaatgttgatctccccttttgtttgatatctatgaatatgtatttcaattttcaactagtagtctgcttgacacgaaatatgcatcttcagatacaggggaaagcagctcttcagaaacccttaccagtgccattgacacagtagaagatggtgaaacatctgtatcgcggtccaataatgtggctgattttacttatttagaagaggtgtcttctagcatcccacatgatcagcttagaatgatcgacaatatcaactccttgatgtcagaggtaatctctttgatgtgcaaaaatccagtgtggttggtactttatatcacttacattgatcgattgcacctaaataaccttaaaccacagcacttgagtttcatagcctacaaaatttacttccttgttaatagtaattgttgcattgcagttggcagtggagcgagaagagttgctgcgagctttgagaattgaatcatccaattgctccaagctgaaggttttgttcatttcgcagcaactttgtttctactatttttgattcattgagcctatatttcttcctgtccagagcttcgatcgacccaatataaatgcgatgcatgtataattaagcactaagcctctagggtatacaaatgcctagggtcttgtatagttgcccaagggactatcccagctggcttaacctaccgggccctttcctccggatgaaatcatgtccaaatcgagggctattgtgtactgtaactttgtcatggtgtatctatcttatgcagtccattctttgtcttaaaggaattgaacaaggatctaacgcaaaagctggagattcagactcacagacttgagctgttatcttctcaaaggatggctaacgagaatgtccttccaaagccgatcgacacacgctccatcaatgatgcaactttgtatgctgatgaaggagatgaggtaatttagtttctgttatctaagcatctaacagcaaaactcacagatcacataaaagaacatctctttttcattattgttataaagccttttcatgtgttgacagcttgattttttttaaaggttacaacttatctgatgtaacatatttgattgcctttctccattagatcattgttatgattgtctgacgaaaaatatatacaggttgttgaacgggtgcttggatggataatgaagctcttccctggtggtccaaagcgacgaaccagcaagctcctctagtggaaagtagagttttggtataccataatgttttcttttcatttatatatgatatttttttgccctgttttggtgatagcatgatgagaagttgtatattggaggagagccccttgatgtaaccattcttttttctacagaaaatgaaatgtatggtttgacttctgtggagctacacttttgtattggcaatgaacagaatagctgccagcaggaaaaatacgcccccttatatattccataattatacgtggggtggaggtgtatgttgtaattgctgtatccatttgttatttcattcacttgttatccctagctctactatctccctcgttcattttctcttctgttatttgctgcaacttgtcatccgatttcctatattgctctggctactggttacaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtcgactaaaagactttcctgttctctaaaagaatgcgaaagtcgatttttatccgcatgggatagtatgatctgaccaacgaatagactaaaatataacaagaaataatatatgatgactatttcttgttatgggtaggaacgcttagatagaacttggtgttcctgaaatcatcaaggagtggattatatccatctttggtcctagtcttcaacggcagtccaaactcttccatgaaggcagcagaatcaagctaacgatagttgacaaataacatcatactcgtcagtgcaccgaagtttgtaaaagatgtgatgcaagatgaactaggacactaggttgcatagaaaacaaaactggcttaaatagtctgaacttacaatgatggttctcctcgtcttaactggtttaaatgcaccggggttcttttgctgttttgagaaaccagagcagtcatggtcgatcttctccaaaagccagaaatcggttgggaagaaaatatctgcgtcaccctggcaagtaacataaccgagttcttttaataatatataataacacatagcacaacaacttaattaaacacatagcataacaacttaattgctcaaagttatttagttctttttccccatggggttggacagtagggtcaactaagctacgacatgtttgcaacgaatctaatattcagatataacagaacagaaacattattcaaacctgagcctcaagatagttgcgatgatccaaagtcctcccgtccttctgcaagcaggacacaacatcaacgaggtgtcctagagaaattgccttgttggaaaaacgcaccaaaagtcagtgaaggtcttgtcacctttgaagaaaccaatggagctctatcgccaggtatactgacatcaggaagatagctgaaatctgaagctataagggacatgcttggcaaagcttgatgtaaagtatctagtattttctgcatatgtcataacacatatttcagagattctggcagtaagctgacaaactcatcagcatatgatcacatatagaataacagtttataacctaacaagtggaagtgggttcaaaagacataccaagcatccagttggtaaccaagctctccgaggctttgggaatacttttgacacaactccttttgcagcaagtgataatttgtctctcacagacactttctcttcatttatgccagtaatctcgacacagcgggaaactagtgggtcttgtaatggtttgtatacctcagagccttgtgaactatttttcataaaaggcaaccatacaaatttaatgaagtctgtcctcattagttaccaggcaatatcaatcaatacaactgtccagattccagaagcacaagggcgatcgactatgttatactagaggggtaaggaatcagcccttcaacaataatatatcgaaaatgataaatttatctaacaagaatctagtaaaagaccagcatgagagcactataaaacaagcagaaccttcccttaatcttctgttgaagaatataccttttttcctttccaaaatataaagtatgtatactaagaataaacttatcttatgtagcactgtgcttatatatgttacaaatacaatacagtaatatatagaaaagaaatcataagatcaatagatcattagccacgaggtaacagaagagaattcagtaaaagaatttcactacagactgtcagacttccatcattttttttttacccacaagaagcataagttcattcatttcatcaaattattccaaagtccagatcatttcattgaacttgcctaaagccgcacataaataatcggtataagagcaaaaaagatactttcatatattgtctgaagcatacactctcaggaatcagaaaaaggaaaacacaaacctgccatttactttttcaatccatacttccatccatggagagacctgatctggcgaatagacaaggtcatgtggtagattgtcaagtacctgacaatacaccaaatgaatgttgctgttgaggctgctgccatcatgtctctaagatatgattgcgaagctaagaagtccatatgataatctaattcttcacttagcaaacaaaatgatactagcaaccagtgtttccctacttgccatcatcagtcagtccagactactggcatggtcatacaatggttaataagtgatggttggtagaatgtctaaagaggatcctatatctggttgttatggcaatagtgagggtacgtaaaggaacagcgcccaacgttgatacagtgttttgtttgcaatatcattggcaaagagagagtaatcaagagtttatgtctgctataactttataacctactcttacatatcctttgaaacacaaaataacacacagataaactcgacactgaaaaaaggtatatttgcagtattcacatcttgaaagcctaaataacatttgaggtgctgctacacattctgccaagctactaagttagtgcaaaccagccagaggactgcagctaagcgtcaattaataacaggaaaggtggactgtaatgatggtatattgcttctttgattcatatgagacatcaaagaaacaaccgagcagatagtcaaggcagtacctcaagcattaacacccaacaaggttgaggatccttgcggcctgtaaaatatgacaggaaagtaacccaaagtggtcaaggaataaaagtgcaacaatataaagatcagaagataaaatccgatataagtgtgatttgacatggagggattagtgggaagtctgtgtaagtgtaacccacacattttagactgagcctatcagcactacatcaaaatatggtgtaatagcattagctgaaaatttgcaagctgaattatcaaagttcatacattattttttaaatagaatgcattttagagtagattgccctacagaggagcagggacaagaagtcagcttaccccatccagctctgtcagttgcgtcacgacactcaaccatgaactttgacaaatggcttcgcacctcaccaacagtttccaattgcttctcagctagagaggaactaatttctactgagctagcaaattaagataaaagcaaggtcaaagcatattcgatcacataacagagatcataaagtgaaggaaggtttccttacatgtatttcatagtattgtatactttcggtggagcatttaacatcatgtagtcaagtatgcattttgcacatgtgccagaaccaccaccaatttcgtaaatctgatccatgcaggggaaaattcatatggtttggtgaaaaagaaaacagatgactatgtgccataatattataaggtaccttttctccaaaaaaaaaatttggcatgagaactgcagtaatattactagttgagaaggaatgaaaaaaagaaaaggaaaatggtgcagtagcacagccatcatttattaaatcatatgtgagcggttatggcgcttgtaagagcaaatgggtggatggaggtctagaactatgctgaggaggaagttaagaatgcaccttcagtgggactgaaagatttgctgtacggaggattgatgcagctattgcataggcataccatggctgcaccagagaaagaccacgcatcaagggtcaaactgacagaaaaatgacactacatgctattgaacagcttaagaaaacaccttgaagagctccactggagtgaaccaagcgatgtcatgcttcttgtacaacttatcaaggtactgcatatacgcactcctacctacataagcaaattacttccgtttctagtcaaatatccaagatattaaaacagcacaacacagaatcgtaattggcaaacaatcaatggagttcaacagtcgtggaagaaaaacagaagtcccaaatttctgcatgagaggaacagtggcacgcgcaacgtgttcgtcgaaatgccacctcggcaaacaaatgttagaaccggcctaatctgattcccgcaatgccggaacacacacaccaaactcccacatccaaatccggtccaagcaatagaatgatccaagaagcaggtagaaaggaggattaccgtcgagctggttgaagcggatgctggagtcgagcacgcccacgggtcccgaccgcttggagaagtagccatggttggggtcgtacagcgccgacctcacgaagtcacgcacctgcgcgcacgaagctcccaccaaatcatcacccgctacaaggagatctcactgcgcccctcccagcccgcgaaacctccgccccgagcgcttaccaggatgggcttgttctcggggacgatccccgacgagaacatcgccgccggataccaccgcgccagcgtcgccgctcgccggagcgccgccgggacggacgccatgtgcggcggcgccatgggggagtcggggagtgagtcgctgcggcggcggcggcggcaatgcccacgcggttccgggccttttccccgaaagaaaagaaagggaagtccgattcgtgttcgggcccaagcccaacacgagtccgagtcggagtcgtgggctgcttgggccgtacggcccgcggcctatttaagtcgcgcgagaggagacgcatctcctcgcgcacgcgcacgctcgagaaattgagagattcattcaattcgaagggcgggagagaaggaaggggagagatgatgatgacatcagcgatgccgccgggcggcggcggcggcggcggggaggctcctactccggtcaccggcgtcgccggcgacccccgccatgagcagcgcatgaggctggtgaggaaggcgagcgagctcgcgacgcggtgcgccgtccccgtcgccttgtccggcccggccatcggcggcgtgtgcgagccgctgcgctggccgtcgatggacaaggcacgggatatcaacaatcggtacaaagcgctgccggagaacggtcggaggaagatctccgtgggcgacgccgccgacatcgcgaaccaagccgcgacgcagcagccgcagggcgtccccgccggcggcgagtcggccagcgcggcgggggtggccgctgccttcggcgccatgaccgaagaggagctccgggagcttctccgatccatcgactgctccctggcggccgcgagccacgcgatccagaaggccgccgacgaggccgaacagaagctctcgctccagcgcgcgggcacgctcatggcggtggactcctcctcccaggacgccgtgccgccacatgccgcgcccatggacatgggagacgaggtgcagggcgcgcagccaccaccggatcggtggttcgaagaggaacgagagccggtaatttgctccaaaaagaaaccagagccgtgctccgccccgccgccgccgccgccgccggcgaaccggaacggcgtcgcctacgaggccgaacaaaggcgcgcgtgcgcgctcatggtggactcccaggaggatgccgcgccgccgccgccgccgccggcgagcgggaatggcgtcgccgacgacggcgagtacatcaacctgggcgggtacatgatcgagcgcaaccgattcgaagcaatctggcgcgaacacgcgatccctcctccacaaagcctcctgccggagtcgttgccggacgacgacggcgagccgctgcggctgtggtcgttcgacgccggcgagagggtaatcctttgaatgtgcccgcgttgagttggcctctagactgattttgttgttgataagagtaatgctatatttactttatggccgtgtggcttgtgacagaagtaagatgtaatctattttcattaaaaaaacactttaaaaaatctgtactagtcttaattagtagttagttaggggccgtttagattgcagtcaaaataaatctaatgctaaaattttagtagtttgacaatattataaaaattgacagaatttcttatatatttactaaagttggacaagaaactaaatgtatgcacatttttaataattttaacaaaaatgatatgatttaaaatgacatcaatctaaacaacccttcagttagaaaagaatgggcttaaaatcaagaatcaatcatattttatccacatcagcttttcaagatgctttttctagacaaataacagatttttgtacgcgtataattttccttttgagaaggttttgtatctaaaacagtttcatttatgcagagctcgagaaaacagcacaaaaaaatgaaaacggctgcgaggggaagatcaaagctcactggacacctgtgttgacgacattctgtaccggctgaagggtcttcgatcgatgatttcacttagatagcagtgcagtggtctgccttttttgtgaacttgatgtttctgtaaatttctatgtgagattcagatgttgctcgatctgtagctagttcctgtcttccagctgtaactgtaactgtaacgagaattaacaggcaaaagaactttgttatggggattctttaataaagctggataactaggtgatctgttcatctaaaaagtagtcgtgggactgatcgagtttgctgtttgccgccttccgacagttgaccttcatgtcgccgccgcagttgccttttgctgaaaattggatggaaaacgtgcatcgagggatgggtatttgattgatggataattggatgtcatcaaacaacaacatggataatatggagcatgctgggtggcttaccactagcttgactctaggcattgagagacaacacaaactgtcaaagattggtggaagacactagctaatacggcatgagtttgagaggtttgcgcaccctcatcctcctcatggtttgggagatatggaagaaaaggaatcaacgaatctttcagcacaaggaggctacatcatctttcctcttcgccaagatcaaggaagaggcgcggacttggacgatggcaggagcaaaacgtttgcgggaccttctgcccctccatatataatatataaagagtacaaagtttttcatttctgatccttaagagttgttttttcttccactatattcaatgaaaagtcatgatctagtgccgttttgcttaaaaaacaacatgattgtagttaatagttattactccataaagtgcactttttttaagtgtaaataagtaaataactgatggatataattggaatatcgtcgaacaacgattggccctttttttcttttcattggcgtttagatcgtttgacgtagcgacgtccggggtcgttgcgccattcgatttgcatcggacggaaaagagggagtacagcgatagaaggggctattgctcggtccgcaacaacaaaaatcaagccacgaagattgtcctgggcccatggaaacaatacgacggtagcattgattccgaggagttcctctacatccattctacaagtgcaaccgtatatatcatgtctaacctgaccgtccgtcttatttaaaaaaattatatacttttattattaaaaaatagtcacacataaagtaccattcatgttttatcatgtaataaaaaatatttatcataaaaaatttctaataaaataaatggtcaaacattggacataaacaatataaaactacactattttgggatggagggagtaccattcttaatgcaataggggcaaatgacaatgcagtagcgaattatctatcgattacgttgaactgctcatccaccttatgtcatattctcgatcaaccgagcatcgtttttatataacgggtaatattttcaaccgctactgtttttttatatataaatgttttttctaatttctttctgcatcgtactggtgtcaacactgagtagtttaaatgatgaatatgatcaattatcgaccgatcgatcattgtttttgaaaagatgctattgattctgaatgttttcgaccgttttcacctcttttaacttccataaccatgaggatactccatacaatctctactattataaaaattaaagatgtttttgtcggtactttgacacgttatccgtgtatggttcggtttttaagttcgttcgcttttggaaatacgaatctgtatttgagtcaagttttaagatcgctcgcttttgaaaatacaaaaggagtcgtataagaaatccccttaaaagaactaccatgctaacttgagatgatcgaactcttaactacacatcatgattttctagaaatatatatatatccaagtaaattcccaccatgaatttcaccttaactaaaccatacaacaataataatattaaaatagccttcgtccgttgtaacatacgggcattttttaccgttattttcagggtagttataaaaggcacacggtcgaggacgatcttcacgggttcccgaacttccaaaaaaaaggggcaattacttatttgaccctgttttgaactgtaattgatgatttggccctactttttgaactttgcttatttgaccctccttttcgagtacgaagctccggtctgaccctattccgtttgggtgaggtgacggtgttaattttggggtaaatagtctattttgcccttgcttatttgacactgttatatcccttttgtttgcttgtttgaccctattttgttataccgtgtatatattcaacaatgttgaaatatttgtaataatttttgctcaagtaacagatttggcattaatttgacagatttgaatcattttgtgaaatttgacttaaatttgacagaattttgtgaaagtgaaaataaattaaataaaatgtgccccaattatgacagatttggcataaatttgagaaatttgattcattttgaaagatttgactaaaaattgtcaaatttgaggcaattatgatagattttgttaaaaaaaaatcgaacagcatcgacgccatcgacctcgctctctcggcagtcggcatgacagtggcgaacggcgcgcacggcggtgcggccgacggtgagcgggggcgggcggtggcggacgaggcggagaggcaagcgggcggcggtggagaggcgggcgaggcgagctgcggcggacgaggcgggcgaggcgagcagcggtggagaggtgggcgaggcggccggc

SEQ ID NO: 64889 - DNA, 3392 bp, Oryza sativa
tttcgaaacggagggagtatgtcacaaccaaccaatgtgcgtgcgtcccttttttttattagacgcgatcgatcgatcgatctaatactgttcagtacagggtactacatgtttacctctctcactaggctggtcattgttaccatttattagtattatatatgatcttcagggtccagttaatcgtatccatctttctttgtcagcttcatttagctgctgtcctttgctggattcactcactatatcatcatttctatcattattagtggtatccaatgtctcgttttcttcttaaaaaaattagtggcatccaatgttggtttctgcatagtattattatttacttaattaatgttcattaacatcttcgcggaaacagcaccaaatgattctgcatttttcaggaaaacgaaaaaaaaacagaaagctggattactttatacagctgcacttttcatgctcatgatctgaagatcaaatcaggtttccttggaggaagaaggtgcagcttcctgcagacaggcaggagggaacaccggaatgaaatgcatgcagaattgcagagaactaattgcagatccataggaattaagtgaatttggccatgccccatgatccatagtataggaagatcggatgaggagaggaaggagtggtggtgtgtccccctgaccaccttacataccctacggtttcagtgacgatccaagttccaaggccagaaaaattcaggccatatcatccactgcctgcttttactcctctgtttcagtgtcactccacaacaagtcggccattgttcatcttcttatctgattctgattgatcatccttcattttgcttggaccttgtaaactggagtttagtgatccaagagatgcagatcagttcttcagtcagtcaggttctggaccaccaatgggaactgggaacaagaacatgtacctgcatgcctcttgtctgaattttcaggcaatgatcgtcaacatttaggttaacagactattcaagttggtgatcatcgtgtggtaaaaaagctggacacatgtcagcaaacagatagcactgtaactgcacaattgcctatgacgatcatcgatcgatctcacctgaacatgcaggcacaagtggatgtaatcatcatgctaattcttaaacttcttgagaagcaggtaagaaagagaacagtgcctgagaggctgagacaaataacaatgaggcacctggttacaattctgctacactgaaatgtagtgcctcgttaaataaagtgctcatcaatcctcattatacaagaagattggatggatgtcatgaaacagaaaaggggcataacccttgatattgtacataatgctttttcattattacaataaataaataatttaggagagtatggtgactgtactactaactaaatctcttgacacaatcacactgttctcagggagagggaaaaaagagctaatacattttttatcaacagttaagctcactcttgctggaatggatgtaatcttcgggtgatccgagtaaccatattaacaaataacgttcaccctccgagtcaatcaagaaaccggtataccggacaaaaaatagacaagatattacacaaataataatcaatcagttaaaagggcgttatcttgataaggtttagtggtagcctttttctccagggagaagtcacagactcacagttcaccctatcaccaagaccttcagtcttttgcagctcatgctccagtaccaactagcatagtctggtgcacatcacatctgcttcagcacttggcttttgctctcacatgataacatactgtcatggtgcagacatggctctggttcatatgatgtccatctgcgaaagtagaagggttttacactgggtactagctagcgagttcagttataacagattgaatgataagaggcattctgtccaccatggtacacaatgggatcccattagtcacgagctcggatcagcttcacaagaaattttggcttacgcatccaaactacaagtatcaataactggaagcaacctatgtgacaagaatgtatacacaggtacctgtgatgtcagtctctgttatggcaggcaatagttctacgacaacctagaaccaccgccctcctcctttcttggtagctttcagttccatcactaatcgttcccgctgagcctctacctctgcatactgcaagctcatgttgagtaaccgctccttcatatctcttagctctccttctagttgcaaaaccctttcgttactactctcattgccattcccagcagcacactgcccatcaggcatgggactgtacagaaaaggaaaaataaaaataaaacaagaatatcatgatgttctgaatggaaggcagcagagattatcagactaggtatgaaaaagatttgccaaaggagatatgctgtccaagttcaacagtattgatgatttagcaaaccaacaaaatgaaacatttaacatagtgtaaacatatggcatcaagatttatgttcattaacattgtgtaattcagcttaaatatcaccagcagcccaaacacatcatgtgggtgtgtgtgtgtgtgtagcagactgcagatgccattgtaagaatatcaaattttgtttcaaaggttagatggataactgtaacaaaggaaagaaatgttcttctatgatgtgttgttctaggttgggtaatacataacaaaaggcatgtaagtttggagcagaaggaatacctctgctgttgagctctgtacatcttattctcctctaaagcctctgcaagcttagcttccaatacttggatcttcaaatgaatgccagattcctcatcaactggagaaccaccaatatcctgcagttacaaggaaatatatggcagacagacattaaaaaaaccaataaaatcaacaaaaaataatcatgataagcactttttagggttaacctgctttccaaggtcctcttctttgatgtgggccatctgctcgagctgacttgtaaggtcctcattttcctgctcaagagattgtatctttctctggtactcactatttgatctcttgattctattaagttcattctttagctctgcttcatgtacatgcgatgcttccactgcagatagatcactctccagccttacaagctttgcctgcatagctattctgcttcgtttttcttcttcaccattgtccaaagtctcctgcatattggacattttatctgtcagcatagccttctgtgccttcaattcttcacattcctcagtaacagaacgatgtagctcctccagttttcctctttcgaacttagcctcatcaagagaacttttaagtttgagaacttcgtcttgaaggctcatta

SEQ ID NO: 64890 - DNA, 2378 bp, Oryza sativa
cttagaggcactttaaaaaagtctaataagtgtcttatggtgaattatctctacaaacgaaaagacattttataaaatgtctataagatggtagaggcattttctagagacattaaattataccacaaacatatgaaaccagcattttctagagacattaaattgtaccacaaacatatgaaaccagtctaaaaaagagacattttataaaatatctataagatggtagaggcattttctagagacattaaattgtaccacaaacatatgaaaccagcattttctagagacattaaattgtaccacaaacatatgaaaccagtcccaaaaaggagaataaaatactttctttgcttttgtcaagccttgaacacaaacatatgaaaccaagtctaaaaaaggagaataaaatagtttctctgcttttgtcaagccttaaacccatgacttcttggagaaatcttttctacctttaatgcactaaccaactcaactacatgtcattacttgtatgtttgtgcctttagttacttatatttactccttcagtatacattatcattctaagaagtgtctttacatagtttaaaatgtctcaagaaaatacttttacatatcagtgccgaaatattgcctctacaagataaaatctaataaaatgagctgaaaatatctctagagtaaaagttttctaggtaatttttaaagtgcctctataaagtgtctctacactataaaaactcatgatcttagaagaaatttgcaaaacacctctacaaaagtatctctatatgaggtttttgttgtagtcctcttccacaaggattgccaacatggccaacttgcattagctaaggcaccactcgagaggacaaacttctagaaagagcatgcccaaactgttgaaaaaagtttttgccaaggaagcctcctagaggacgtctctagggaaagaagagacgataagacccgccgcactcgttgaggtcttgaggagaaccaagacaaggtttttacccagcaacccactagagggagagagacgactcgacaatgcccctaagagggaaaacgacacctaaagcggtgttgttttcatcccagcaaggtcgggctaggttttacacctattgtccgccccttgccgatccacaactatcgcttcattactccatcaccggccatccttcgtcagcgggtggacaccactataccgacgcctttcgtcggccagcttccgcatgcctctatggcatacccattgtcaccggcctctctgttgtcactgcgtcaacctctcgcgccattagtcgggctggcttccctaccgtcacctacaccgacctcctaacaccacctgcgctagccacccgcggtcgccgtgccgattccgaccagaaacttataccaagtctagctaaaacttgaatatgggcaaacaggtttcactataaggaacctaaccgtttgagctactccctccggttctccggttctataataattgacgttttggataagcttaaggtcaaacttttataactttgaccatcaataactttaaaaatatttagtttaaagaaactataacaacatatatagatttgtctgtcaaaacactataataaaagtaagcatgcatttaattattgcatatattataatagaaaaataaggtcaaagatatattttgtagaccgtgtcattgtctaaaatgtcaattaaaatgaaaccggaagaagtatgtttactctgcatttagtgtcctaaatattgaaaacttttgtatgactcccaaaagtggtttcggatgttggtactgtatatggaaattatctctagctacaaaagaagtagtccaatctcctcctattgcttaaggatgtggcactgtttattgttgattaaccatgcgtcgtcgtcactcgtcactgctcagtgctcacaaagaaacctcatataaatcacaaagactttcgagatttgtattggaattaattaatcctctacttgaatacatttaattgggatctggaacccagtgaagaggggcgtgtcgaaggtgtccatggatcgagaatcaatcgatcgagaatcaataaaggccgagactgcagagaatgataactttatagcttgggaagcacacaagtcagctcttgtaagattaatgatgtatataaaaaaaattagatataacaatgtttaagtgttacaccttcatcagtccacagtttgctcttcagcttaccagctacaaccaaaggccccatcggtaggttcgtctaataaaccaaagcaaaaagttaaaatttgaatttttaaatttaattttaaagttgattttgagatattttcaacgtattgtatcccttgta

SEQ ID NO: 64891 - DNA, 12053 bp, Oryza sativa
  unsure (1)..(12053): unsure at all n locations
taatttggagctagtagtggactatactattaaacttgctcttatagtgagtacagtagataacgtaagcgggttgtacatgttgtaacatcggatttgtgcttatgtaaaagagagaagaaaatcaagctacatatgtacagccagctacaacatgacctctaataaactatgagagatgtatggattagtttttttttcgggggattagttttttttttcggggaattagttattaatgatacaatatatatttacaactaactattgtataataagtggctatagataatgtttagtagtttttaaggttaatagctgactatattattaaacttgctttaaaggagactcagacgatcaccccattgcctggtgtacggtattgttacgtcgagtcgagagcaagtcgtcttctttcaagttgttgcattgcggtacaaaatgggaaaggtactgaaactacttcgatttacacggtatacaaggttgcaggtggcagaaaatgaaaaccctacaacaaccagaggaccaggctgcttgtttgaccattggcaccgcacattacgtggtttcatttgcacatctcaggggaaaaaaggcgcaaattgacaatgcagatctatgatccttgggaatacagcaactttataaaaatctagtagtaccaggaattactccaatatctagaaaaatactccctccatctcaaaaatctcaaaatatagcaacctaatttactggattagtcataccatagtgcaacgaatctgaacaaagaacctattcaaatccgttgttaggttgtatctaatctcgtactataaagctatattttggagtggaggggctccaatatttcattcattccagaggtggcataaccgcataagctacagcagtgcacaaaggtctcgatcacaatacatacacggctacagcagtgcacaagggtctcgatcacaatacagacacggccagaacgtcgcagtgcaggataaggtaacaatagaactagatattgttcgttgtcagatgattcgtttccccagttcagcttggtgaaaaaacgaaaacggtcgcagtgggtgaaaagaattctagtgcttgaagacgatcagcacggcagtgcagttgtccttgcacgcctctcacgaacagcttccttcacgagccgccgcactgccagagtcgctgacgaggtctcctgcaatgattgacggttgaacaaagttttagggttgagaaatttggtgttcatatacttcatccatcccaaaatatagcaacttaaaataaataggccccctaggatatgttttctccgatcctaggttgctatattttggaacagagagagtaatgctttgcggaattgatcgtattaaattcaatcataatcgggtcacatgctttagattttgtgtgccagcgtaatctgatcataaatgctttcactacggtagataattgctgttagatggagtagtggggaaaggaaacgaatgcacttggagatgcaaataacagaaacaaacagcaccttcaattgattctgcacaaattcaacagcatcacctggtccaaatacctggcacatccatttacagcacatgttaaaacaacacggaaaaagtatattactgaagcagaccacaagaacgattggcgataaaggggagaagagaaaaaggacgtactccccataagccatcacacccaagaataataaaatgatctttcctcgttacttcaaaggagtggacgtccggtgtagcaatcagcccaacctgcagagtggggcacataagagatcgtaatataaaaatgtagcaatttcctatggctaaagcaggctttccaaaagcatgtcaaaagaccataggatttcacattttatctttgaaagaacttcacaagaccaggcatggccagttgcccaacagaattcatacctactataattcaatatatgcaaatggcacattgttaggtttgccatatcgagaaagccactgttagtttatccaattatccagacaaagagatgaacagagaaacagggaaatatactagtatcataattttgtgaaggcttgcagcctcgcaaagacctaaaacatgctagcaagcttccacaacgtctgtttacaacttaaatccccagcagttaatagggtcgaacgttagctgaaacaacagtgctagcatatagccagaaatctgacacttcatagttggttcaaaaagcaatgtggaaatgtgcacaactgcttatgagaaatgtatctgcaacagcaaaccttcttaaactgacgatcacccaaagctctagatacttcaatgcgaccttgtaatctgccattagggccaacagatcctccagcctttgtagggaaaacatgttaaaatgaatcaagagtcaacacaaatcaaaatcaaaatcaaaatataatgatagaactaacaagctcatatagtaattgccaattcatcaaaaccacaagggactaaactaaataaacgacatgaagcaaatcaaaaaaggatctgaaaccttttgcaaagcaataaatcaagaaatgataacatactcataatataaacaagctaactgaaaccacataaaagtagggtaatcaccggcatatgattgaagcacaaatgcattaagttgttcaaggaataacccataatgaaaacggatattaacaacgcagagctacattcatatttgcagttgtgtagcataatcagattaggtttaacaggttacggtgcatgcagcatgattacattggaaaatctagagcaagaaaggacttcattatattaaataacagtgcacaaaacagaatatacttttaaactttcaaaacgaaactgagatgaaatttggcaggaaaactgaaataaatgttgaaagtaaagcaacaagttaccttttggattcgagcacgttcttgtggaaagattgctttatgttctctggtcaaaacaatagccttcagttgacttttggcatcatccactgcaccttcaccatcagctgatgtggaacgagctaatacagctttagcatctccagcatttgcaacaaccacctttttttcaaaaataaaataaacaacaatcacataatcgacaatatatttcactacataaacaatagaacagttgtgatccagtagttcaaaatttaaaactatagagcacagagctgaaaccaaagcacatagcattgaaagaaacaaaatagtaaaccacatgatttaagcttatacaaataaaaagtagattggacctacgtacagtaaaccacatgatttaaacaactcagcaagaaatgacatgcagatgatcacgatataaaatatgggccctcatgaaccatcgagaacctctaactaagagggctgaaagtaagcaccaacacatttctatcacctcttaaatcttgtcactatcgatactcccaaagtcaaaatccaaaaatataataatgtgaaaatattatgagtacacaaaattcccttgttactgaaaactaaccgtctgccccaggacccagacacagacagctgttgcaccatcttgccagtttcctatagtataataaggaaataggtagaaattcagtagtatagagtaaaaaatcatatgaaacaaaaatgaaactaacaaaatttacataatagagtttcaaaatctacctcaatgctgggcacaatacaatgtttattattagttgtcaccaaaacagaaatgtattccttttattgttgtgaaataggaaagtcgaatgaaatccaatctgattaaataataaatatctctccttgtccaagcagaaggaaaaggagacaatttgagcagacctttagtatctctaattagctctgctgctcaccaaaataattatctcattatatgcattttgttgacagcatcagctaaactatacactacgaaccactagctacaaattttaaccaccaaagaaggctatttatggtcaggtaactgataacaatgcagaacattaagtagatttgcaataacattttcagccaatatagtagaatggccagatattattcttatctgggccataaacctatattgggtcagaggtgactgtaaagcagaggtctatggtaaatgtgcaggccaacttttccacacgaattggatattgcagaagagtaatggagatatgggaaaatatgtagtggaacctacaacttagctggaaacttttgcatggaagttcagaaaatatataaggaaaatcacaaatgtagggaagatgtaattagacaaccatacaaaatttttaacaacaaattcagacttcgtttgtgagatataaaattaacaatggcaatgaagaaacactatacctgtttttttgttattttgtttttcactgtttctcgatttcctatctcatagatggagaggagtttcatctgatattttgtatgattgtctaatatcaccttagccatatgtgatatttttcaaatatttttaaaattttattccatggtttctgcctagatatgaatatatcctcgtacctttagtactttcttgcagtaagcactcatcagttctacgaaaacctgaaaagatccaacaaagtaagtaccagagcataaaatcagttggtgtatcagtaatgtactaattaccgatggaaaataaatacttactgaacggaaattaaagagcttgaaacatcaaatgtgtggagagatagatatagtaagtacagagaagagtagtgctatacgtaagattcttttaaaatgccaactgtttgatttaataagttggttgatggaaaataaaagatgcgaaagtgtaccatttcagtactggtaaaaagtttgtaagaattttttttgtagcacatcattttcttacagggaatatgctaatatgaaggaaaaacaataataaacagagaaagcttggaattgaaattgtgttcctcttagcactggaactacacgtaagatggcaatgcctgttgtcgttttccataaacaatatatttcttctaccaaaccagacagtgaaattaaaactaaaggattgcacctggactcatcatcataaagtactccctccattcaagtttgatcatcattttttttaaaaaaaaaactgattttcaagtttgatcgtcacatttgcagttggcatgcagttgcatctcgtccgacgtgctggccgtttcagttcgcacgtgaaattaatcagccactgcatggacgcctcaggagcactgcccgttgcatgcatgtgaaattaatcgcatttacaattggctacagatcattggttccgctgcgatcatcatgcatgcatgggctgttacaataggcatgctgacccattggcctgngagtagattangaagatgataagcatgtttgctgtccttggtctttgtgtcaggccaaaatatgacagacaaacttgaatagagggagtatatgggatgctaatggaatcaaggtcaatgtgtctatgtacagtacataggacagtttagctgaccaggggaataatcttagccatcaaaaatcaacaagtgtaatcctagtctacagttatcagcaagtaactaagattcatgtaataaataccttcaatgatggccttctttgcagctttaacatccatctgtaaatccatttttaattactattaggtaactcacaaaccaaattactgtgtgcattgcattcaagcaaaaaagggattaatctagagataccattgaaataaatcaagtgacggacctaactgaaatgactcattaatggaaggtagcataagaggaaataaaacataaatctaatgatggaatactcccatatgataaaaaaaagaaaaatagagaaacaatgaatgcgcaattttgctaacactaaactatcactcagtgaggaaaacagaagttcagatagaacatgaatagtgaaaacattgaaaggaagcagataatgtaaacagaccaactcacgtggtaatcctgctgcaataacattctgatgcaaatgtttctgtgcatactctgcagccaggcgaccaccatgtccatcatatattgcgaaatgagcgcacctgcatcaagctacacatcaggctgcaagtattggatgctaggagttaaactgaacagaaagaggcagacctcaggtttcccggagattccatgctagcatcaggaagcagcacccatgcatcttccatagtatgcctgcaacccttgtcttctgcagcatcagcttccacactagtcaaaatcaccccatggccacttgaaacattcgagttggttgctgctttctcatctgaaacacacgggtttgtcgacaccgtgttttcctttcgagaggcatctcctccttgagcttcatcgccattcgtttcatgcgaagcgtcagatgtcagaatgtgctccttttcagcagcagcgccgacaactttggggcgttttgatgcccactcttcatcgccaccgccgttgtcgctggttgcttcacgcttttgatgagccatgacgacctgaactatacagcttccaagttccaacagcctcttatcaatttcaccagcgcactgaaatgcacaaacaaacagaaggaaatgaatgaaatgtgagtgcatttcgctatatactttatatatttgctaaaagctaaatcaaaatatgagcccctcttcatcatctgcatctaccagatccccacccctcttccccaatctcccatgaaccaaacccttccaaatcgaccccccaaaacctagcactagtagccattctcccacatccccaccacccgaacccttcgttcccagcatcactcctttgtccccagaccacatcgaagcgatcgagacgcgctctaagagcgcgggcgagcgagctcatcgcagcagaaatcgcagcggcaaaaaccgtaaaaagggagaggagctgaacagagcgcacgaccacgaaacctgaggaggaggaggaggaagcggagtacgggagcccgccggccgtcgtagcgccgccgtcgccggtgaacgagagggtcggagagagaagaagaagaagaagaagggatttggcgattttagcctcgtttgggttgaccccaattttggcccatccacgtattcgggccgggctggaatctcggcccaccggaagtggatgggcctgggtttccgcctaaccagggccggattccgcccacgcgggaacaattcctgggccagatgaacggtggagcccatgtcacagggatttcattctatctttttcctttcttgtatataagtctttgctcttcataactactccctctctgtgcctctgtggttataaatattttattttaaagaataagtttggatcaaatttcctaaaattttactaccaattctatatttaaataattttagaaatataataaattaatgatactatgatagtacttgtaaaacagaactaaggctctgttcaggaggagggttgagctagcacgtaaaacgatgtttgtattaacgcatgattaattaagtatttgttattctttttcaaaaatagattaatatgatttttttaagcaactttcgtatagaaacttttttaaaaaaacacatcgtttagtagtttgaaaaacgtgcgcgcgcaaaatgagggtggggagttgggaaccctagggaacaaacagagcctaagtagggctcaatttcatgtatttgacggatcgagtttaaaaagtttgactaaattatgcattagtcgcacagtccttcctcactggtagtgtagcttggcagcagattatgttacgaaccccttttagtgcatattagatcgatcaggttactcgggctctattagggctttaagatattattgtataaattagccatcacatcaacctaacctaccctcctctttttatttgcactagtaaggctcaggggcaatgattagttttttttaccaccgttcatggcatatcttttttttcttttgttgttgtatgagagggaacagttgattttatcccccttttagtacgtatcggttgtttgacgatgcggatcaaccaaaagtagccacgcgtagtccttactggtttatgggagatgagagcacaccaatgctcagaaatctcagctctgcttacacagatggagatcctcagcaagagcttcatagacttcaatttacattttattagccgaaattgtaatagggtagcacatgcttgtgcccggatggtatcccagaactctcgggcggtggagtggcttataacccccttataaccccacctgacttagggatatcttaatccaagattgtaaccctgaccgtgattaatgaatctccggtcgccccccccccccaaaagaaaaaaacaatatgcaatttactctctttctcctttatgtttgttatactagtttataatattgtggttgagagcatcctcatatgcttgcccatccatcattttcggtggatagttcctagagtcgagacaaaacccacttatgacacatccttaacatttactccctccgtactcgaattagaagtcgttttggacaggattgtgcttaccaaggaatcattaattaaggggtattcttccatgtttgcccttattaaatgaggctgcgggtttccttttacaagaattgttcatagttagattggttaggcagccgcacccagtctgggcggcgagtgtaatgaacaagcgctattaatgcgcatgattactgcggacggcgagcatgcgcacgcaggggcaaacacatccaccttctatcctctgagcgtgccgcgacattctttgtgaaaacaccagtgacacccaaaacgacttctaattcaagtatggagggaatatacatggtttaattatctacgacatggctcttgatccaccacttgttgtgtgtcgacgagcagcccctgtagctgttcaaggcggccggatgctggttcccaaagtgattcttgcccatttcacacaaataaaaaagaagaaggtaaagatcatgcatacaaattaactgaaaaaacataattaccatgcattatatgatgcactgtcttcattgtaaagcactaaggcatatagatgatcccaattaagatgatacttttccttgataaaagatcagtttcccctcaaatgtctctctaaaagaaaataaagatcaccaggttttagagataagattcatttcaggttacagcgcagctgataacggcagctagaataatggcagttgctgctgatgactctacatgtgtatttagggataaaaacggatcggatattttcttgaccgttcagccgtttctaccaaatatggcaagtattttttctaacaccaggaatattaaattaaataggatatgcttttatcttaaaaacgggtgaatgggttacctaatacttttttaggttatctaaaactcgtactattatctaaaaccgatattcggattaacagatttctagattatatcaccatactacatgaccgaatctcacaccatcatagtctaggatttttttagacttataagctaacttataagataaaaagtctactcctaaccaacaaagcaagttttttgtttggttttttttaaagccatataaaccaaaagctccatcattttcttcaacagaatgcattaattgtcctgcgatctcattgttgaagaagcttttttggtttacgtgatcaaagtggaggtatgactcaagcattaaataattaaaatattaggactttaaataatcgaccggcttataaaacatataagccaaaaggttgacttgaaaagccaagccaataaatctaagcccaaataaagagagcctaagcaagtagcttattgctctttttaacttccgaggccctccaagcacgtggatgggagcataactggcatcattatttaatgcatgccggcctatccgataatttcgacatgttcataaatcgagctgttccactcccatatcatttccgacatccgtgtatatatccaaaagtgtacggtgtaagatatagtatgattataaccgtacgtctaagtacactatgtttttatccctacatatattgatggatgctatcttcctaaaactagctactacccttgtcctaaaaagatttatttttctagatgagtttccatagttacgtttccacattttgtgtagaaaagtgaactcctttttgaaacagagacaacaccagaaatagtaataatatatcagtatatatggagatgatttatcccgtcatgatatcattctagccttagctagctttgcagataaaatggatatggattactccaaatcaaaatggttctttggcatcattaaatctatctcagaaatttatactgcatcaatgcactccaacctaaaactaatctcatttcccccattttttttctttttcgcttttccagacgaccaaacgagacgcacgcatagcgtctctcgtcacgagaaaaaccaaaacgacagtaaagagcgctcgcgtcatcactgacataagggcccccacccccctggttggcccctagtgtcattgacctagtcagatggacttcctgacctcggagaccgcacacgcgacccgacccgcgcctctcgctgaccgccctggcccacgccacccgtggggcccacacgtcagcaactcaccccgcccccacacccctcctccacagctgtcgcgtgccaaacagagagacggaactcttcctctcgccgaccggtgggacctcccgaccggctcaccgacccaccgcggtcgctgacagtggggcccacatcctcgcgtaccccacctgtcggtgagtgtggcgtgcgtggccaccggtggcggcgcagggcgtcactgagggtgaggcgctcgcgcttgcggttgtagcatataaagcacgccgcgttcacatcgtcgtagtgccaaatctaccaactcttctcccctccccctcctcgcgatctcgcgctctcgacctcgtcgccgccgccgatcgccgccgccgcagccgcagccggacggagagtcggagaccgtatggaggtgatgggagcggaggaggcgaggacttcgagggtggtggtggcggcggcggggcgcagcctcaacccgaacgcgaaggagttcgtgccgcggtggcaccgccacgccgccgccgccgacgacgacgacgccgccaggaggacgaagctctccgcggacgcgccggagttcgtctacgaggggttctggcgaggcgttgatggtctcaccggctacggctacggctacggcgacggccacgacggcgcgccggaggagctcgtcgtcgtcgtctcggagcgcctcaacccggacgcgccggagttcaccgccgccgcctcgatccgccggagaagatcgccggggagcgggaatggcatctcctccacccgccactggagtgtaagcaagagccgcttcttgcactccgtaatttcttccttcgatctctttcagatcacaaatcgtcgatgaaacttgattttggtttcgatttcgatttctcgtttcaatcgtgttcgtatgattttgatttcgatttcgatttcgattatttctcgtttcaatcttgttcgtggcgtcttggtttacagttttttgggtttacgctttccttttcgggtggcggtagttgcatgtgttgaaaatcagggcgaagaggcgcagatcggtgggggagggggtttatgtttttggtatagggatagcgtcagatcgaggtggttgcttatttactgtgagctgcaagaaagacaagagggagttgttgcatgctttgagtgtctctctctttgtacatttgaatacaaggagggtttatcatctattattgaagacaagaaaaggaaaattctatgcatacgtactaaattttgttttactaaactcttactaacatcaacgtgttacgctgtgag

SEQ ID NO: 64892 - DNA, 658 bp, Oryza sativa
catcaccagaaagtgaagaaccccattttcaccttcactgaacacatgctaatttttcacctccactgaacacatgctaaataagggtggcaatcaaatttgctgagggttggcggcctaccaggacggctgtatggcccgtcactggctggaaagaagcagctgattctagcttctcccatgttaacctcctctttgattccagtgaagcttgcctttcttcgtcctccttgtacttgaccaggcacgccgaaaagagcacgtcatccatctcagaaaacatcttctttacattatctgtgagattcaggacagcttggttccaatgattctggctattatgttccaatgctggaacaatgataggcatgatcatttggcggttttgtgcaatcaagctaataacgttatcgttgttccatatgaaaagcgcccgttcagcaacctgaaaaaacccatctcgttgaggcaattacttggataaaaagcattagtctgtcatggcagacaaatgtcttcaattcttaatgctggtccaaatatctcacatttgtgatattaacagtacagagcaaccccatgcccaaagcatgattagttgataacataatggcccactattgttgtccacatttatttcggaccatcagacatctat

SEQ ID NO: 64893 - DNA, 1769 bp, Oryza sativa
tacagaaaagaatgtatgatttggagaaaaagtctgacacaagtgaatctgtctagttatttgaattgcaaagttggctccttagcgaagccccaagcggtaaccaaattcctcatgtgacataacacatggcctgatggttaaggaaaagtgcccttttcattttttgagtgttataatatatgttcttttccccctctataacactacatcaaggttggcacactgataactattgctgcaatgaacacaaaagaaagccgcctattcatatggtaaactggctactactgctgattaacatgtgtagcctttctacctatattataaggattggtaggagttttctatgtgaccacaatccattttgctatatagagtatggtgattaagtccagtaccaatatatactgtattagtcctactgatcagtgatcaccacttttctacccaagataacaagaaatcagtatatatgtgtaaatattagtgctcatggagaagcagttcagattgatataagatgtgcacttacattccgatttgtcggacaaggtccagtagtataataacaccgcatatggctcatccgttgggagctctgcttttgtagtgctcctgctgcctgggttacacatgaaataattcgaacccctccttggttcctgcactggttgtatgattggctccatgaccagcttaagctgctccttgcgccactcttccctcttctgaatttcctcctcagttggaaacttgggtacatatggctctgaaaccttcgcccaatcagattcctcaggagattcaaacaacaagctgtactcgccttctccttcccctccccctgatagtgtcccaggtagagataacgcattaagcctcaactcctcgttttcttgctgcttctgctgatacagaagtccctgatcttcctctgcttctaatgcaaagatggcactgagtcccaaatcatgtcttctctttctgtcattgcggcatttagccggcaaagcttcctattgagctgaacaagcaaacttgaacacgatattgggttgttatcatcgaccctccattctagaatttggtgtgtccagctctctgctgaggtgcagggcaggaatgtgcagttgtcgtcatcatctccgctatggatgcccaccgtgattccactccacccagtaagaatgatgccatcgttgagccgtattggtacattgtctactaggaacttgaaactcaaaatctgatccacctgtgtgtgttcttgcggcaacaccgatagcattgccacaggtctcaacgtctctatatagcttctttgttctgtgaagccaatggtctctgggtccgaatagccttccacaaatcctactacttgaagcttcatcgtcgtcaatggcagaataaacctgccatcgcaggcaagcctccggcgcatgacgcgaggacattcctgctccacaaagttgcagcgaacctccccatcagtgcccattgaagtttgaaccttcggtgcatcgcttcacaaggcgattcccactgcatctccccatggcctagagggatgcaggcaagaggcatcatctccagctcctccctttccctgttcagctcttcttgcttcctcttctcctgctcttgtttctcctgaagcaccatctttttttgctcctcttgttcatcatctggtagagagtcctggccagatcctccaatgcggccgtaatgttgatgaaatcatggccgaccctagcatacaactt

SEQ ID NO: 64894 - DNA, 27281 bp, Oryza sativa
tcattccacactgaatccagcaccgaagcatatcaaatagatgtgatggtcatccaatgcaaatggttcagccatggttttatcatcctggtagcaatgaagatatcaacttgttcggtccaaattgcaggtttttattgaaaaatacaggtactatttcaatagtaaaaaaggcatagttctttaatgccgagatgacaccagctagaaaaatatccagcatgtgcacagaaggttaaataagtttaagcactaaaaaaagctggagttttaaaaattaagaaatcttgctgaattcacttgccttcatggcctcgtttattagttcttcatttgtcagttttagatcaaaagtcattttctggaaaacctgagacaatatcataacatctcgcattgctctatgcgcatcgtcatgcgagacgatgccatagtgttctctcagtgcctccaagcttgtacgacgttttttccctgcaacagaatagtaacaatatgtaacttcggctagttattattaaatgaatagaccaaatagcacagatagggaacctaattgagaaatgaaaacagtaaggcagaacaaaataaaatgagatgtgtccctaactgggccccaacatatgtacagctccaagctactgctcctaactaggacaatatatcagcatttcacttttctgttaatcctcattatgacatacactcaaagcagtacatacgggaacttccagaaaagaataatatgttcgcttttcgacaaacaatacaatgtcatataaaaacctcaagaacggtcagcaaattccaagaactacggatttgctaatagcagaaacatggaaactgagttgtactactaaaccatacacaacatcctaacagaagcactctttttgcatggttaaaagatgaagtgtgggtttcatcttactcaatatgctcctggcaagcagatagtgagtcgtaattaaatgaagaatctagcttaaaaggatgaagatagtgagaatgacacactccaaaatgctgcgagaagtgtgtcctttttttcgcatgctcaaatcaaattgaccccaaaatatacagtatcttcacatgcaaaagacttagagtgagagtacttaccctctgctttcaccatcttttttgccaagagaagggtgtcaaaaaacagccaatctgcaggaagtggtgctgaacaacgatcaaactcctgagcaaggaaacgagcatcaaattgttttgcgttatgagcaacccacagaactggcttgccaggagcttggcgacttcgaacgaatgccaatagtagtgggattacatcactaaacctgtggtagtcatattaagataacattcagaataagtgaaatagtaaattaactgttggtgaagtgagatatgcataaccagttttccattgcaaaaactaacttattcctacaagcaaataatttacaataaaacctgccttaatggcatgcatgcttgtgaaaaagagggaatacagagctattgcatacattttccataactaattcaatactatggtctgttcacagcatcatgttgagtgacaaatacatcagggcatgttgacgacgactgttatcaagacatgtgatgaagagattaggaataatatggattcgttggatgcaaaacacaccttgggataccaggcctgcacacgagatcagtgccaattttaatgagatgttcaacgtagtcaggaacagtcctttcaggattaacaagagtttcaaaagtgctattctttcctccagaaagatcacagagtgcaaactcaactattctatgatccttatggaaatagccagtagtctcaagatcaaaaactagaatagttgctgccgccgcaacttccttcccatgttcctgtacttgtgttgtgaaatgtcgtttcccacagcttctaggatcaagcaattctacagttgataatccggcttgttgcttaagaaatctgacagggaagctactccatatactgttcctcagctgaatggatcgaagaatcgatgacattgtgcacaggaaatccacttaaaaccaatacgcagagccaaacctgtatacattgtcccacacaactaccatgtcagagtagatggcaagtaatcaacctcacagtgtttcgatatgaaatttaacctcccccccaaaagaagacttatcttccaaagtcaatacgttctaaacgtagcaaacgaaaggaactcacaagacaggataaattgcattaaaaaaagggtaaatttaaaaaacgatgttttcacgcgcagctgaacttccggaaggcatgaggcctgcgtgcgactcctgtcgacacacatcatccaatccagcaccccctatagttgagacaggcttgagcatttcacctcttaaaataaaatggactaatttttcagtttcacggaccaaccaggaagataggctcgcagctatgaactcccgcaacctcccccagcgagaaacaaataagaaatctgcaggttcagtacagccagtatccctcccagaaccctactcccaacagtcccaactccccccaaatctcctccccccgcaccctacccagatcatccaggcataacatcaccacgagagagagagagagagagagagagagagagagagagagagagagaggaaggaatggagtttaccagcgccgacatgagcgtacgacccccgccgagatgcccacgcacgccgccacctcccccgccgccgagggatttagctaggggtggctgcggtggtgaactgattgtgtcgcgcggcgcgtgatgcggcgagcgagacggggtggggtcagttaacagaggtggtgggggataacggcgcggaaaaaagtccatttgacaaccttaaaatatgccgcaactaattcctatccctaagcgagtaaactggatagtttctcgaagtattgaaaccagtgtaatttaactccccagcgattttggaggatggttttaacttctctagcagttttggagaacggtttttactgacgtggtggtgttgacctgattttcgtcccatgtgggggcttatgtggtattagaattaaaaaaaattatgtgggatccatttaccatcactctcaaaacatattgcaagacccccatcctctctctccaacccttcttcccttggcttctccccttatcctcatctagcatcggtgcagaggctgcgcgcggcggccaggcgaggcaacaacagcggcgacggtgatggtgtggagttggctcgccgatcccctccttccaacaaccatggacgacgaggaggagcatggcgcagcacggcgcggcgttgctgtctcccttgtcgatggccccatctctcttatcgggagccttccctcctctccgtccttcaccacccctcccccctcccagcggcggcggtggagaaggccgagtgaggcggcagtggcggtggaggaggctcgctacctctctctctctctctctctcccgaggacccttcctcctcctctccatccaccctccaccctctcttcactgtaagtgcggtggccgatgagttagcggtggcgcaagtttgggctcgcctgacagagcggataggatcaaggaaaagggtggggagctagagtaggaggctggtcgaggatggagtggagcagcgcaggggagcttggggtcatgctcccaagcagcaagggtctcccgcgacggagatggacaggagcatcgcgagcggcgtcactaagctcccaagcaacatggacgtgggacgtcgacaacgctaccgggtgatagagacagagtcggtggtgggagtcggatgtggggaagggtgacgaaaggggcacagagaggtgaggaaaactttggtggaagggccacagccgtcggtgaggaggcggcaacagagagtgacacgaattgcgttgcttggtatgtgaggaacctcacccacaatgacatcgtgaactcctcccacacgcgtgcttagttgggaagattctcctctgcgcgtgcccaactgacgactcctctcagagcacgacctcccagcgagatcctccccagcgcacgactggccagcgagctccttccccatgcgcagtctcctggtgaggtcccccctcacatgttgggataagggagagagagaggggggaggaagaggggttggagagagaggatggttgtgggtcccacaatatatttgagtgtgaatgacagatgggtcctacagatatttttgttaattctaatgccacataagtgtcacgtgggatgaagactagattaacaccgccacgtcagcaaaatcgccctccaaaacctctgagggagtcaaattgcactggtttcaatagttaaggagtcatctgatccagttttctagttaaggggtacgaattagagtggcctccttctgaagggagtcggagtagactttttcctaacggcgttgtgtgactgtgcggtggggcctttcgacctggtgagagatgggccgaatctaacggcccgttcctccgtggttttagtcaccgaaccccattacaaccggagtgtactgagtaagcacggcctgagtaagatatttgggccaacatttatgtgctaaatcttctttgggccaaggcctgattaaatttagttcctactactgtagcgagcaagcttgctttcttcagttttcgttgcagtataaactataagctgttaagttcgatcaaaatcaatcttacatttaagatccaaaccgatgtgatgttttgttaatcatccaaatcgaaatcgagacttatcgtcagctagattagaagctaagcgtggggctatacgctggcgttttcatcagttggttctgaaggttctttcagtatcaagtgtactgtctgcatcctgcagtgcagcagggaatagagttaacctctctctaattattcgtcctcctttttgcaaggatttttttctgtcttacagatgaactcgggtgaatccaaaagaaaccaaattgatcgatcgatcaagatcaagtacagtaattcagtccaactccaaccactgtgtattgccactccatttctacaattctacagatgcacaaatctctatttttctttcatttcgtcagacgtgacgcaaccttcacgagcaagcgtgtgttcgtcgtgcttgcataatgctctacttgtccacatcacactgccccgtcgttgctgccgtccttatcccccgtaggatgactgatccttgtcttctgacgaacagcaacaacaacgcatgcactgcactgagctgagctggatggattgtatatcctagtatgtagacccgtatctgatagtatattgagatgtgaaaggaatacttcatagaatctttgccccatggttaactattgcagcatcatggaatcacgatcctgtagagattagttgtcttttttacagagttcggtgtacaatctctgtaggtgcagtgctgtccgtaggagttggtggtatttgctgtcatcctgaagctttaaggtgttgtttggttcactcccaatcattgccaaacctccatgccaaacatagctaaatttgtggcttataaattgatgaccacaccttaggtaacttttggctaaaagatgggtgtatgacatgtgggcctttgaattgaaaaactttggcatgccacaactttggaagtgaaataaacgagtatcctagaaagtgtagcaaagtttggcaaagtgagggagtgaaccaaatagcccctaagtagtttcacaaaacagtggctgaaatacaaacatgtttatgaatcttggccctttttctctctgacttattcatccaattattaaatcatatttatttatcgcattattgaaacgggctatttgcgtcttcatgacgagagttttcgaagaaaatccgtaacatttttaccatggtaagcaaacaaagactatatcaaaactgctttggagcaaaactatgggctcttcctaagaacatttttttaatttctgttaccagttacaattgatgtttaattaatttgtgtaaaagaagcatatgctggcgcgagtatgtcgcatgattttttattttccttggcctatctggaagcaacatgtatgtgttattacaaaaggtaagatcagccaattacttctcagtagtgggtaagattaaccaattacttctcggtagtttctcactcttgtactccaactgggtgtgttagcctttctcttgtgacatggaaaattgtattcaaaagcttggaaacaattttctatatcaatttgatctgtagataagattccatgcacgcgcattgatggtgcagaaaagaatttttagttcgtgccaattcacagaaatgacaatgcaataaggcattcgggagcttggtactgtttgtttgttctttaggtgccagaaacaaagggcagaaatcaaaaacttgagatggtcactactatgtcctgtccttagcaaggaacatccatgtgcaagcgtgctgttcttgcagctgtccaaacaaaaattccaattcagagaggccactagcggcatatgcaacgaaccagcaatttaattattgtacttgtatagcataatttaccatgaaatctgaatgagaaaatttacccccctgtataagagcaaataatattttccgcattacttgtacaattttttttctcctgttatattcaataaaattagcacaatttagtgtcggttcattaaaaaaaagaatgagaaatttggggtcattaagacttaaaagaggtactaaaattttgtgtatggagatttttttttggtgtgctgggagtgtatgagacccgtccatcacttctaatctaataattaatttgacacctcctgttatctaggtactgaaaggtagcaatttttttcgccggcctagctagctagccgatgtattaaggaggagagggtttagaaactgtacagggatgtacaaacagagccaaaagccaaaagtctcacaccaaaagccaaaagtctcctactactttgggactgttcctcagttacaaaagagatagtaatagatagagaagcataaatacctccattatttgtagatgtcacttcacatcaaagaagaattcggcttaatctcatcttttagatgctagaagatccttgctgtgaatggctatcatcgcatatttgacacaaactgcaccaatgctttcttcattccattattagtccttagatatatcagacgtttgatacaacacgcacacatgcagatatgctgcctgcctgcctcgtcagaaattaggaacaaactctcctggtccttaaaatttactagcttcaaatttatcctaaaataaagttattttttttacctacacccatatcatctttcatttaattttttctatctactttatattcttaactaattacttccatcaaaaattctaactgttttattaataatttatataacaatataacgaaaagcttacattttaggacggagggaatatccgtttgatgcacaacacaggacagcagcacagcaaccatctgagcctttaaataccccacaccacgagacctcccctgctccgctccaagacactcgcacgcagacatcacatccattccaggctcgatcgcttcgatccctttgcctgagaccgagtaagccatttctccctctgatcctcctgtgaaaatttctcctaacctttgtgattgtttgcctggtttctcttttattcttgcatgtgttgtttcagtttcttgtagcgtgattcttggagataatttacaaggatgagggttttctgttatttcttcccgaatctttgggatcagtcagatctgttctttttcactgtacagttcatcagtaatactgttggagcttcgattggaatcaaagtttagattctgcaaaccattcttcttgattgcatggcttcatttaatcatgcttcttctttttcttcagtttttttaaactgtactgtactagaggcagttagagtataactgttaatggatgaacttggtggctgaacttctaatggtgatgacttgagcagagaaatggagctaatcacaaacgtctccgagtatgagcagcttgcaaagcagaagctgccgaagatgatctacgactactacgcctctggtgcagaagatcaatggactctcaaggagaacagggaggccttctcaagaattctgtaagctaccttccaaaatagtaggctttatctctagaaaatatattagacttttagctagctgtttctatctggtagcacactgctggatgaactgtgtttgttttatttacatcagcagataataattgagcttaaagtagtgcaattgaaaagttcttggaaatatttttttcaaaaggatcccagttccatattttttttgatgtctcatgaaaagatagatgatagatatggccagaggcgtctccaatcctagtggaaagcttacaagtccgtgattataattaactttcggattttttcaagtttctgacaaggtttgagtgtaagtggatcagtttgcctttgattaatgtaatgacatggcggccaaagtggacaaacaacattgagtagaggacaaagatcagacgtgtcttgtgacatgtggtttgtatggtcaaagtagatgacagtttcattaagaattctcatacaaagatagtactacatgacaacattacttcttctcggtttcaaaaaaacaacattacttctgcatgtgaagatatagatcatctgcaaggctccagctcattgtagaaaactaggcttgcattcgtttcttttagacttgaaatatttctcttcaaactttgctgctcccagtttctatagctatcctggatatatactgtcatactgatgctcatgctagatgagaaatactctagctcagaaaaaaaaacacgaatattaaggaaggatctaatataaaataaatagaaggagtgaggtttcgaacccaggccggctagtccaccaccttgtggctctagctcagaaaacgtctgttgacaaaatagtcatactgcattatcttcaatcggatacaaggaagtctcgcacacgtgatatatttgaatatgaaaggtattgatcacaagattcttgaactttactttacccttccctgaaaaatggttccaggtttcgaccgcgaatactgattgatgtatcccgtatcaacatggctacaaatgtcttgggcttcaacatttccatgcccataatgattgctccctcagccatgcagaaaatggcccaccccgaaggtttatccaagttgcattcacctaattctttcctctttattttttttttcaaagcaatgtttctcatggagatgtttatctgacatgcaggagagcttgctactgcaagagcagcttctgctgcaggaacaataatggtttgagagatatccaaaagcttgttatgttttttttggtctcaaaatgattaattcagtgttctgatgctatggctcaacattatgttttttttttcagacattgtcttcatggtccacttctagtgttgaagaggttaattcagcagcgccggggatacgtttcttccaactctatgtatatatttttcttcaaaaatacttaagatgtaatgaggagcagtgttttcagtttctaaaccttagctgagttacctctgtctttactaggtttacaaggataggaatatagtacggcaacttgtcagaagggctgaattggctggttttaaggcgattgcactcactgtcgacactccaaggcttggtcgcagggaagctgacatcaagaacaggtcctaatctagcaactctgtacacaattactgtatgctttaccacgttccatactgtcatttcatcaggggctttacagtcttaagtatgtattctgaatttccgatgtcttgcagattcaacttacctccacatctggtattgaagaattttgaagcgctggatctcggcaagatggacaaggtttatctaaaactgaacccttatgcatctatatatgaacaaaattttcttatattcttaaatgtgttttatgtttttattcagacaaatgattctggccttgcttcctatgttgctagccaagttgaccgctctctgtcttggacggtatatgcttcgataccatccttagttttgtgcaccaaacaatgaatcagaaactgggatactgtcctggttcttctggcacttctctgtggcaatgagatgctgatgctactgatgcacaatgcaggacgtgaagtggctacagacaatcacctcgttgccgatcttagtgaaaggagtcatgactgcagaagatagtaagtgcagtttcagagttctggttgctcattgttcattgttatggcatgccatggtctgatggctgatgatcacatgaatttggtgcaaaatgcagctaggcttgctgtcgaaagtggcgcggccggtatcatcgtgtccaaccatggagctcgccagctagattatgttcctgcaactatcagctgcctggaagaggtatatgctattaattgctaacccagctactgtcataaaatgcacttgtaaacatcttcagaggaatcttcagtgcaactgacatattcagaaattctagcaagaaacttccctgaacttccatgatctatactgaaagtgtcgagcaaactcaggtcgtcagggaggcaaaggggcggctgccggtgttcctcgacggcggcgtccgccgtggcacggacgtgttcaaggccctggcgctgggagcttcaggagtatttgtttgtccccagagcctgcattttcaatcaagttagtacagtaccatctgaatttacagcccgcttaacgccatgagcatttgggtgttcgtcagattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgtagcagggaatttgtcactgttgctgtcgttggcagggaatttggtgattcagagtagtttgtgttggaaaaaggaaaatctgtccaattctgtctcgacactgactgtgatgctttgcatcgtcatttgtcgtggacgaaacgaagcttttgcctctgttcatgatttttttaaccttttttattttaaaatttaaagataaacccttccaaaacttatttccaaaatataaaccttctcatcacatcagccagagtaacgtggccaaataacgctgccatgtcagcgagattggcgtgacaatattgttttgccacatcagttcagctagcatggtcaaaatgttcggattttgaaaataagtttgtgtagggtctatttttaaaattgaaaattaaaggttaaaaagattaaaaaaaattctctgttcatagctcaggaaatcgtttgctctctgataaatgggccccaggcccactgtcagtttcacatacactcctccccagtcacctacgaattccgccagcggcagtggcggcggcggcgctcctcgccgccggccgctcgccgcctcaccgatgccgttcccgcgcctccccgcggtgtaggtccagttcctagcagccagcgcttgctgcctgctggcctttcaactgcctccaaggctccaaccctagcgcggcgccatcatcatcccaatcgtccgctacagcctacaaatcgcggtgatggtcgcgtcagcgtcgcaagctaccgaactagcgccgcttcgtcgtcctgccgctgcggcttgcagggagagacagcgagagctgtgctgatgaagtgatgaaacttgtgggcttgcggcttccaggaccaaactgcaggtaccagcaccaatttttattccaagaacacgcgtgatactctcctctagtaaaatacttcagatatcagtcaatctttggtgtcttgctgatggggaaaatctgattcttgaatacaaaattagtacacaagtaaagatccttcctacctccaagatattctcccctgtcactgtcggtagatcaccactctcttcctcatccacacagatgaacacaaagaggaaagagcataaaaaagccccccaattcctccttccagttcaagagtacaagaaagacacaagcacagacaaaattcctgagccctgccccccgttgcttagtaaacagtgagtcctcttgctgatctatcgtgcagaaattccaaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtgtcctttgtggataaatgatgttaggtttcagccggttgtattggttgatgtgtcctgtatcgacatgtctatgagtgtcttaggctacaatatttccatgcccattatgattgctcctacggctttgcacaaattggcacatcctgaaggttctggtttgctacctttatatctttcttttggcaatcgcatatttcaatgagaagttcctttagggatatttatctggaatgcaggagagcttgctactgccagagctgcagctgctgcagaaactataatggtttgaaagatcgtaacaaattttatgcattttgatatctacgtctgacacattgattcaccaactagtcatattttcagacattgtcttcatggtcatcttgtagtattgaagaggttaatttggcagggcctggagttcgtttcttccaactttcagtattacactattttctttcttagattcttcacctttcttctttaggatttatgctcccttacttcttatcaatgtcttgttcagatatacaaggacaggaacttagtgcaacagcttatccaaagggctgaaaaggctggctataaggcaattgtactgactgttgatgctccatggcttggtcgcagggaagctgatgtcaagaacaggtcctcatcgtgcaaccgtagtgtttgacttgtgcattatgcattatttaatgaaaatctgtaccctgcatcaatatccttttcttaaaggcacctttattgaaagaagaaactccaccgcaaactcattatctgcattatactttacattacattctaggttcaccttgcctcaaaatgtcatgttgaagatctttgaggggctggatcaagggaagatagatgaggttgtctaaaaactagtgccattgtgtgaagtagtcatgattctgtttaacaatgccctgaatcattctatttatctgatgtttcagacgaatggttctggtcttgctgcctatgtcgctagccagattgaccgctctttttcttggaaggtattgcagtgacactatgacttgtaatttccagataacaaccagttaatatgaaagattttaaccatcagaacaatgtcatatctcagacaattcttaatgtgaatgaaaccgtgtgatgttgatgactcatcctacaatacaggatatcaagtggttacagacagttacatcattgccggtcttagtgaaaggaattataacagcacaagacagtatgtcctttgctttcaattaccttgtgtaactacatgcctcattatccaagctgcagatctcacaagacatttacaaaaatgcagctagaattgctatagaatacggtgcagctggtatcatcatgtccaaccatggcggccgccagctagactatcttcctgcaaccatcagctgtctagaagagctatgccatatgtaactctcttttcaatcttaatgaaatttggtcggctccttcaccgactcagcaatcagctgtgtagaagaggtatgccattgataacccaatctgcacttcagcttattgtgcttttaaacacattttaactgaaaacagcacgaatctcaggttgtcagggaagcaaatgggcgtgtgccggtgttcatcgacagcggttttcgccgcggcaccgacgtgttcaaggccctggcattgggagcttcaggggtatttgtaagtcccctagctagctactgcttgaatgaaagatgatgctgaattgctcatgacacggcatctgcatacgcttcttgttctgtcagattggtaggccggtgctgttctccctcgccatcgacggcgaggccggcgtgaggaacgcgctgcggatgctgagagacgagctggagatcaccatggcgctcagcggctgcacgtcggtgaaggagatcacgcgcggccacgtcgtcaccgagagcgacaggatccgccgttgttctcggctgtagtgtacccaggtttcctttgcgtttgcgttcttgggagtgttttggctgactgtggaaaattctaatttgttttattgtgatgttttctgatctattatatcgaccctctcatggggtatatataggagtacataggggatagagacttggagtataatacaagtaagagtagatttatctctaggattctatctttaggactctatcttatctctaggagtcaatctctaggatatatcttatctctatatttgtatttgactcttatctctaactaacacattatatttctaacaaaagacatctttgcagattgcaattgatgtgattctgtaactttgcgttcattgtcagatggagatggttgtgtttttttagaaacttagtacaatcaggcatgtggagaatggtaagtatttagaaacacaattcaaacataggcgttcataaccgcgtacgtataacatactcacctatatgaacacatacacatggagaatgacaagttttttaaaaacaaaattcaaacgtgggcattcataacgtatgcacacacataccctattatactgaaaaaaataattagtcgtagaggcgagcatctgtacatcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtaatcccccatccaatttctctctacttttcctcggatttgcgccgcactcccgatcgatgtcttcgacgcggttaactgcgatggatttgcgcgagatcggatcctatggtctagaatttcgagtcgattaggcttttttttgggtggtgttttgcgttgggtgatttcagattggaagtagaacggggggacgaggattctgagaagaatctactggtctttgtcgtactgaatgctctcgatttcctcctgttttgatcgcgtctgtgtggtttggtctggtcaggtggtgctgcaaccagatccgtttctgagcgagttgacgagcatgtacgagcggagcacggagaagggatctgtctgggtcaccatgaagcgatgtgagtgcgcgctttcatctggcaatctggtttgtgatttgggtggctgaagaactgatgcttgagttgatgggggttgtttgatatgtgcagcatcgatgaagtgccaggcaaggttgaagaagatggcggcgaagggagaggcagtggagtaccggtgcctcgtccgtgccaccgatggcaagaagaacatctgcaccgcggtacagtgactgtcctattgtcctttgctgtgctgattttgaattattattttgcttatggttgttagttttgtgcataatggttaccgattatctggtattcgatgctaattatgccaccaggcggtaagtgaggaatgtgaatatgacattaggcgcttttggtattgcactaaaacctctcggatatgaaatttcggtactgagccagtttatttggtattcaagtcagcaaggtatattgttttaagagatagataaaagtatggaactgtagaagtgctgcaataagtatgatccaaactgtgaactgtatatatagtgaacatatattgtagattggtctatgtagaagatatacagtacgttggtttcttgcttaagcttctcacaagcatcctttcgcggtaacatgtgtaggcactcgtgaagcatgatcataaacagcgaggtaccgtagaatcagatgcttactcataggacatcttaactcgcatcctattgaagtagaatgtgtaacataatcataagttggaacagactatactatcacatgcttagttgtagcatggtaaattgataataaacatgaatgaactttgttcaatagacaaactagccaagaaaacgtttagtgccattcatggtgttaatattgcatgtttgcctgccctacactaccgcagtctcattttcatcctatgctaagataactctcaagttggtgtagatattgagtatgaaactcatttgtgtgctcttgccaagttttgattgcattaagtagtgaggtttctcattaattgcaccatcttgcattttctgaaagcgtcatcaagttgtttgagcttaaatttatatggtgaaagtattgtttctaatgataagactgtagtatcgatgggcatccactggccactttttcccatgtgattaatctttaccaccaaacagttgggtcgataatctttttccacaagagtaagaacgccatgataagttcagagtcccaagatctatgttctgaacagtttattttctcctctaccctatatgtggtgaaaattcacatggtgatgtgaggtattccatatgaaggctaaaaagttggtgattatatctcccatgctgttcatgtagatacagaataatagctggtttggaaccatgtgtgtccatatctatttgtccctgctaaattacatttgtcaaagctcgcccaatggagcatttatttgcccctgctattgcaataatgcctcctaggggtcgatagtgcaattacgagctgaggtaaactactatatttacttagatgttagtgatactatgtttttttccttcaatactatttataggacagtcatttgcaatacttttttttttgtaattttgatgaaaactggatatctgagttgactaattacatgttcgtagttttgatgaaataatggatatttgaactgattaatgatggatttattcatctttctgaagccataaacattagccatacttatttgagatgcgtaaattattctcctgtcacttccttagctttttgggctacccaataagtctaacttaaaaagctcgccatgtctttcagctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctggatgtctgtgttccttcaattttgtttttctggttggggagaaaaagtgtgaaggtatgtctgtgtcacgattcccacatgcaagtggtgatcagaatataagcagattccatgtttaggttggtgcataagcaaacggcgtactactatgggcctatttggtagagcttcaactctggattttagctctaggagttgggtctggagtggagttgtagagctgcctgaacctagctctatctctgagattttcacccttctattttaagtggagctgaggtgccaaacaggccctatctctcagcaattgctgcatcaacatggagcattggagggccgtatgcccgtatcctgtgtatgggcacagcattgtcggttcctagctatttgttctgccatcccccggtcccaactgattctcgtatcggtccagacaagtccaaaagctccaagctccagtttttacaccatttcgtttttctttaacacggttagaatttataaaccatatcatgtggtggtatttttgtccagagattcacctcagaagtggcgaattttttatcgtaccaaattgcagagacgaatctttgctgagtaggaggcagcaaccactatgagcagccgtcaccatccaaccggacaaaatcccatcaaaaaataaacccaaagaaatcaaaacaaaagcgagcacccaccgatgatcactcactgatctctcatcaccaaacgcctccgacctcgctcgcgtcgcgcgccgcgcacccatccccccggcctcgccaccacccactcccgatcgcccccgtcgccacccaccccctcagaaatctcatcttttccgcctcctctcgccaaccaaacccgcgaaacccccacaaacgacggtggtgaaagaagatgagagggctactcgcgtgcgccacgctcgcccgccgcgccgccggcgcgacgtcgacggcgcggcggcacctggcgggcgcggccgaggcggcggaggcggagctgaagaagacggcgctgtacgacttccacgtcgcgcacggcgggaagatggtgccgttcgccgggtggagcatgcccatccagtacaaggacaccatcatggactccaccctcaactgccgcgccaacggcagcctcttcgacgtctcccacatgtgcggcctcagcctccacggccgccaggccatccccttcctcgagtccctcgtcgtcgccgacgtcgcggcgctcaaggacggcaccgggacgctcaccgtcttcaccaacgaccgcggcggcgccatcgacgactccgtcgttaccaaggtcaccgaccagcacatctacctcgtcgtcaacgccgggtgcagggacaaggatctcgcccacattggggagcacatggaggccttcaacaagaagggcggcgacgtcaagtggcacgtccacgatgagcgctcgcttcttgcattgcaggtgagcggtttctgtttcttgccctctttcatctggggaatctgttggtgattttagtttgcttaattgattgcctcaattgattatacatttcggaaagggatttagcaattgattatttctgggatttgggaatgtcatgctttgagatgagtagtcaatacatggataaaaggtccattcctgtcagatataaggtgggatgtgtagtcactagttagtggatgatggtaagcgaagaaagattcgcttcatatgaagtagtaattttcttgcctacttgaagaaaaactacatatcgtttttattagctggaggattagagaatataagctgttaggcttgtttctttctgcagttttatttgttatattgtcaacgcagggtagaagataaggcttttttcccaggatgcacaatgccttgatgtgcatatgagcaataggtagtaaggcagatgtttgaattttgatggcgtgttggtggaaacatgcggtgacttattatttgttgtttaatgtttagtggcattttcatgatcagtaaatttgatttctggttgtcaaacaatagttctttgctaaatcattattttatttgttatagtgcttttttggaactgactatatattgatttgttgaggtagtggttgagcaagtttgtgtgtccttttcttggttggtggaagtaaagcttcttctagtcctgtgggtttatttttagtgtaatacagaagtgtctaggccatattgtcacaaaacaaactttaagtttcctatgcaatcacgatacaatacacataacctggtttcccttctatagcaactaatttcatcaagaaagaggcagatggatgtctgtgcaaatgtatattcatggatagaaacattgcgcgacatattttgtactttcaaattttcatgcaagattgctgcagaacttgtccctcaattcctactccctcagcctttgtggggttttatcatagtgatcagctttcactattacagcacgtagaaatttaatttttcctgacggcattacttgtttttcacacgaacagggacctcttgctgcaccaactctccagttgctgacaaaagaagatttaagcaaaatgtatttcagtgacttcaagatgattgacatcaatggatatgcttgctttctcaccagaactgggtatgcttcatttgatcctttagccaagttgttaacaaccatgctactacctttgttttgtggaattattttgaacactatgtcaatattctgagaatttcttacagttataccggtgaagatgggtttgaaatctctgttccatcagagaatgcagttgatcttgcaaaggccctcctggagaaatctgaaggcaaggtgagactgactggtttaggtgcccgtgacagtctccgcttggaggctggcctctgcctgtacggcaacgacatggagcaacacatcacaccagttgaggctggtctctcatgggcaattggcaagaggaggaaagcagaaggcggcttcctgggagcagatgtgatcctcaagcagctccaggaaggcccaaagatcaggcgtgtcggtctcctctcgcaaggaccgcctcctcggagtcatagtgagattgtgagcaactccggggagaacattggtgaggttaccagtggagggttcagcccctgcttgaagaagaacatcgccatgggctacgtaaaatccggtttgcacaaggctgggacagagttcaaggttgtcgtccgtgggaagtcctacgatgccgtcgtcaccaagatgccgttcgtgccgaccaagtactacaaaccctcatagatttgtacaaaggatgctccttcggttgaaattttctcatgcaactctcttgtcgctgcttgttctgcagcaccgcaactgtaacttctgtaaggtctcatcttacagcttgacattttacctctgcccatctaataatatgaaatgtgatatgcagtatggatcctttcccacaggtaacccatattttgtcttcagaactggttgtctgcgttggcagttgcaaggccaataggccatgttccccgtctgcaacagatgtcgcagaaagcaaattcagcatctatttgcctcctgtgtttgtctataaactcagatgttcttcaagaaaagaacacttgatagccaaacattaaggaaatcgagacctgtagttccttgatgcaaaagagaataagaaatgtagagagaaaacaaccatgaacttgcagaaaaacagtggacacggttccaattcatagatctgggtgattctgcgtcagcatgataattccacttcagcgagaggctgaagaagctctagggaagaagctgctgaactgttgcgaccgggcctactggtgatggcaccacaggtcagtgaagcaagccatcggtttaaaggggctgtttagttcatgaaaagaaaatttttgggtgtcacatcagatctttgaccagatgtcggaagggctttttggacacgaatgaaaaaaataatttcataacccgtctagaaactgcgagacgaatcttttgagcctaattaatccatcattagcacatgtgggttactgtagcacttatagctaatcatgaactaattaggcttaaaagatttgtctcgcgatttcccccctaactatgtaattagtttttttatttatctatatttaatgcttcatgcatgtgttcaaagatgtgatgtgatgtttttaggaaaaaaatttggggtactaaacagggcctaaggtttaccttcctcttcgtctactgtccgattaaacttaggcggctgagattgagggagaaccagaggtaaaggtgtctttgcattgggaccctcatacaataccgtattgctttacactactaggtccccaaaaagttggatgtccaaatgtcgttctcgccatataccgtccgatctcacataggcggtggatattatgttgggggactcggagtaacgtggcggtgacttttcatagcaactctcgtactgcactgtatgcgtagagcataaaagttggatagctaccaacggtagcgatccagattgccttcaacatgaacaccccacctcacgcagtcacgctcacgagctcacagcaatttgggttgttaagttgtttgggggattgggatcctctgtcgtagcatgtaatacaacagatagttatagtatattgtatatagtatatagtagtccctcctttcctaaatgtttaacgtcgttgattttttaaacatgtttgaccgttcgtcttattcaaaaaatttaagcaattattaattcttttcctaccatttgattcattgctaaatatacttttatgtatacatatagctttacatatttcacaaaagtttttgaataaaacgaacggtcaaacatatttaaaaaagtcaacggcgtcaaacatttagggaatgagggagtattagaggtattgtgtatttttgaatgtgattatagatggccatatggcatgaggcccatggcccggtccaaggcacgccaatttggcccggcccaagtacggcacggcccgacagccagaccatgcttgggccgctcccttggcacggtgggctggcccggcacgtcactgatcgaaaaaaatagtagaggaacgtaaaatagacttaattaaccatataaggcgaggcccaaagacatgaggaatacaaatagacttatttccaactatatgtgcataacccacagagtttagggagcaaaaatatacttattctgtggagtaaagtgctactattcttttcttttcagaaaaaaaactgtgtttattaatcaaggacaattacatgagttacattttctagtgggtaaagttgagagaatagctagttttacataaaagcccctaagtgatgggtaaatacacttcaagaataacatatacgaaaaaaagacctacaaagataaaataaaaagcaatcaaatccttgcaacaaccacataggcgatggcaagatcctcgcagacgacgacggcaggagcaaaagaaacatgtttagttgcaatgggtagagccaaggagcatacccgaacgaggcctcttgatagaggttgaagccaccttggcccataggagaaatcatcagccacattttgcaaaacaaccgtcagagacgaattagacaaccactataagtatgtgagacttgctgaatatggagtaaacaaccgatgcaaccttttgttagacatgctagaggacaagctttcaacccaaagcaaaactcccaattgaaagcattggaggtgaacccaacattcactaggcagaaagatgacgctagcaagaacgtcaatgaggttcgccatgtccatcaagctgagacataaaaatcgaacgtcggtgaccctcttgaggtacacaaagaatgggatgaacccgagaacgaaaaagatctgactaaacctaaacctatctctagtagtgggaggaaggaaccagaaccctctctcctccacccacacacacaccacacgatgaccagaaggccaccggagaaggaaggaaatgggcaagtagtcgagttttttctgcttaagacacctagagcttttaaggcgaagggatcaaagtgctactactttactgcatttattcactgttctcctcgcatcaacaatccccctctaggttactatagaggaaccggatcattgtttaggcgagacgattcttcccctcccgggaagaaccgaagaagcgcgctctttcaacgccgcactgtcactatcagagctagggatggcaatcgggcgctgcgggcacgggtatgggtaggtgtgcccatgagattatttgtgcctgtgggtatacccattattacatgacgggtaaggatggttgcccatgcccatcgcccgcgggcgccttgtgcccgcggtcatgcccgtttacccaccacaacaaaagcagtggaacaaaaagtctacaagcttctaagttcgaatcgaacttaaaacatcaaatattctccgcctcggtgtggtatctctcctctggcggcgatagagtaagggggagagaaataataagggaaataaaagggaaaccgtagaaaacaaagaacgtggcttatgtattctagtggattttgctcttagcctacatataagttagattttgcgggtaaacgggcaaagcgggcatgggtagtgattaccaatacccatgcccatttactcatcgggcatagcttttgacccaataagatacccatgggtataaaatagagaataaacctaaccctaatagagtttttacccacgagtaaacggacaaacgggcacaattgccatccctaatcagggcgggcaccccacgactcaggcccggggcatattcagatattctcgtgccaccggtacggtgtgccaccaagtctgccagctacacggaattgggcaaatagcgcgctgcagcccaggccaggcgcacagaccacgacgactcgaaggcaacagcggcggccgcgcctgacctcctgcgctagcctcaccaggccgcgcacgcgtgtggcgtcctcgtcaattccgcgagctcattggcacgcgtgtacgatctgtcgcgccaagctaggctgcaccacgccccgttgccgcggaagcctcacaactcacagcgcaggtaggtcgatcggttgggctccgtctctgcacaattagtcgtgcgcccacatgcacgcgacactactacctgcgatcgagccagtggtgtggccgctgccgcttgtgggcgatgcgtgcaactgcacccgcgggccgcggcgccgatgacccaagtctcgcttcgcgggcgcatgcacgatgatgcgactggttgcattgcgaggtgcgggtgtcagtggtgtgtgggcgatgcgtgcaagtgcaacctgccgcagacagccacagaggagggggggtctacaagctgcgcggccggcgcaggggagaggcagaggcaggatcgcggtccatcactccactcgtgagcacgagtacatgccatgcttgcttaattaccctgcctgacatcgttcactcgccgggggtccaaacgtacgcacgccgcctcccccggcccctgccaacttatgcttcgtgtcgggcaccaaactctacgattccggagtaaattttctgactaaagttactcggatatatatcaaccttaattttgcatcctctgttctgtttgttccaactgagtcatggtcaatgcaactcgagcacatatctcgtctgatgccatgttgcttccaacatgggaatattttcgattcctatcaaaattggaactatcttgttacagcatccctccttaaatataagagattttgattgaatgtgacacattctaatacaacgaatctagacataaagcctgtctaaattcgttgtacttggataaatcatattcaaccaaaatcatgtgtatttaggaacagaggaagtaatttcaagccgaattcaagaaaaccttaaccgcgaaacactagtaccgcttccaccacctctctcctggatttttcacattttggtccttttaaaaaacttatttcgcaaatagacccctgaaaaaacttatcccagaaatggtcctttttggggcgccagagtggctggcgccgtcttcaacaggacggcgccagcctctttggcgccgtccccctgccgacgtggcggggccatgctgaggtggctagggggag

SEQ ID NO: 64895 - DNA, 61136 bp, Oryza sativa
  unsure (1)..(61136): unsure at all n locations
acttcccaacttttaaactgtatacatccaacttagaatagtttaatgaattgatggtaaaaatatgttgcgattcttttgcaggacagtgtatcgagaaccacattatctactgttattttgtaatacctgcacattaaaaataccatctcaagggccatgataaaagaaaaaactcatccaaaaaaaatgtaacatctgccctttgtttctaatattttatggaaaagaacaaactaattacagaagtggtaaaatctaaatgctttctatgcagaaaataggtaacataaacatctaccgtccctctaataccgtgagactcatgttattattagagctgctggtattttcccctgtttgtttggtttcagaggccctatgtgcaaaatacacaggttgtattggagcgggaagtgctgcctgttcgttctccaacatgaaaacaacagaagacatgagtggcctactatttggattatcttgcacgcacaacaggcctatgtggatacatagtaaaacctcgttttttgagcaactctcagcaatggatgagtccaccaaatccatggtcttatcatccttccataatctccatgcctgaaccaatagaatagggtccatataaaatcagtacagttagtttgcattatattcctcccaatcttaatgaaatttggtcgccggttccttcggccgacccggcaaaaaaaaaagaaaaaaagtttgcattatatgaagatagatcatttcaccgtacttacataggccaacaagttgggaaaatccatcagctgaggtaagctaatcttcaaaccgcttacaatctccaagagtataacaccaaagctatatatgtcagacttgactgaaaagaccccatccattgcgtattcaggagacatgtaaccgctgcttaacagttttagcaataagtaacaaatattgtttcaggaaaggaaataaatatcattctaaacactaacacataaatcactcactatgttccaacaactcggttagtatttgcttcttgctggtttccgccaaagattcttgccataccaaaatccgatatcttaggactcatatccgcatccaacaagatgttgcttgttttgagatctctatgaattatagttaaccttgaatcttggtggagataaagaagtcctctagctactcctttgattatcttgaaccttgttggccaatcaagaataaatttacttgctggatctatcaacaatggtgaataatgctaattagtaagcattcagccaattatatctggatcatgtggtaagtttctgaacagtaccaaaaaggaagtgatccaagcttttgtttggtaagtattcataaataaggagcttttcatctccatgaatgcagcaaccaagaagcctaacaagatttttgtgctgcaatttggcaataaggaccacttcatttgtaaaatgctctaatccctgtgtggaacctgtactgagtcttttaaccgcaatttctttgccacctcccaacttgccctgtataataacatcattttagcatgataaaatgttgtaggtttctccactgttgcgtttgtctgtgtaaattgttaccttataaaccttgccgaaacctccttctccaagcatatttgaatcactaaaattgtttgttgcagtgacaacatcttcaaaattaatacatgggaattcctgattttgctcatatacttcatgagaagctctaaagtttcctagcatcgctctattctgattttcattatttctcttttcacctaataggaacatcaatatcataagtacaattacaggaggaaaacatgatatgagtcggtgttgagtattggctcctgctgtaccttttgatatccatttccagacaaggtatatgcacgtgagcattagcacgcatgctataatggggactacaaccttgactacatacctgctctttttatgacctattaagagaaatgaagaagctttcagaatttctaaccatagattgcaggtatatgcatggatgttgcttttaattggatgttcaggctatctaagatctttattgtcatttgtcaccacagggataaaaggtgggcatacctggagagtcggccaaccggaggtacaagttgtcaccaagattgttcctcgccatgtcaacaagctcaccaacccaaagcaagcaccttgactggctggctgtggtaccgggagagccggttatggtcaagttggtgtaagcataggccgtgcatgagcagtttcggctacactcagccgcgcactcctcaaagcttctgtcctggacataaaagaacttgtcagggagcttcattccaggcatggtcatgaaatggttcccttctccacatcttaattgttgctttctccggcatccacttgaagagttggagccgttaggctcaaatccatccgggcactggcatcttgggatgaccgacgtgaagtcacagtaaccgaatgggccacacgagccgtagggatcacaatcgccaatggctgctgggcgttgagaatagattgcccatgatgacgagttgacgttccaactcaggagcctgaaggtgcccgtgtagtcaagcatgatgcgcatgtatggtgagccatcagaggtggtgtagataacatagaactcatcctgtgtgtttacatatgtttggtacatgaaggaggtgctgctgccatatgctttgccggacacccacacactgtcaagcacaatggagcggtaatatggcttggtcccgtgccagacgaagacctgaaggtctgagctggggtctccgctgcatgagaagtcccccgttgttggatcatcaaggcccttccaagctacaagccgcatgcctacttgctccttgtacctcagcagaatcttcatgttcgacagaatggtgtcagttgggtgatcgaaactttgccatatggttacattgtttgacagccggagaaccaagtttcctgagtcgagcagcactgcataagctccgtcacctccggtgacatttgccattgtcgtccagacggtgcgacctttggaatctgacaatacaaggtcagaactattgctgatggcgagcatcgctgatgaaggtgtggtgattgggttgtcacggttagcaacccaaacgtatgttcgctctgggatgttgttataccatatgccgaggaataagctctggttggaagtggctggggagaagaaaccgagtgcaaagacgccgctcttggagacgagcttgccgctgggggagatcaatcgatttacctgtgtcagctgatcatcgcatttgcagaaagagatgagcagcaagtagatgagaactgggaggtaggccatattcatctggcccttgttcttcttttttggacaagcaaggcaggagctctgcaaaatcaaaattagattatgcgattaaaaagacacagagtcttacaaaagaagagcccgaggagaggcgaggcaactggaaaagaagatgtacatctgataaaaaggagaactgctctcgtagctcttgaaattaccaggctaagctctgctaagctctatctgatttaactcctgcacaattgggcagctacttttgcttctccctctggctttggtgttggaaattcttctgttccgttcctgccacaccaaccaccaaggttcttgcattcatcttccttttccttccatactttggctctaaatctcattaggtcttgttcttctgtttcctagttgccttcaaaaatgtaaatgtgaagaaatagagcatatgtatccaattatcagatgcatactagatgatttcccatagtcttagagcatggttggaccgaagaaagcaaacatacggccaagacatttctgtccttccagatcaggatgcacgcgcaaagcgaaaacgaagttcggatacgacgagaaaatcaacgagagcgaaaccgttatactgttatttttttttcctttttccttttttacctttcccgggacggcaaaagaacctggccagaacagtacaactgtaactaataaaacaaggctgccaacaagtacaatagatcctgttaaaaacggttacagcaaaaggagaaatctctagttaatttctgaaagtttactactccctccaggctgataatacttgtcgttttggataagggtgtagtcaaactttataatctttgattataaatcatttttaaaatatttgtcttttaaatatggtgactatatgtatagattagtcttaaaaagtactttaatataatcgtatatttgttaacaattttatacatattataatgaaaaataatggtcaaagttgttttttagagaccgtgcccttatccaaaacgaaaagtattatcaaaccggtatgaaacaaagaaatcagcaatcagggcgatttggccgtatcagtaataagtaaatggaatatatgttccgctcaaaaaaaaatagaaatcagcagtcaggcgagacgcaaaattccttcttgatcttctaacctccagactccagaggcgtattggattcagattggaagatttttgcattaacgttgtttccaaataagccagaagaccaaaatgatctgagagttgaacgcggcacgttgatgatctgcgtcatgacatcgacctcactccacgattaaccaaattccatttcatggcatcggtagcgctgtactaaccacccgtcagccaacaagtctatagttgacgagacctcatgggaagtcctagttacatacctcatttttcgttaagaaacattaaaaaaacaaaataacttagtacaggtagcttaacacaaaatagtttagagcaaatagctggcctacaatatatatgtttttttaaaacacagtataacgttcacacactcacctctataaacacatatttggaaaactgagacaacacatatgatttttgcacgggctattaaaatagattattttacatagaacaaatagcttagaataaatgatccaaactatttgaaaaaaaagaagatcgagcgtgggagtaaataacatgtgacaaaaattggtgaagaaaaaaaaaagaacaatctgtcgccgagacctattttcttccgtcaaaagccgaaaagataaactatcgctacaaaactgaactctcgatagagatcgagaaaagtcgacggcagcgaaacctcgcggcatatgcagatatgcttttgtccttgccatggcgaagtaatctcatgctcttgctcagcactcagcaggtggaataagttcactttaggtccctctatttgtcggttggtccgattttcgtctcttggccgcaaaaccggatacgacccattccccaacttacgaaaaccggacaaacgagatcccttggcagtatagaggacggtttttgccgacgtggcgcctacgtggcttatttaactagatcttcatcccacatagtgttaaggtggcgcttacgtggcaattttatcccanaaaaaaataaaaaccgtagaacccatatggctacatgtcagctacatataaaaataattaaaaaaggtggggccatgtggttccacatgtcagcctcctcctctctatcccctctctccctctcccttacgctgaaggagaaggacgagcggcggcgggcggtggacgttgctcctggccgcgggcgctaccgacgacatgggcgtggtggcgtcggggcggtggcagatggcggcggcggtggagacgtgcgacggcgccgtcagggagtgcgacgtggacgacgaggaggaggtggaggaaatggcgttgatgggggcggccgccgccgccgacggcggggagacgctgatgccgcggccgacgaactggtaggtgagctacgcggtgctggacgccaacaaggtgtcgtgcaataagcgcggtcagtcctactaccagaactgcgcctcacagaaggccggcaacccctaccgccgcggctgctccgccatcacccgatgcgctcgcaacaccaactgatctccctcttccttcgccggcgtcactgccgttgccggcggcggcaagtgaatacgctgctctcatatgtgtatgtacatatcgactctatccaaagcgtacgtgagcaactgctactgctgccaaaaaaaatcttcagtttctctctcagctcgatctatacaagccaaagtggtagcatgcattatattattggcctgaacctaagaatcttttaaagagtacagtaagtaacaaggcattcacatctttcctgtaaatggcgccctggaagtagagcagcgtcggccggtcatcgtagccggcggagtcgttggccagcgaagttggggacgacgtgccggtacggcgcgatgacgtccttgtcgaggccaacgacgctgggcgggtacctcccgaagtcgcagagcacgaagacgcatggccagagcttgtagcgcgcgtcgagcatcccgttggggtggtgcgcgagcacgacgtggtccctcccgccggacctccgccactcggggcgcgcggcgaggtaatcgagcagcctccgctgcaacgtgcgacaaccggtctccccggcggcggcgccggccgcccccatcaacgccatctgctccaccttctcctcatcgtccacgtcgcactccccgacggtgtcgtcacacgttgccgccgccaccgcggccattagggctgtcaaaaaagctcgagactcgcgagctgctcgagctcgactcgtcctaggctcgattcgagctcggctcgagctccaaacgagccgagcccgagctgtcccaaagctcgtgagctttgtcgagccgagctcgagcttctaacgagcctagtaatatatgattttttattgctatttaataaattggtagatcaaatatgttatttgtatgccttgtattagcatcgtatgtttattttattctttttcctcttatactaatatgataaacaataaattaaatttttttaaaaattatcctttgaaatatacattgttctaattaaaaatcgagctcgatagtcgagctcgagcttgatcgagctcaaacaggcttagttcgagcttatatcgagctcgagcataggcaggcaagctcgctcgagctcggctcgttgacagccctagcgccgatgtcgttggcggcgcccgcggagaccgggagcaaggccaccgtccgccaccgctcgcccttctccttgcaggcttgcagtgtatgggagagggagagaggggatagagagaagagggaggctgacatgtaggaccacatgggcactacctttttaaattatttttacatgtatctgacatgtgggtcctacggtttttattattttttcgggataaaattaccacgtaagcgccacgtcaacgccacgtgggatgaagacctagtcaaaggagccacgtcggccaaaaccgccctccatactgccgagggacctcgtttacccggtttcgtaagttgggggacgggtcgtacccggtcttgcggtcaagggacgaaaatcggactgaccgacaaatagagggacctaaagtgaacttatttcctcagcaggtagtcaatggtagagttgggctgtaaatactcggcccatctcgatgatgctggaggtggtgctcgtcatttccttataggcttcatggattaaatcacacggatcgttgatggaactaaattataaggcccgcgcggnaggcccaaggcccccccaaaggcccccgggttaaaaggaaaggttttaaagaaggccaccgagccggcactggggcggcccatccgaagtggaggccgttccttccgaattcccgatccgctactgaagtggcgaagatgttgcatgccaaggcgcggcgaggcatgagagcgaacgtcctccggccagnacgtggaggccggatcgagaatcaagccggtggcggttaagcagggagcagcgcgcatcaagggaagaagcgcggcaggtctctgttgaacttgcacacctctcaaaggtgcagtgcctatctaatctctaataccgattatagggttctaaccctagccaaagattgggccacgtggcgtctcaaaaatcaagttttgcgcctttgaaaatatgccacgtgtctcctttctctcctcccccaccgttcgatcgagtatcgacggttaaatttcgctgcgatggacctctttataaaactgaggtttgaaaaaaatgactactataaagaggtagggggtcttggaaatgtaggccgacacaggtcgtagctgcagtgccgaagtacctggcacccccacccccacccccatccccatgcatgcgctgcatgcaaacctcgggtgattatccatctaatccatacaattagctcattaattagttgcaagttgagcctatatctagctgtccacctgagttaattaacatatcaaagcgatgtggttgcaagtctccaaaactaaaaaggatgaatagaaatgatgtcgtgtcattcaagtattgagtaaagttggtgctatttagtgacatagtttaaaattggttctttttatgctatattaagggtatgttctgattgtagccaaaataaaccttaccaaattttggcattggcggcaagttgataatattcccaaaattttggcaggatttcttatgtatttaccaaagtttggcaacaaactaaacgtaggcacttttttaacaactttacccaaaaaatggtatggctaaaaatggcataaatctgaacagcccctaaagtacattcagactcggacatacactctccatcctaaaataagttcaattttatatatgaatctagaagaatgtgttgaaatatataaaaaaaatcatatcaacaatcattttatgtatatattagtgcaaacgacaaataaccacaaaattcaaaatataattatacgaggggcgactacgtatattagagcgaacaaaagtcgactgggcgtgaggccaatctgccactctgcaggatttaagccaccaagattcacatcattgtctaccgaggcgttgatgagttcttacgtctcgtgccaccacccctatctctaaatcctggcttcgtcattgtgtagctggatcggtcgacccaccctgtctaggtacaataaatctggttaaggaaaggaaaacaatagtaggattgcatatacactgtacgactcatgttccctaatgagaaaccagattcgagcgtttgtcaatgataaaccatagaattctcctttaactgcattttctaagaataaacagcatgacatttatggtgatgccatcctattacgatatccttttcttggggtcaagggcaacgtacggtatcctcacttatctgccatgcatctctttttaccatggccatgaagatgctctgccctgtatcacggtaagccgagaaaagggctgatggatgagaagataatgcgcggccacgtatcatcacggtaagccttctttgcaggttgcaccaccttgctcgtctatggactcagctgctagtcagccttttaattgcccagagcaaattatactttggttcatattttatttctaaagttttagtttgcacggcaactttttaatattttccgtttgtactctcgatttatagtcaataaagtcattttcatccgtcgttagtaatccgtaatctgttgagaacgcagcctgttgtgctgggtttttctgtctagtaggtttttgaacgtacaggttttcctaatttcctttgtgtttcatcccgatatgacggacaaaaaagtatctgcatacacgtcgcttcctagttccttcggtctcaagattctggaaacaatgtatacgtacgtcagtaacatatatactgaatgataacaatgtatatttctgtgtgcttcgtgcttcgcaggctcgcagctaagcgaagaaacaaggcagaacaaatatggcctgcctgagccacaacctcccagttttcatccacttgctactactaatctctttctgcagatgcgatgaccagttgagacatgcgaagcgactaatctctcctagcgacatgctcatctccaaaggtggagactttgcgctcggattcttctccccggccacctccaaccagagcttattccttggtatatggtatcacaatatctccgagcgcacctatgtttgggttgccaaccgcgacgacccgatcgctgcatcttcatccgcgacgctctccatcagcaacaattctgctcttgtattgtcagattccaaaggccgcaccctatggacgacgatggcaagtcccaacagtattgtcaccgaagacgacggagtttacgcggtgctgctcgactcaggaaatttggttcttcggctatcgaacaatacaaccatatggcaaagctttgatcaaccaactgataccattctgcccaacatgaagtttttagtgagatcctacggacaagtcgccatgcggttcatcgcttggaagggcccagatgacccatccaccggggatttctccttcagcggcgatcccacgtcaaactttcagatcttcatctggcacgagacaaggccatattaccgtttcattctgtttgatagtgtctcggtgtccggtgcaacatacttgcacaacagcacctcttttgtctataaaacagtcgtgaacactaaggatgagttttacctcaagtacacaatctctgatgattcaccatacacgcgcgtcatgattgactacatgggcaactttaggttcatgagttggaacagcagcttgtcctcatggactgtcgcaaatcaactcccaagggcccctggctgcgatacctatggctcgtgtggcccattcggctactgcgacctcacgtcggccgtcccaagttgccaatgcctcgatgggtttgagcctgttggctccaattcttcttcaggatgccggagaaagcaacaattgagatgtggagatgaccattttgtgatcatgtctagaatgaaggttcctgacaagttcttgcatgtccagaacagaaacttcgacgagtgcacggacgagtgtacccgcaactgctcgtgcacggcctacgcctacaccaacttgaccgcaaccggcaccatgtccaaccagccaaggtgtttgctttggacaggggagcttgccgacgcgtggagggacatcaggaacaccattgctgagaacctgtacctccggttggccgattctactggtatgcccaccctttttcccctgcgacgatagaatagctcttagattagcagtcctgaattttgttcacttgtgttgataggacacacttcaaactcaacagaaagaaaaaagaatctagtgaaggtggtagtctaaatttagcatgcctgtttttgaacacgaccaccaggttactatctcccacaagcttgcaagctactgtatgtttgacgctgtaacttctgttcacccacattcttcacagggtcaaattctacagtaaacagaaagaagaagaggcacatggtggtaaatattgtactcccagctatagtgtgcctactaatactcacagcgtgcatatatcttgtcagtaaatgcaagtcaagaggtactataagcagtaggacctgcttaattgcaaagcgtgcatatatcttgtcagtaactgtaagtattgacattgttgattttactataaggcgtccgacaaaacaaggaaaaaacgaaaagacctgtcattcaacagttgagcactattcatgatttgtgggatcaaaatctggaatttccatgtattagctttgaagacatcactgctgcaacagacagtttccatgacaccaacatgcttggaaaaggaggttttggcaaagtatataaggtgatatataattttaccttgtcattctgtcaatgatatgaggaatagcgatgtcatttactcctattactttaataatgatgaaatcacacagggaacattggaggatggcaaggaaattgctgttaaaaggctcagcaagtgttctgagcaagggatggagcagttcagaaatgaactggttcttattgccaaactgcaacacaaaaacttagttagacttcttggttgctgtattcatggagatgagaagctgcttatttacgaatacttgcccaacaaaagcttagataaattccttttcagtatgttcgaccaatccaaagaaatactcttgcttggttaattatttgtttgattctactatcctaactgtgttctgggcagatcatacaacagaggctacacttgattggctgacaaggttcaacattatcaaaggggtagcaagaggacttctttatctccatcaagattcaagaatgaagataattcatagagatctcaaagcaagcaacatactgctcgatggagagatgaaccccaaaatatcggattttggtatggcgaggatatttggaggcaatgagcaacaagaaagtactagacgagttgttgggacatagtaagtaacttctgctcttgccaaccaaaattattcaaatacccaggttctggaaattattaaacttctttcttattcaaatagtggttacatgtcacctgaatatgcaatggaaggcaccttttcagtcaagtccgacacatatagctttggtattttgcttctagaaattgtaagtggattaaagatcagctcacctcatcatcttgtgatggattttccaaaccttatagcttacgtaagtgttgccggtacccaatgcttcaaaatttaacaatcaaagaacaaacataacattgccagaacaaatattgaagttattctcttgtttcaggcatggaacttatggaaagatggaagacaaagggattttgtggacaaatcaattttggagagctgttccctcagcgaagtttttaaatgcatccatattggactcatgtgtgttcaggacagcccaaatgctaggccactgatgtcattcgttgtgtctatgctggagaacgaggacatgccacacccaattccaacacaacctatatattttgtgcagaggcattatgaatcagaagaaccaagagaatactcagataaatctgttaataatgtgagtctgactatactagaaggccgctgaataaatgttttagcataagctctaaacagatggatggttgtatagtacattagtacggaatactttctccgtttcacaatgtaagtcattctagcatttttcatattcatatagatgttaatgaatctaaatagatatatatgtctagatttattaacatcaatatgaatgtgggaaatgctagaatgacttacattgtgaaacggagggagtagtaaacaatgaactgaaagatattggaaagaatgcattccgtaggtggttgtgcgcttgtgctacttgtttttttctcatctgctttgctctatcaatatattaggaagagctaatttatgttcaaaaattgaatagatactcctctaacagaataatgattagagatccacacaagtgatcatttgccatgcgtcttttcttttgtgaaatatattgagcaggtatttgaaaggtcatctaattaaggatggaagaatctatccaaggcgaagtgctccagcagcgcttggggtctatgtttatgtgtggcgggtggttccaatccccgctctacctcacgggcttgactcatgcatgaatcagccatccccagatgcccaacctagaaccaaaaattggaggcttgggtcgaaaaattagttaaaatcatgcctgcccgtgctgggttcataccgtctgcaccctggacgcgccgccgctcgccacacgctctccctcctctccggcgcgcccgtgcagcggatgatgtcgcgactcgcgaatggccgtgccgcacggagtcggatcaactcaatccgcatcgaaaaatcggaggtttgggggggagggggggggtgtccggaacttggcctgctccgtgagctcgcgcaaccgccaccgcctgcatcctcgatccggcctccccgtcctggccggcggccgctcgctctcccgcctcgccgcgccatcgtcggcaacatctccgccacttcgcccgcgccgtcggcttgcagtggcggatcgcctcctcgggtgggccgccccagtgccggctcggtgggctcttactccacggatgggctgactccggcgggcggaggcctcattgaggcccattagtccatcaacgagctttcaccgacttgggccggcctgctttgcctcacctcctgccaacacaggcccccactgatgggtttgggccataggtgctcgagatggtccgaagccgccgaatgcgcctctaccccagttaggtgttcggccgccgcccgccggagccaccggagtagagggcaccgagaccgcggcggggcggagtcgcggacctcctggggttggttcgtccgccactgcgatggcagtggtacgccgcgaggtggtggaggctttgcagccttgcagcctaggagaggaaccgctagtggatgcggcaatggatcagctagcgcttacttccccatccctgggagcgagaacacatgcctgacagagtggtggttgcaggccagaacatattttcggaagtgctacaggacaaacttcgacagcgcttgtatgctgatttgctggtagatttggaaggaaagaaatgcgcgtgttttcgaccaaagatcgagaagccctaaccagttagcagaggctatcaaagaagagatcttagtgtggaaagaagcaggctatttcgagaattgcagttcttagttttctttctgttgtgttgacgttccagttctttagtttgccgggctgtggttcctgccacagtctaattcgacacctgtcgttgcaagcgaaaactacttgtactttgattttattcctcctaatcttaataaaattggtcgccggttccttcggccgacccggcaaaaagaggaaccgctagtgctgacgcgctgttgggcaagcggcggcggcgcagccgccggcggcggctgagggggaaccgaagcagacgcgcaacctccggtcgtgacgtggtttcgccgaggaggttcaggttcaggcgtgccatttcaacgcccctcgagtgcaggtactagtactactactgattaaaacagtgatgaatcacatagatgcggattcgtattcttcgtttttttatcgcctagtgcaaattgcaaaaatgcacccaggtacccaaccttccagttccaataatttagtgaaatttgacgacgaaaggattttacctttttcttttcgtaaaacatatagggcgtgtttagttggtgaaatgaaaatttttgggtgtcacatcggacgtttgaccggatgtcggaagtggttttcggacacaaatgaaaaaactaatttcataactcgcctggaaactgtgagacgaatcttttgagcctaattaatccatcattagcacatgtgggttactgtagcacttacggctaatcatgacctaattaggctcaaaagatttgtctcgtgatttacatgtaaactatgcaattaatttttctttttatctatatttaatgctccatatatgtgtccaaagattcgatgagatgtttttgagaactaaacaaggccataatatccgaaaactgttgaatatgaatgataattcataagcccaatgacccaaagagcaatcacattttcactgggacaattttgtttcctgtaaatttcattccgtagcggttaattctataaccagctcattctgaaattaaagagggacaatcatatgatcagatcaagtgatgaattctgcaacaagttgattctgaatccaaacttctaacgcccctgtagtgtggtaaggctcatgctgtttacagatttgttggcgtcctgtctcgtcccttcggccatataattccttggcacgaaatatgcaggttgctttggagtaggacgtgctgtggtctcattctctaacatggccacaactgatgacatgaatggtctagcacttgggtcttcctggacacataacagtcctaagtggatacagagcaaaaactcgctaattgcatagctttccagaataattgagtccacaaaatcctctgcatttccatctttccacaagctccaggcctgaacaaagagaagagagtttctaattagtgcaaaactttagctgttgaaactttgtgcactatatgtcatacaacttacacgggctataaggtttggaaaatccattgtcagatgaggtgagctgatcttagagccacttataagctccaagactaaaacaccaaagctgtaggtgtcagacttgacagagaagatgccttccatcgcatattcaggtgacatgtaaccactgtttaaatcatgtcaccaactgagtgtaagtagtttgaatgcgttcaagtatatagaagtttgtattttatacacaggtagttgaagagttactcactatgtcccgactacatgcttagtgtttgcttgatgctggttgctaccaaagattctcgccataccaaaatctgatattttggggctcatctcctcatccaataaaatgttgctggctttgagatctctgtgaattattgtcatccttgagtcttggtggagataaacaagtcctctagctactcctttgattatgttgaaccgtgttcgccaatcaagcatagacttttttgaatcatctacgacggacattatgaaaggaaacttattgttgttcaggctttgggaaccctctcggcctctcccaccaaaagtgaaaaaggtaaaaagagaatatataattattacataccaaaaaggaagtaatccaggcttctgtttggtaagtattcataaataagaagcttctcttctccatgaatgcagcaaccaagaagcctgactagatttttgtgctgcaatttggcaataagaaccacttcatttgtaaaatgctctaccccctgtgtggaacctgtaccgagtcttttgacagcaacttctttgcctccttccaacttcccctgtatagtaaaattattttaacaggataaaaattataaggcttgtccactgctacaactcttagtgtaaattgttaccttataaaccttaccaaaacctcctttgccaagcatgttggaatcactgaaattgtttgttgcagtagcaacctcttcaaaattaatatttggaaattctaccttctgctcaaaaagttcgtgagaagttgtaaagtttcctaacactgttctcttcttattttcgtcatttctctgtttgcctaataagaacatcattatcggtcagtagttacaggaagactgcatagtgttagttagtattgagtattgaccctcactgtaccttttgtttgccacttcctgacaaggtatatggatgtgaatgtcagcaggcatgctataattgggactacaaccttcactacttttttgttctttttgttggcttcagaagtgtaccctatcaagaaaagtgattttttttctcagaattccatgtacaagctatctaagggtatcatcaatgtatatggcaaaagtagtctatatagatgggatccacataaataaactttacctatagcaatcctcacaatgtatatggatacaatgtgacattaggagaagagagagaagtagagatagataatattatttatgtcatatgggtagtccatatgcatatggataccttttgctattttctttatatagactagttgcacaatattactagatgactgaatggaatagtttattccctatggactacttttgtagtacattgtggatgccctaagagttatattgcaactgcaggggaaaaaaggtgggcataccaggagagtaggccaaccggaggtacaggttctgaccatcaccaaaaccagtcctccccgtgtcgactagctccccagtccaaagcaagcaccttgattggtctgccgtggtgccggctatggtcaagtttgcataagcataagccgtgcacgagcagttgcggttgcactcagccgtgcactcatcaaagcttctgtttgggacaggaatgaacttgtcagggaccttcattccggacatggtcacaaaatgattcccatctccgcatctcaactgttgctttcttcggcatcctctcgaagagttggtggtgtcaggctcgaacccatcgaggcattggcaccttgggatggctagcatggcatcacagtagccgaatgggccacatgaggcgtaggtatagcagtcgatggtgctcgctgggcgttgtaagcgaactgtccatgatgacgagctatcatcccaactcaggaacctgaaggttcccatgtaatcaagcatgatgcgtgcatttgctgagccatcagaggttgtgtacctaacatagaattcatcctgtgtgttcaccagagtttgatatatgaaagaggtggtgttgctgccgtatgcttcgccggacactgacacactaccaatcacgacgaagcggtaatatggcttggtcccatgccagatgaaggcctgaatgtctaagctggggtcgccactcaaggagaattccccggtggatggatcatttgggcccttccaagcgacaagtcgcctgctgacttgtgccttgtacctcagcaaaaacttcatgttgggcagaatggtgtcagttgggtgatcaaagctttgccatatgattgtttcgtttggcagctggagaaccaagtttcctgtgtcaagtaacgctgcataagcaccgtcgcctccagttatggtgatgttcgttgtccaaagagttcggccttcggaatctgacaagacaaggttagagctattgctgatggcgagcatcacggatgatgaaggtgtggagatcgggttgtctcggttggcaacccaaacatatgtgcgctgcgggatgttgtggtaccatatgccaagatataagctcttgttggaggttccaggggagaagaacccgagcgcaaacaccccgctcttggagccaagcacgtcgcctgggtggagctgctttgcttgtgtcagctgatcatcgcacttgcagaaggagatgaggagcaagcagatgagaaaggggaggcatgccatattcatttggtttgttcttcacttgcctgtgactgtgaagcctgaagaaataacttgtctggtcatcacattcactgattcacaaatagctttggagtaattcccgtgagtcaacgtatggccgagactttttattcgtctacgggtctatgagtggaggtgcacgcgcaaaggaaagtgttgctacgaaatcatactaagggtttgtttagttcatgctaaaattgaaagtttgattaaaattggaacgatgtgacggaaaagttggaagtttgtgtgtgtaggaaagttttgatgtgatggaaaagttagaaatttgaagaaaaagttgggaactaaaatcaccttggagagaatgagaaaactcgtaaaagttgcgagaagtcagcgctgcatgcgtgcgtaacccgtttagttggtggcattgacgcatgatgagtgcattatgagggtggagctgctttgcttttgttagctggtcatcacagtacacttgtgtgcaaaaacttcctacaacgatttctgtacacatgattgctgaagcttaagaatagtccgaaagacctcaaggacacgagatggattttcctccgttcatcagaaacccgaatttttcagtgttgacggcgttctgacgctgggacatggggataagtacactaatcaacacaggaatagctgagaagaaggttcagggggccacaaacaacagcaaactctctctatccaatgcgatttcttgtgagctgtgacatgccgagccaagcacgagacggtcagttcaggctcggcccaggtctgtcgtgtgaggccggctctgtgtcagatactacttgtgaaactgaaggctcgcatctgctgttgatcatgggattcttgggcatggctatctgtgaactgtatttggttagcattgagacaacctgattcatggtaggcctgtcatcgggagattgctgtacgcagagaagcccaatttggatgcacctgtctagcccaagcaggagatcaggctcaggtttgatcagtcctaaatcaagaatgtcctcgatctcatgctgtttccaagactcccaggtctgccaaaaagaaaaaaactcacttacatgatagtgcccatttgcattttctaatagctatatttttcctttcaaaaaattattaactttgcctggaaattcattattttttttctaaaagagtagtactgaaaattatgaacttttatgtcatttttttgcgggtgcttagttcagtctgttggcactggcttctcaacttctgtttatgtgcttatttgctttaggcaaatcaattgtgcgacttatatgttcacttacctcacgaagaaaagttggtaatgtcctgttccttttaccactgattatctctagcaacacaactccaaagctatacacatcgcacttgagcgtcagatttccttgagctgcatattctggagctatgtagccccttcattaacaaaaaaaaaaaagcttgtcggtcagttgagacctctaaggaaaacatgcagaaaatgccagaaaaacttgaataggaacattagctgaagtaatgaagttaaaaatcatacgctgacagaactaatgttggatcagtctggtcgttgataaacagcttggcagtgccaaagtctgctaccttaggtctccgattgtcatctaggagtatgttggatggtttcagatccctgtgaataactttcacgttgtgaaggtactcgacacctatggcgatcccgcggattatgtctaatctttgcacccaattcagagaggctcgcagtctacgatcttctcctgtcagttccaaataggcccgtgtgataagcatgcagaagatcagagctttacaggaatatacagaagataattatgcatcacatttctacaaagattaacagactacagtgagtaatgaatttgtttttttggttaggaatgggtaccaaatatgtagagatccaagctcatgttctccatgtattcatagactagtatcatctcgcctccttcttggcagtaacagagcagctcaacaaggtaggcgtgccttgtgttcgacatcatctccacctctcttatgaaatcctccttgcgtttgtcagtaacaagagactgtgtgagcctctttacagcaacctttctaccactgggcagcttcccctggtgattgtaaaatcagatgtttcaatgcagactttgcatttcaagatttgtggtagtgaagtcaaatcgtaacttagtttgcgtacataaaggtgtcaaattgttgaaaaaagtgcagacctgatagacaatgccgaaaccacctctgccaatgatattgctttcagagaaattccctgtagcctccttcacactagacagattaattgaaggggcagccaaagcaggattaggacgagcatgaacagcagcagtagcagctggaacgcccgcatcatcatctggtgaatataattgcattgatttacaccttcttgtatatcaaagcactcccttcgtttcatattataaatcgttttgtttttggtaaaagtcaaactatttcaagtttaattaagtttgtagaaaaaaaagtagtaacatttttaactcaaaacaaatacattatgaaaatatgttcaattatatatttgatgaaactaatttggtgttataaatattactatatttaactacaaacttagttaaacttaaaataatttaactttaaccaaagtcagaacgacttataacctgaaacggagggagtagaaaactatggggatgattttctcctctctagacgcctcccgtttgtagcacatcgtcaaatagttattaaaaaaacaaaagaactataaaatatattacatataaagtcaaattctcgtttgtgcacgtcgactaaatagttatgaaaaaatataaaaaatagtacatgtaaagttaaattttaacctctacaaattgtagaaaacaacaaattaaagtattcatacattagaagttttttttttataatttgtagaagtttaatttgtctcatggagcaatatatcatatgttaatctatcttatcaatttttttcatgactattcagttgacgtgggagaaacgatgggtcatcatctcaaggggcaaaaaaaatcccagtaaactgaacaaaatagttatcaggaattcagactttcagagtattacgaattgttacctgatactctaggcctctgacgcctcctaatcacatataggaggaccaacaaaataatgagaagaaccccaacaactgaagcaatggatgcaccaataaccacagcagctggaggccgccgttgccgaataccatctttgcctgtcacagttttttccacaaatatatcagcactcactctcactcatttcatcagcattagccttgtcaaatcttattagatttgctcattttgaaagtttttaccaaaaaacatgcgacagttttttttagcaatttcgtaaaaaaaatacattgctacctgcttcgtacctaactcagatttcgccaacctcacgtagagatcttgtcctccatcgacgtagcgcaggtcgacgaggtcgtcggcccagatgatgcatccgctcccggcgccgcagccgccgccgcctccgatgtcggcgggggcgtaggcgacgcacgagcagttggcgaggcaccgcgcccagcactcctccaccgtgacgcgcttgtccaccgtcgcgttatgcgcgtcggggagcttcacgccgcgcaccgtcaggaagccgtccgtggcgcagcccagcgccgcgtctcgccggcacccggcggaggtgtccctcatcttcttccacggcgacggcgacgccggggtgaagccctccacgcagctgcagaacgacgtcgacgccgcgccggcgtcgcacaggccgaacgccccgcacttgccgtagtcgtcgcacaggtccctcggcccctggaagaagttcttccatgcccggctgctcggctcccacaccagccgctggacctcgccgacgcccgtcaccacgaggcgggagaacggcgcgccggcgttggcggagtagccgaaggtgatctcgccggggctcaccgtcagctggtagctgaacatgtcggagtacgtccccatctccgggatgccgctgaaccacagcccgttccacggccccgtccggtacacctcgccgtcgccgtcccagagcacgttctccggcacgcccttcgtgtccgtcctgtaccggtagttccccggcgacgggtcgccggacgaacgccacgacgagaggtaccactcggcgccggtccacaggttcttgccgatcttcatgccggggagcagcgtgtcacacgggtggtcgaacgactgccacacgacgacagcgcccgcgccgccattgccgcggtcactgacgacgaggtttcccgactcgagcagctgcgccgccatggacgcgccgcccccggtcgtcgtgttcgacgaccacacgacgtggccagagccatcgagcaagaggaggctccccgcgtcggtgatcaccagcacgccggaggtgtccgtgagagggcggtcgcggttggcgacccagcagacgacgtcgtcggagacggagaaccatatcccgaggtatctccggctggtgctcgacgacgaagacgacgccggcgagaagaagcccagcgtgaatgagccgccggcggagacgagcctctcgccgtcggtgatgttccggcccttgccaagagtgtcacctagctctgcacctgtagttgttctgccagaattagaaaggagaagcatgcatgataggatgattaggaacattgagctcatggctgattagtagagaaggtaattaaccacctggatgcttaagctagatttgcatctctgtcgtctacatatagactggagattgaaagctggtatcacttggaggttaacctaatatttatatggattggcatttggaggttaagcagctgacttggtcatcatcgatttttggcaaaagagaatatacaactgatgagtgtgattgtatatatatttgtattgtgtctcggaggataattgtaactgcagtctgcaggtagcgtctgagtcataactagcaattacattttgtagccaacctgctaatttgtttacccatgaacatttttgtcttctctgcaagcatatacttcctccgtttcatattataagtcgtttgattttcttatcaaacttttttaagtttgattaaatttatagaaaaatatggtaatattttcaatacaaaacaaacatattatcaaaatatgtttaatattaaatttaatgaaactaatttaatattatagatgctatttttttaaaaaaaatgatcaaacctaaagaattttaacttagggaaaatgtcaaataatttataatatgaaatggagagtacagattgattcaccgtttggactttggagcatgcgaatggtcagtagtcacttgcactgctgcagaatactagtagtaccataattgtcaatgagtgtaaaaatattttatttgagttgtgtgcgaggaaggcattgtcttccgagtatcttgtatattcttgacaacttgcagatttgaatggcaacattaaaatcgggagtactatataaaatgagacaaggtagttcagttcatgcctgattggcaaaggaaaaaaaaaggaaaagaaatcggcagaaacttctgtttggctcaatgattcgacacgtatagaagctagaacagcacaacccatatactccctccattcctaaatatatctgacgtcgttgaattttttaaacacgtttgaccattcattttattcgaaattttttttaaatatataaaaatatatgtatacataaaagtatatttaataataaataaatcaaatgataggaaaataattaacaattacttaaatcttttaaataagatgaacggtaaaacatgtttagtaaagtaaatggcgtagagacggagggactatatatataaccctgtacagttgtactacgtgagatcgtcgtcaatgtcggtggcgcccagcagctccgactcgcgcaacggtggcctgcttctgccgccgtgaacccctggcctcttgggacgatccacccgtgagctcttgctggtcagcatcgcgacgaccgccgacatggccggcctttcctccggcgcatcctgcacgcacaggagcccgatctgcacgcacctcgccagttcatcttccatctcggtgtgatcaggccctgagactgagagagggagaccgatcatcgcgtcaaggagggacatcaccctgccctgctcccacagctcccatgcctgcacacaaagccgatttggtgaattaatccaaatgtatatgtatatttggtgatttggtgtatatatggtgatgcttacatgtggaaggagactgtacatgggaccattcctctgtccgctaagggtttcgagaagaacgactccaaagctgtagacatcgcactttagtgtcatctcccctcgccatgcgtactccggagatgcgtatccccttcatggaaatgtaactcgaccatgtcagtgacacagtaatactacgaaacatgaccagttggctgattgttcatgagcaagagaatggagggtgtgaagtaactgacggtgaaaccacaacggtgagattggaaggctctggctggtctgctgtgaatagcttggcggtgccaaaatctgcaatcttgggtctgaaactgtcgtccaacagtacgttcggaggcttcagatccctgtggatgacgcactcgcctgatccctcgtgcaggtacgcaataccattggcgatcccatgaatgatgcccaatctttttctccagttgagcatgagtcggaggccagaatcgcctgccagtgcaaggtacatcaagttagcaaatgccatacgagaattgtataaactgtaagaatgcagccttttttttttctgtatattcgtttctctaagtaccaaatatgtagagatccaaactcctgtttgacatgtagtcgtatatcagcacacgctcgctgccttcgctgcagtaggcaaggagacgaagaaggttgccgtgtctgagcctagccatcacctccacttctcttgtgaaatccttcttgcctttcttggtgagggttgattggtgtagccgttttacagcaatcattctcccatcaggtaactggccctacagattatacaatttatattgtaagcaactgagaatacataaatttcatccacattcctccaaaaaaaaatcatccacattgactctttgacaacctcactacaaggaattttcattagaaaaatggaagcacacgagtgtcaagagttcatgaatcatgaccgagcgagtatgttctatcatgtagaaattagaaaaaggaaaggaggttaccttgtaaactatgccaaatcctccttggccaatcacatggctctgtgagaaatttccagtggccgccttcactttctgcagatcaactgaaggaactgttgtagcaggattatgaggtataccttctgcaatataaaaagaatcagtctgggtctggaacttcctgggaaatgtctaacgcttaccttaaatttgttctttctgtaagcgtaatctagaaggcaaaatttgctcagacatttgcttcaagacactcttattttatggttgttagtcagaatatgctctgactattattttaacatatcctattccaatggtgagatataactagtgcgttcgttccagtgatattgggtgagaaaacacatcgtttttcacgcgcacgctttccaaactactaaacagtgcgttttttacaaaaaatttctataagaaagttgctttaaaaaatcatattaatccatttttataatttaaaatagttaatactcaattaatcatacgctaatggcccacctcgttttgcgtatattcctaatcttctcaagtttacacttggccaccttgcaagatttaaattcaagcttttttttgaatttaaacatattttgcaaaatataaaacttattccaaattgtggaaaaacattttaaaaaacttgtttaaactcagacaatatatgttcaatttctatttttaaaatataacaattctcatttttgtagttttgaacaagttttgaattttgtaaaatatatttaaattcagctaaaatttgttcagatttaatcttctaaggtggctcaaggataaaatcatcttttgtgaagtttttatctcttcatgggaaaaaagatgtattaaaaaatggtcaaattttaccacagatttagagtatcctaaaaaaaaaccacaaaactagagtttaccgaagcaaatgttgccgatgaaaaaaaaaagtgaagcgtatacaagccattggagaatagcactttacctgagattttgtgtttccttctgcaccaaatagcaagtagcagtacgagcataataatcgtggcagatattggtgcagcaataacagttttccagagcataaacttccggctcctaccctcatctgtcatagctcaaaagttttccagagttaatcatcaatagatagccatggttaatattacatcgaacctgatccttactaaatgtgtcagctaagccaagaaatgtgcttggaaatgacgtgcagaactgaaatcactctgataaaattcagcacatacctaattcagactctgccaacctcaggaacagaccctgcccttggtcgacataccgaagatcaacgatgccgccggtccaaatgacgcagccgctaccaccgccgcctcctcggatatccgccgcggcgtaggccaagcacgagcaattggccacgcacctcgccctgcactcctccaccgtgatgcccgtgtccaccgacgcgttgtgcgtgtcggggagcttcactccctgcaccaacgcgaacccatccgtcgtcgtcgtgttgccgcagcgcagcggcacgtttcgccggcatccgccggaggcgtccttcatcgcccacgccgccggagacgtcgggctgaaccccctgaggcagccgcagaacgacgtcgacggcgcgttggcgtcgcacaggccgaacgccccgcacttggcgtaggcgtcgcacacgtccctcggcccctggaagtacgtctgccatgtccggctcgtcgcctcccacaccagccgcttcaccacgccggtgtcgagcacgacggagcgcgtcaatggcgccccaggcttggagacgtagccgtagcttatctcccccgggctgacggtcacctggaacgtgatcaggttcgtcgtgtacgtcgccgcctccgggttgccgctgaaccaccggccgttccatggccccgacctgtacctctcgacgccgtcttgccacaggacaacgtccggtatgccgctggtgtccagcacgcggcggtaggcccccggcgacgggtcgtccggcgagcgccacgacgtgaggtcccactcggccccggtccacaggttcttgcccatcttcatgcccggcaacaaggtgttcgacgggtgatcgaacgactgccacaacgtggtggtgctgccgcttgcgtcacggacgaccaggttgccggagttagacagccgcgcctccaccgaggcggcgtagggcgagttcgacgaccacgcgacatggccgccgccggagccgtcgagcaggacgaggatcccggcgtcgctgatcgccagcacgccggaggtgacgttgagagggctgtctcggttggccacccagcaaacggcatcaggggagaccgtgaaccatataccgaggtatctcttggctgacaccccgggggagaagaaccccagagtgaacgtgccgtcggccgacacgagcgtctcgccgtcggtgatgttccggccgccgcggagcgtgtcggtaacggccgcggcggcggcgaaggctctgggagcaacgaggaagaacgagaagaggatgacgtcaacgaggcagatgccagtcgttgccttcgccattaattaatcaccacgacgctaattggtttcttgctcagttcatgagctactcatttatacatgatctgcaatgcttatcagttatcaaggctaatctagtgcagtttactacagaggttacaacgcaagtatgtacagcctggtaaggtaaagtcaaattaaagttctgactttgtcatctgttcatcatttttttttgaacgaatatgttcatcgattagagagcacaaacattttgtattagtagcgtttgcatccaaggaattacttcatccgtttaacaatgtaagtcatttttatatttctcacattcatagtgatgttaatgaatctagatagatatatatgtctagattcattaacatcaatatgaatatgggaaatgctagaatgacttacattgtgaaacggagggagtaagttacaacttgtgcaggagtgtgcacctagccgcacctacacgtacaatatattttgggtttgttttttgcgttcatgcatgatcgttgagataaaaataccacagataaatggttaaagtaagtgattaaggtcaataatttgaggtcaacacgcttggcttggctcttcattttgccatgtcgatgaggtcagataacgggtcagtgaagaaaaccagcgattccttcccgcgtagaactgctagctaactttgctacactacaggatgctagcggtacagttcgattaatccacttatagttacagggggaaagatatatcactccacaaacaaacaactttaaatttaatttctacaagttgtaacaaaaataacaaatatagttgcgaatatgcgataactattttcagtttaatttgttatttttgttgtaacatgtagaagttgaatttgatcttgcatgttgtcgatgggtgatacccgtaggccggatatagaggttattggggtacgctggtacaaggatctacgtaatacgacatcaagcagacaaaagacaaagattatactggttcaggccccttgataggtaatagctctaatccagttgatgtgggattatatgatggaaaacacaggttacaaagggaacaatggaaatcgacggatccggcgagatcgtagtcgagttggttcgactagatccctagcggtttggctccttgtaggctccgacttcatatgctgtgagggttgtgttggctctgagattcgatgcctcaggccctccccggggggtcccttttatatcacaggttaggcggtttccaagtagaactcggaaacatcgaactttacacgatacattgatgacccagtcttgtccgagtatgactccttccatttgtaaactccgtgaggggtttccttaatatatgcggagagtatccgtatacgcgtgggtataccataccgatatgagacgtatatcaaagagtaaagggtatacctaacccgtaaccctgacagtagcccccgacttctgcttaaatgagctcgtgtaaccattcgcgacttcctgtgtcgagattgttgtcgttcctggtgcgaggaccgtagagacatgacgtagtcgagaacaccgtttgaaacccaatggtcacgagcgaatttaaactaaagtccaaaaaactgttgcgcgtaacggacccagaaattttcggcgggcatctctctccgttccttggaattcgcaccgtcggtagtgcgtctctttaaaggaattttggggatccattttgaagtccgcccatcgtgcagaaaacatcccgcctgcaaacgctcttagtcttctccgcttccacaagaaaccctagttcgtcgaccttagccccttctccggcgatctccgatcgacgatggatcttggcaaatcatcctccaccagcgcgtcgctgaagaagattcaggaagacggcgcccttcccggtcgtgggaccatggaaagggaagcaggaggtactaatccccagcccgtcttaggtcgcatggttgcgattgaagactacattctctgcggttttctccctccgccttccgaatttcttctcttagtcatgaacttctacggtctttctctgctccacctgaaccccaattccatcgcctttcttagcatcttttctcatctttgtgaggcctacattggggtagagccgtttctcgatctctttcgcttctactatgagctgcgttggatggagcccaacagggtgtctggatgcgtcgggttccgacttcgggatggcctgaagtcgcgttacatccccttccagtgtccctcttctcgcagcaagtggtggacgaggtggttctaccttcagatcaaagattcggaccctgtctttgttgttcctgaggaacaaccggacaagatcccgtcttggaccgcaaagccccctttgaccccttctctccaatccttcatcgacattgtcgacgatctccgagtatgaggcttgtcggggtatgaagtcgctgcagacttcattggtagacggatccagccgctctaggctcgagtccacccagcctttgactattccggaccggaggacgcgacccgggtttctcctcggggtatctttcttgcatttatcctaacatgctcgtgtccacgttcctcctgatttatcaaaatttggttctcgattcacaggactgaacagcgaaaccgtgggacgtcgtgtcagccaggtgatgatcagcggcctggcaacggcgagtaacatccccgttcccctttgtgaaaagggggcggccaaacgtgatgctgccatcaacgtaagtgttctcgataggcatcctgcgttttccttctgagatcactttatgacttgattaagcgtaggctcttcctctgactgacatcatcgggccactcgcggaccatcaggtgacggcatctctgaaagagaaggtcgccaaggaggcgtctgatgctgctgctgctaccacaagtggtggcaatgttccgacaaaggggaggaagttctcctctgtaagcggacatcgtcgcaaggcatcaaccccctcggtaagctatcctgtcatcagatcgtacaaccagaagaatttcgccttacttcgcatcgaccgtttttcaggcctcggacgcgtctctaccgcctccacgacgacaacgtcttgtgacggttggcgagaagtaagtagatgaacttaagtctccgtgattttgttcgagtgttatctgaaccatagctatctcatagggcggcacgggcgaaggcggtgcaagacgagtctggagggacttccggcgtgtctcccactgcagcctcgacggatgtcgtgcttgcgcccgggagacgcgaggcgacaccaagcggcccagtcagcaatcctgcggctggtcgtggtccaccggcggccatcctcacctgggaggagctccaggtcgagatggggcgcctcctcgaggctggtgctcgcggcattggccgtgagattgcggaggcgaggtcggcagcggcgtcggcgaacgagtgtgctgaccggcaggtacgcgagttggcggaggctcgtgaagacctcaagaagatgagggagttggtggccggcaacgagcgacaacggcaggggctcgaggaccgcatgtcgaagctcgggaacaacctgtcggaaatccgtggctcattgcgggtcacacacactggcctgcaccagcttgccggggagtgcggcattaagtctactatcccggcgaatcccgacgagttctcgcttacatcttctcttgcggagctggcggcggcgatgagggagatcccctccaagcatgcggccaggatcggggaggagacgtcgaacgggatctacaccggggcgtgccacgtcctcgcgtgtgtaaagctggcacatcctgaactcgatttgcgcgagatcttggatcagggggcggctagcaacacgcataaggaggtgatggaagaagtcggtgatctgggggaatctgttctccccctttttgaagagtaggacctcttgtactcccaagacatgctgtgtaaaactgaatcttaatcgcctttgtgcgtgcaattattgttctagcttactcttgtatgttgatcttgagaacttttgtcccttgtagagatgttgatgacgaggatgtccagcagcgcgggcagcccgagtcaccagcgattattccggttcttgcgtttgaaccacatgcgtcgcccgacaatgtagaccagacccttgctacggggacggagatggcgacgacatccttaggttagtagcccattcatccctttctgctcttccgactagatcaactatgttctcgaaagaggcgtgtagcttgacttagttgttcccacattgagcagatctcgagagtgctcttgctggccaagatcgtcgtatccaatattggaagacaaaatttgaagtagcggaactcgagagaaccatgcttgcagtgaagaaagagcaggctgtggaaacgctccggggtcatgaggtgtggttcaactcgtacttgaagagttgctgcacatccatggccaaggtctgtagagaacttcgagtgccccatggagatcccgaggagtcggcggccggatacatctcatggctgaacggagcatgtgctcaactcgatggcgtcggcaagcgtatcgacgaggccttgaagcaggagtgtcgtcgatcgagccgatatgccggagggcacgtgttggcttgcctacgagatcatcgcccgcacctggacctcgattttctccgtgagggttttgctcattctcggaggactccggcggagatagaccacctggcgaggtcgatggcgccgttggcggagaagatcttccagtctatggactggcgttggccttcttggtagtcttcgtaccctgtgatagatatctcaggaaaaaggtgtaatatagctttggatttgtgttaaaactgtaagaagtattttgtgaaatagagaagagatctatctttaacaaatctttcttactccggatgtcgtgtgtaagagtatgttctcagttcacgactttagtcagtcgtttgagtcgaacactctccctagcccccagccttgtcgtcggaggaattttctcggaggataaggctcttggacctttgatctgccttggttgaataagctctgatcctagctcccagccgtgaagttggaaagttaatttccgatttcgcggcttggttaatacgcacggtgagaactcttacacgaccagatcttacatggtctttcgtctctacaggatctgacaaggccttatcggctctgggcgtccccagccgaagatcccttaggttcctcggaggccttgtcaagacggcgtaaagggacatgaggataggtttcaacgctaggtgtcatcagggtaagggatcatcgggcggaaatactttgattgtaatatgggcctaagaataggctttattgatactgtaaggtgccttacaggtacggatggtattgactcatacatagaatttacgtagttggtcaatgttctaagaatttgctaactcgcgaccatcgccgtctgcgattttgaatgcgcctggctgcaagacttgtgtgatcgtgtaaggtccttcccatttgggtgagagtttgtttcgccctgcttggctttgaacccgtcggaggacgtagtcgccgatcgaaagtatgcatgcttggatgcgcttctcgtggtaacggcggagggtctattgatagctggctgctcgaacggcaactcgttcgtgatgttcctcgagtagatttacatcgacgtttcgctgctcctcctggtcctcgtcggaatgcttctgtactagtgtactctgatgtcgtagctcgctggggagcatggcctcgaagccgtacacgaggaagaagggtgtttccttgttagacattgtcggtgtggtgcgtacggcccatagtactgatgggagttcttcgacccattttttgtcatgtgacatgagcctgtcgtagacgcgggttttgatcccttgtagtaatatgtcgtttgccctctcgacttgtccgttactttaagggtgggagaccgaggcgaagcatatcttgactcccagcccgatgcagtaatcctggaaatcagcgctgatgaactgggagccgttgtcggttatgatgcggtgcggtagtccgtatctgcaaaatatacccttgatgaatttgatggcgttgtcggccttgatttctcccgtgggtactgcttcgatccatttagtgaatttgtcgatcgccacgaataggaacctgtagccgccctgtcctcgtgggaatggcccgagtatatctagcccccagcacgagaacggccaagtaagagggatagtctggagcgcttgcgcggatagctttgtgtgtttactgtggaattgacaggcttcacatcgctggaccatgtcgcatgcatctttaagggcggttggccagaaaaacccttgtcgaaaagctttcccgaccaatgtccgaccggtggcgtgtgacccacaaatgccttcatgtatatcaaggaggaggtgtctaccgtcgtcggacgagacacatttgagaagtaccccgtttggcgctttcttgtatagattgttgggccactgtatcgtcctcgggcaactcctcgctgttgatgaatttgattagtgggatgcgccagtcgtctgtggtctcgatatcggcaacggcgtgttctgcctttgtggcctccgagctaatgtcgggggtgaccgggctaacttcaccgctaacctcttttactgatggcttcgttaggatgtccagaaaggtgccgggctcgagcggttctcgtctagacgcatgtcgtgctaggtcatctggctcgatgttgtctttgcggtagacgtgtcggacttcgatcccatcgaaccttttctctagcttcctgacttctgcgagatacttggataactcagggttagagcatttataatctttgtgcacctggttcgcgactagttcgaagtccccttttacgattagtcgcttgaccccaagtgcagctgcagctcttgtcccggctagtagtccctcgtattcggctgtgttattggtcgccctgaagttgaggtggattgcgtgcttgaattgatctacggagggagacgtcaagataaaccctgcccctgctccttggctgttgagtgcaccatcgaacgccattgtccacgtttcgttgtcgacttggttgtctgatttgttatcaggcatagtccaatcggctacgaagtcggcgagtacctgggatttgatggctgttcgtggcgcaaagtggacatcaaactggctcagctcgactacccattttgcaatgcggccgacaacgtctttgtttctcacgacttcaccgagagggaaggaggagacaactgtgactctgtgggcttgaaagtagtggcgtagcttccttgatgtcatgatgaccgcgtaaagcagcttttggatctgtggatatcttgtctttgcgtcgtggagagcttcgctgacgtaatagactggtcgttgtactttctctctctcgacaatgatgacggtgctaacggaatatggcgtggcggcaatatagaggaataattcttcattaggttggggggcaacaagtacaggggggtttgataggtagcgcttgagtgcaacgaatgcctcttcggcttcctgtgtccatacaaatttgtcttgcttcttcagcaaagcgaaaaaaggttgccctcgttctcccatcctagcgatgaacctgctcaatgctgccatgcatccggttagcttctgtacttctttgagtcttgtgggcgacttcatgttctcgattgccttgatcttctcgggatttgcttctattcctctgccagagacaaggagtcctactcgcgaacacatattcctccgcgtccttttcgaccacgcgtactcgtttgcctttttcagatgcaatgtgcttctcgagcgattttttgaaaacaaggcaatcttccaaagaatgtctgtccgtcttgtgtatggggcaccatgctttctttgtgtcgctactttgtgggtctgggtgcttgggagggttcgcgtattctgctgcgaggacctccgcttgagctttccttttcccatttttgcgattcttcttcttgcttgactcaggtgcgtccgtggctggtttcttctctcccccggtcttcggcttatcgttcttgcgtcttagcgcatcatctgcgtgggcgcatcgctcaacaatctcgaacaatctccgagtggttgtgatgcgtcttgtcgccaactcctgggtagtatagcgatctctgacaccggatttgaaggcgcgaattacagaagcatcggtgatttcggggattgtatttttgcactcgttgaagcactgaacatattccctcaaggattcacccgagttctgtgtcaacgcgtgtaggtcgtcttcgatcgcgtggcgcttgtaggttccttggaagttggcgacgaactgttgccacaggtctgcccacgaagagattgagtagggcggaagatgcatcagccatgaacgtgcagagccttttaacgcagttggcaaataattcgccaatgcgttgtcgtctgctccggcagcatagagtactgtggagtagacttgaaggaactcttctgggtcggtgctcccatcgtacttttctattgctccgggtcagaatctctcaagccatcggacatcacgtagggaacgactgaaagccctacacccagcgctgggggcggtgggttgtcggcgatcgtgtgtccttcgtggatgtctgtctgatgatgaggaagacgaggatgatgacgatgacgatgggtcgcttggttccggcgtacgaatacgaggatgtcggcctggatctcgagaatcttgtcgtcatctcccgctgttgtctcggcgccggtctccatcattgtcatcgttatggcgacgtcctcgaccagtatcgtctggcacccgccgttcgtgatcgttgtgatcgtggcggttgtggcggttatcatggcctcggtcttcgtttgagcggtctcctcgatcttcgttattatggcgccgtgaagagacatgacgccgggaacgattctcattgtctcgtgcgcgtcgtgcctctcggcagccgttgaggtgatctcggagatcgctagtgccgcgaggtggaggggtggctcgatgaggcgattccctccgttcagggtcttcaccattggcatcgccagttggtggttgctccgggtgcgctgcggcggcggcctcttcggacgcgttgctgaggttggtcactgattcccgtagtcgttctgtccaatgcgtgatatcgtcgttcaaaacaggatcgtagggggtttccctcagtatagcgttgacggctctgatgtgctgggccggggtggccaattgattctccgcttctgcattggtgcgcgctgacgtgccgacatcatcgatagccaatacctcccgcggcgtgctcgttgttgatgatccatagtcttcgagaaggtgcaagactgatggttcgtgaggatcgatatcgattaccccaacaaatcgatctgaagttggcgtcgctcctcgttccttgtctttatccctgatggggatgtgtgactgttggaccttaggagatggcgctttcatggtgctgagaaagaccttgcaacttgagaggtcgtgattctttgtcttgtgaataggacaatagacatcacgagttggagaaatacgctgaattccacgctctttgcaggcgcgaatttcagcgcggatgttgaggaaaactcagcaggcttgcaaagtgtcacgcccgaaaattcactagtaatttccgaacttatttgtgcataaaatcctcgtccaggaatcagccgaggtacacaaactgacaatttaatatacagattcatcaaattaactaaaccgataaatacttacttaagaggcacttagtcctcaccaagaagaaaactgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagcaaattattaccagttataacatctataattatggtgagaggtgtgggactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtccaattataatcacccaaggtatcaaggaataaagtaatcaagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcgggctagggtttcggtggaccgggcgcacgggcggcggttcacgcgaacggacggccgagatcgaaccaatccaagatggacggccgagatcgatcgggtccacggcggtttacggcggacggcctggatgacgtcagcgatgacgtcaccaccggcggcggcggctcggcggctcgggctcgcatgctcgccggcgaacgacggcgcggcgacgcgaacggagagcaccaggacgtagagcgcgacgcggcgaactcaccggtgaccaaagaagcggcggagaagcaacggacggcgacggcgacgaggaggaagcggcggaaaccttcgggttgacgacggcgatgaagctccggcggtctccggcgacggcgaaggggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggctacgggtagaggagagctcgggggtccttaaataggtgcaaggaggcggcggcgaaggcccacggcggcggagacggcgaaggaaagctcggcttggagagaggaaaaccgatccaattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcgggccccacctgtcagcggctgagagagagaggagagcggcggctcggcggactgggccggctgggccgaggagggagagaagagaggttttgggccgactttcggcccaaagccaaaagaagacttttaaaacctttttcaatttaaattatttcttaaatgcaattccatttactaaaaatacttccttagctcaaataaatcccagaaaaatctaggaattatagaattaagcaaagtatttaatgaaattttatctagcccaattttatattgagatttaacaaattaaaattagatcttctcttataagcttttaaaatcatttctaataattccttttaaacaacaatttataatttaaggatttttaaacaagaaaagctctttaacaattataattagatcattaatgatcaaataattactgaactgttctttgtattattaagagttgagctctgaaaaatccgagaaaatttcagagagttgacttaatcatggagaatttaataaaaattaaatccatccatgctttatatttaggaaattttatttcccacatttaacttcacttgtaaattaaagaacatttaatataaattctattaataatttattaaataatttataaatcctgaaacgaaaatcaggatgtgacacaaagtgtgtttcctggttttgtggataggacaccaggaccttgtcacttcggaagtcatcttcgtcagctcgcggttcatgtcggaacgacaaggtttggccgcattagaatccttctcgagctcggatgtcgtcgatgttccgttctccgcctcggcgggaggatctttcgacatggagtcgtcttggtttgtagccattgcgttctcgtttctagtcattggcggaccggttgagatcggcattgtggtgtaaaccgggaagacgatttcgccgacttgagtccacaccagcatcgttgaagcagggaatacttggctgaggttggtgttgacgctattgtcgacgaggctggatgacatagtagtggaaccttgagtaccaagtccccctacctggcgcgccactgtcgacgggtgatacccgtagaccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccagcgagatcatagtcgagttggttcgactagatccctagcggtttggctccttgcaggctccgacttcgtaggctgtgagggttgtgttggctctgagattcgatgcctcaggccctccccagggggtcccttttatatcacaggttaggcggtttccaagtagaactcggaaacatcgaaccttacacgatacattgacgacccagtcttgtccgagtagaactccttccatttgtaaactccgtgaggggtttccttaatatatgcggagagtatccgtatacgcgtgggtataccataccgatatgagacgtatatcaaagggtaaagggtatacctaacccgtaaccctgacacatgtttgtggagtgatatatttcatattaatctatgttgttatttttttcaaatatatttataactatttaaatgatttacaaataacaggggatgtcctctcgtgggatgaaaatcatgtgttacatgagacaaaacgtatgcacatgtataaaattggcccattaccatcgtgactttggaatgggccgggccggattacccgtgacgtgctttacggcacgccaacttccgggttgttgattaccgttgagaagttaggtggtgtttggatccagggacttaactttaatctctgtatttagacactaatttagagtattaaatatagactacttacaaaactaattacataaataaaagctaattcacgagacaaattttttaagcctaattaatctataattagagaatgtttactgtagcatcacatagggtattcatggattaattatactcaatagatttgtctcgtgaattagtccaagattatggatgagttttattaatagtttacgtttaatatttataattaatatccaagcatccaatgtgatagcgacttaaaagttttagtcccatctaaacagggtcttaacgtcttttgctgcttgtcaacaagttaaccaaaaaaaaggaaaatggttccagttaactgctcctcatatcatgttaatctgtagttagaatcatgaatacatcagccattcaatggaatatctgcaaaaaaagatgaccacacaatgacacaagtcacaagcagccaagcagaagagacatctacaaagagaaactaagtcaacacagacatgcatacaattacaagcagagaaaagaaaatccttctcttctactacacctgagcacggccaatccaggcagtctgcatgcattaggtgagatcggttgtggttgagccttggacatcactctgacgaagcggacgcatggcggctctgctgtcaagtgtcggtctcttgggctgctccatctgcgacgtcctgctcgtcagcatggcgacgatttcggacatggtcggcctatcgtccgccatgtcctggatgcaaagaagcccgatgtggatgcaccgttctagatcgtacaggagctctgcatcgtcgggtgcaggcctcgccattgccgggtcaaggaggtccatgaggttgccctgttcccacaacctccatgcctgtatgcacgaaagaggtctaactgaaggatccaaatgccattgtcttgcaatgaagatttgatgtgttcagtgcactgcttgattacctgtggaagaagcgtctgcattgagccgttgcgaacgccgctgagcgtctccaggaggacgactccgaagctgtagacgtcgcacttgagcgtcatctcgtctcgtaacgcgtactccggagatgcataacctcttcaattcacgaattcaattcaaggcttcaaatcaaaacttgagcaacattgctactaggaacagccattagtttacttactgtgagaccacgagggtctggcctgactgatcggcgacgaacagcttggcggtgccaaagtctgcaatcttaggcttcaattcgtcgtctagaagaatgttgctcagcttgagatccctgtggattacactcccgtctggtccttcgtgaagatacgcgacacctttcgcgatggcctgaattatgtcgagtcttcttctccagtgcagattagctcgacgcggcaacgggcctgaaatgaagaagaacatggaaggtgacattatttattcatgtcatggtgaatttatgatcaggtcagtgatgtagcttaataagctgaattcagatagaacagggtgggtaccgaaaatgtggttgtccaagctcttgttcttcatgtaggcgtataccagtatacgctcattgccttcgttgcagtaagctaggaggcggagaaggctaccgtgatggagcccggccatcactgccacttctctggcgaaatccttcttgcctttgttcgtcagagctgactgctttagcctcttcacggctaccattctcccgtcagattgtactccctggtcatttccaaatttcaggtgattgcaattgcatttttggcatttgccagtgtacggtattaagtatttgcaacttatgtttaatttcttttttcatgaggattagtgcaactttcatgttacatgtgtctatcttctgaagagagaggctcaccttataaacggtgctaaatccaccttcaccaatcaagcaattttctgagaaattttcagtaatagactttatagtagctagattgactgaagcaacgcccatagaagggttatctggaataacatctgtggtattagcaatttagcatacagtttgttagcttagaacttcataataaatatccttaagattaaaagcctggatttacctaaaattccgtgattctttttgcaccaaatagcccaaaccccaaaagcgatcaaaagaatagcaatggtagcagctacaggtgggacaactagtacaatcagagaccttttggtctcaactgttactcagacaaaaaaaaaaagacatagagagagatcagttcatgctcagaattactcccttcgctgacttttctagttaaaacttctttagattaaatcaaatttatataaaaaattaaaagagattgcgacatcaattaggttcattaaatataatattaaaatattttgataatatgtttatttgtattgaaaatattgttatatttttctataaactaaattaaacttaaaaaagtttgaataggaaaaagaaaaggtgagagtgacttatattcgagagagtatcatatgtcggcatttcttttacggtgacatcaggatcgttactttgttaaaaaaaagaactgttactttgacatttctttcgctaatcttttatctggggtcattttcattcaaaatataggctcggattgaaacccattttcattattgttttagaacataatctttcaagataaaattgaaaataaagcaatgcacataccaaattcagacttagccaatctcaggtacaaatcctgcccgcggtcaacgtagcgaagatcgacgatgtcgtccgtccaaatgacgcagccgccgccgttgatgtcggcggcggcgtaggccacgcacgagcagtttcccaggcacctccgctcgcactccgccgccgtggcgcccatgtccaccgacgcgttgcgcgtgtctggcagcttcaccccccgcaccaccttgaacttgtccgtcgtcctgctcccgccgccgccgccggcgcagtccagcgccacgcctcgccggcacccaccggaggtgttccgcaacgcccacgccgacggcgacgcggcggtgaacccatccacgcagccgcagaacgacgtcgccgcggcgtcggcgtcgcacaggccgaacggcccgcaccgcgcgtagctgtcgcaggggtccctcgggccctggaagaatcgctgccatgcccggctgctcgcgtcccacacgaggcgctcgaccacgccggtgtagttcaccacgacgcgcgtcaatggcgcggcgccggccgtggcgaccgatccgtagccgtaggtcacctccctcgcgctggacgtcacctgcagcgggaacttgtcggagtagttggacgcctccgggacgccgttgaagaacctgccgttccacgggcccgtgcggtacaccttggtggcgccgccgccgccgccgcctcgccacaggacgagctccggtaggccgtccgtggccagcgtgcggcggtagtcgcccggcgacgggtcgtcagcggagcgccacgccgtgatgaaccactcctgcccgctccacaggctcttgcccatcttcatgccgggcagcagcgtgtccgacggctggtcgaacgactgccacaggtaggcgtcgccgccgctgccattgcgcacgacgaggttgccggagtcgagaagctgaaccaccgcggcagaggcggccaagaagctcgcggaccacaccgtccggcgagagccgccgtcgagcaggacgagctggctgccatcgtcgttgagcagcagcacgccggacttgccgtcgagggggcggtcacggttggctacccagtagacggtgtcgccggacacggtgaaccatatgccgaggtatctcttggtcgacttcccgggagagaagaaccccagagtgtacgagccgccgccggacgagacgagcgtctggccgtcggtgaggttctggcccttgtcgagcttgtcggcgacgcccgcggcggcggcggccgacgtttggccggagaggaggaagaagaaggcgaccaggcggagtaggttagacgattgcctggttgacctcatgacaaggtcaaaatgtctctagctcttgttgcatgcagaaaggctagctcatgcagcagatggccatgaaggatggtcatgtatactgatcataggcatttctggatatttggattggaatattggatgataaactagttaattcaggtagtccggatctgtctatttagaatttgaaagaggtacatcaaatcccatacgacaatatctaaattctctcaaagtcgtactccaactaattggctgaatttattaatttgcactcaattgggtgtgaaaaaattgcttaaaaagtgcaggtcaatgtgactgcttcgttccaaagatttcttcgtcttagcacgacctgtggctacacgtaaccatgtagcagagctttacattcttttggcctgaaaaaggaaatggagaagcacaatatgcatcctagttatccaatgggttaacacaaggcaaaagtctcccgtgcacgatgtctcacaaatgactttttacagacactcaaatcctactcaaaatagcaaacagatttgataaccggtcactagggcctgtttggttgctaccctgaaaaaaatttacctgacctgagactagcctgactcgttctaggctctgtttggttgctagcctgacactcttttactcaacacggagacgcgtgattagcctgagtcaaatcggtggcctgagcctcaggcgcagcgaggacagaagattaccatcataatctgtttcggcagccagcagaatgaagctgccctcccgtgaagctctgatgccgccactgcgtgaagcccttgcctggctgcctccgccgccgtagctatcgccgccgagtgaagtccatgccaccgtcgccttcgtctacgcgaaagcccctgctgccgtcgccggcgtgcgacaccagatttatcccgtcgtctttcgcggcggctgtcgattcttcggatcccgtcgttgttgcaacatcttggcgcgaagcttcagccaatgctgtgattcttttcgctcctgtcgttgttgccgattgaagcttgccgactgctgcttggatttggggatatttttaatccttgtactcctttggtttccctttttttatgtatgtgattaattgctattggaaagctacgatttcagttggaactgtcaagcaatctcgccgaaatttgcgtcttcttgtttagcacttaacttactagtgaattatcagacccaaatcactttttcccttctcaggcagcggcggcaaaccaaacaagcaaaagttcaggccgcctggccaggtaacattcaagaacttctcagaagcatggtgctcagggcatcaaccaaacaggcccacaacaggaggataaatttcctggtgttgcataccctgatacccagatgtataaacaaacggcattccaattcccaaatacgcttacagttccacatattacaagcaaacctatatacaaaaataataacaggtttattactaggttaacaacaaacaaacagggaaaatgagagacaccaacttcagtaatccaggttggcaagttgaacaagagattcagaggcactgacaaggagctatctgccttgcaattgagtatacgtcaactgattccccgatccagtattgttatcatccagaggaacccttccgacgaaaaatgcagcttgcttcggagcaggaagtgtaacatccccactgagcatcctgagcaccaggggcatgcttggcctatcacctggtaattcctgcacgcacagaagaccaacctggatgcatctgcatacttcatcgtaagagcatatggtgcccatgagtggatcgatcagctccgagacactgccttccttccacagtgtccacgcctgaaatgggtacagtgaattagaagatgccaatcataaaacgtgtattgattaccatatagtttgccatttaactggaaaatgacaaggggaagaagatagtatcatcttacgtaacccaagagattcattgaccattcttcatcaacaaatgagctgttccttcgtccgctcacaatctctaggatcaacacgccgaaactgaagatgtctgatttctcagagaatttgccctccattgcgtactctggagagatgtagccactgcatctcacagattttagcacatttagtttgccttctaggacatctcgtaatgtcaactagcaggtggattttgttatgatctaaataatgtagtaaaatcatagagttaatgatgcaagaagaaagcagtagtttagtgaggcaggtcagtacagttaagagttggatcgtagaatttttgttcaattttactctagtgaacaaaagtgaaaaagagccttactaggttccaacaattcggtgggtaagggcttgaagttggtgttcaccaaatattctagccataccaaagtcagatatcttggggttgaaatcatcatcaagcagaatattgctcgctttgagatccctgtgaataattttgagcctggaatcctgatgaaggtacaataatcctctcccaattccctgaataatcttgtatcgcaatttccatccaaatattagcctcttactttcatctaataagattcacatgaaagcaccaaattagcagacaagttcagttactggcttacatctaaacaaaatcagaacgtcaggatttgcaggaatcaaactaaacgttaccaaaaataaatgagtcaaggctcttgttgggcatgtattcatacagcaacatcttctcttctccatgaacacaacaaccaaagagcctaaccaaattccggtgttgcagtttggatagaactatcacctcgttcttgaactcttccaatccctgactggatctgtttgacagcctcttgacagcaatctcctggccatcaggtagtaccccctagaagtaatatcaactatgttggttcaggtattgatcttatagcattacgattttgaattccaggtcagaacaaagatagtaaaaacaacaatttcattcatattaacaagataggataaaatgataaaatgtttaaatgaccataccttgtaaacaaaaccaaatccgcctccaccaagcttgttgctaaaattatttgttgctgaataaatcgtgctaaactcaactagtggtgagcttagaactgcggatttcactgaatcacttctgaatatagcttcatctgcaggtggtccagcttcttttgtgatcagccgtggtgcttgtattctccttatgcctgcagattagtaaaaatattagatataaacctaccagacagctgttaacgcaaactgaactatatcagcaatctctaagactaagagataactgtcatgaaattatgtttggccgtagaatattatgaagtcttagccttgtatattcataatctgaacaatggcatgtatcatacaaattattcctctaaatcatacaacagaaagaaacactaatgacatcgtagaaggaatccaaatacatgtgaagaagtcagtaataaaaatattacccatttgctttatgacaaatttcttcaggcatccaaacacacagaaatgcatgagcatgatgccgataaggaagatggcagtatcagcgctcactaagacaattgagcatttatgctttgcctagaggaatgcatgtcaacatcgaaatttcgtggatttgcaagataatatgttgtcaatgctccgttcttatcaaacagaacaactggtcaacaagattggtagaatgacaaataaaaactgataaatttataagacaatggaacgtgatgtattagacactgttatccttcgcttgaccacttcaaccattccatgttcttgacaagttcagtatttgttgacgagatcatgaataaacaatcttaggatgtcactatctgaccatgccacctcctagctttgcttaggagttaggacaggagcgaagaaggcaatgcatttttttcatagagcaatgcttttcgttggcaagtggcaacaaattaacagcagccggagaaatctcgggacagtctagcatggaccaagtgctgaaaaaaaaatgaaaattgagacgcggaaatgtacgtccttgcagattatcagattagtcaacatatgcggcgaataactaaaatttctaactatcttcccgatccctaactcacaatccctgtagattgtctatacgggtataggtgggaacaggatggaactgggattaaatttttgcgggacctaacaacccagaaatttcttcattcatgcaggcaggatgacatttcgtgcattcctataccaaaaatatcgcttaaaatctgaggtgaaataagggaggagtagtacgtagttactgattctgggtcgcctttccgagcaagggaaacgcagatcgccgaggataagatggggagatcttcacggtggagaggatctgggcggccgacccatcgcgcctacggccggcgggtccccccccccccttccatcgccggccagaccgccggcggcttcggcctcgtcgcctccgccgtcgccgcggcacaccacctcgccggcagcgaatcccctcccctggaggccagtccgactaatgggctttgccgttagcggcctataccgtaagcaggccagatctagttgtcacatgcggaaagaataaattcactttaggtccctctatttgtcgtacagtctgatttttgtctctgaagtgtaaaaccggatacaacatatcccccaacttataaaaccagcgcacataaggtcaggtcctaaggtggtttggatagcagttttggctgacgtggcgcctacgtggctggtttgactaggtctccgtcccacgtggcattgacgtggcacttacgtagcaattatatctcaaaaaataataaaaacagcgggcccacatgtcaactacacaaaaaaaattaatttagaaatggtggggcccacggtggcccacatgtcaactacacaacaaaataaatatggtggggcccacgtggaccccgtatgtaggctgtagcaatttctttctcctctctatacccttctcccctaccttcccatatcagccattgccgtcgacgaagaagcttcgcgtgggtggtagagcggggcggagtgaggggcggcggcgcggcggatcctcgcgaccacgtacggcttcgtcttgacggcaccgacgacgcggaaccggtcgccgccgacgtaccccacctcgccggccgccaccccgccccccactccgccgcggcgccgccgcccgccggagtacacgacgccgatcctggagccacgtgtgcaccatggtccggttcctgaactcgaacgcctggagctgcaccgtcgcgccgggaagaccactgacgggaacagcacgatggggatctccgccgcttgctcctgccgcggcgccctcgtccacgcagccgtgcaggttgctgccgcccctgcatgtttcccatcaaacgtgtactagcaactacaaccagcaacaccatggattgttagttgagatgatcacatcttccatatatatcatatcagttatccccagctcctaggttttttctccagctatgatcaatgattcaaacgagtacactttgtccgatccacaggtctgaatattccatccgcagagaattctgagacgacgacgacgaagaagctagatggaacttgcagagtcttgagcgccgtggtctcctcctcctcctccgcggcagcggcggcgggctgcctcgagctcccgtccacgtgcggctgcgactcggcgggcggcggagccaagcggagggcgccagcctcgtcgtcgtcgtcttccggcacgaagccggcggggcggggcggagcggggggcggatggcagcgcgaagccgacgggatggactggggcagcgacgggcggacgcgcgggcggagtcttcttgaggtcgtcgtccccggcgccgccgtgaccgtggccggagaggggagatggggagaggggaggaagaagaggtaggggtgagtgacatgcggggcccacgtgggccccaccattttttattactttatgtctaaaactgacatgtgggtcccatggggtttaatattttttcatatcaagttgccacgtcaccaccatgtcaatgccacgtgagacaaggagctagtcaaagggagccacgtaggtgccacatcatttaaaaccgggcacaatactgccgagggactttttctgcatggttttgtaagttgagagatgagttgtatctggttttgcgaccaaaggatagaaataggactggacgacagataaagggacccaagtgaacttattcccatgcggaacaacctacaatccggcttcatttagaatgggcctcaattcaagcccatttatctgtatgggctagaatttaagttcaaatcctcatccttttcacgcttgattgggctgggattaaggcccatttatacacggccaccatgcttctttttaccaacgaacgaactgtcgcattcaaaagaagagaaaacacccccccttcttctttctccttgacgtcatgtcagtgaacttgttttcctttccctccttcaaaaaccatgtaagcaaatccaggagagaaaaaaataaagatctagacatcggacggcactatccaagtttaccacatcctgcgggcagagctcgcgtcactgccgtcacaccgtagggagtttaacgcgcctaagcatccacacccctcgccgggcgtccgcatcaacgctgctgctcccgtcgccgtgccacccactccaccatcagtccatcacatattctctcgtcctatctctgatggcgctgtccacatgcgccaccgtggcacgcgccgcgccgcgccgcgtcaggcgtccgtcagcgggtggaaacccaccggtaatgagaacgaacgccaccgcgaccacacacagaacccgctcggaaacacaaacatcggcgttgaacgcgcgacgaattccaacgcgagaacgcgcccaaaaccgcaaagcagccgagcttctctcgcgcgcgcaccaaccgccgcccgtgcccggtgctccccccactcacggcactacaacaggaatacccctccaccaacgtataggctgcaacggaagtgataatcgttgttaagcatccgctttcaaccactcggccacgcccagcgacccaagtcaacagaaacgcaaccaaccattatcttttcctgaaaaacctcccctcacaatcctcgcccgatcgaaaaggatcgtgatcccagatcgctgccgtgtcaatgctgcgccgccccggcccgagcaccgccgcctcgtccctgccctgaccccgccgcatcctccagttctgccgtcgacgctgcgccgcctcgacccgcatgtcgccgctttatcctctcccgtgctgcgccgacggctgaccggcacgccgccgcctcattgccccgatcgcgatggcccctgaatcccctgaccctgttgcctggaccgccacatcgtgctccatctcgtccgctgctgttctcagctgatctggtatgtgattgcggcttctaatgtacgaattatcattattccctgacgtggactgttgtgtgctctagatacttcgttaattttgcaagaaacacacctaaatcctgtagagctttatatctgcgataggcaagtaatgatgccctctttctctgcaggttgatccctagtgacttagttattagttattgatcatgccccaagtttctcgatggaattgcaatgtaagctaagtgattagtgaatcttgtggctatttttctgctctggtatgtggtaatgacatgaaccatgccttttttattaactttatcattatacagtgcagagtaaccataaaaagatataaagttcatagctcagattgtcgactttttttaattagtttaagttatgttttgccaattactacctgctaccagatacataaatttaacatgtggacagttgtttgttgctgttctatcatctaaaagatgagtgtattcatgccacagaaatattctgcttttcttatgtccaagttccatttatttcagtgtgaagaattattagcagagaattcttaaccagggatggttccaaagatgcttggcacaaaaatttagccattggtgaaagcaaataatttgatccaaagagtaactctggctgttaagtgacaaattgagatctcattctgctacatgaacaatggtaagatttactaggaatatgtcattgcagtttaattgtcgtggtgtataagttatccctttgtgttcttatctgagctatataaactaatagaaacattggcatttaattagaaatacctggaatcatttccaattgtgtatagcagttttgggctatcttgttgatagtttgtgcaattttttgacagggaaagccaacccatacttcggattttttccaagctgtaatgggatgttaaatgttcatttccattacatatcttttcctgtaatccagtgacatctattttatggtgaagtgttgccttgaggatgatgggatagaggaagaagaaattgctaaggagaagatattgttgttgctgccaagtgcccaagttacagaaactaatgttgatctggtcacagagaaaattcaagatgatgttttttttttttgcaagattcaacatatgtttgtactacactcactaatatgctgtggtgtatacacaagttgtacttataagagatttgtgaattaatatattgtgatttttttcttatagtacttatgagtttttcttgtccaaatggaacctatataagatcgtagtgtaaattattaattacaaattggcaagtaagtaatatgtatttggtaaatgtgaacagtatcttccagttgcatcctattgctcacttacaacagttatttatgtcgttaccaacgcttatgtatgtatggctatagatcgtagcaacgtatagaccttagcaacgccggcataggcaacacatagtcaatgtgttgctattggaccttacaacgcttatttagacctttagccacacatatattcgctgctagaggggggttcctcttgtagtgttccggcgaaaagaaaatctacagaagcacagattctcgcgtcgcctagcgactagcgagactgctaagctagagtggttggccttaatcaaatactgctactgtccaacttgcggttcggctcatgtgattggtcgtcgcgtgttcattcgcgcacgagttcaatacttgtattactgcactgatcagttctagatgcatacatggttggtatttggcatctctgaaaattggacttaggattggatttacgttagacttgtgagggcattgaattgaacatgtagagacagacgagaggaaggagtagttgcgttggcgcctaatccgtttgtcgacagaaggaaataagcagcaaatatatagaatgttcaaatgcaggttctaacgcttgggaaacttctgtgtttggtcaactcgtctttcttaatgggtgatggaaaatatcttaaccgtgtcagcaacacggcaacttctctagaatctagattcccatgcaaaaatgaactattttttctactctaaacaaatctgaagccctcgaccacataaacaggtctgaataatataaccttaaatctgatgaaatcgatctttgctcactgtaatctgctcactaacctgaatacagtgatgcacgcaaaggcaaaaaagtataaataaaaagccagaaaagtcagaagcatctgtcatcatggcctcatgggtgccaatggatgatgcagatctgggacagatgagacgacaattgggcaataatgcccaactccaactccatgtagagaaggaaatttcgaacggaggtcgctttctatatttctcttgtcctcttcttctccccttcgtcctcgctaccatcgccctattaatattcctcaaaatccaaatttgagacaacccgaattcagtcctcagcgagtcggaaacgcgccgaaagacgaactggaggcgcccccccaaatcttgagatcgcaggtaatgtccataggcgccgagcttcatgagtcctcctgcgagggatcttgtcttgaggtttcttgcatattggcctgtgcattttgagttttgatgtgcttgctgctgatccgaattccatctccgttgttgccgtaagattctgaatcgaattcatgcatttgtacggcagatttttttttcccccgctagatccgtatggtgtggttatttgggcgatgatagtatgggtccaagaaacgcggttttccctgtgaattgaggatctccaatttgcttctttggcttcggtccatggcagttgtgttctccaatcccatggttcatgctagacgcttcctgcagacaggactagacattttcagttttggtaactgtgaagattatggcattgttttaccaagagaaactgctgcattgtgatatgtaaaaaattaccctttttttccttctcttttagtagaattattacggaacatgcttcgcttggcgtctgtatcgatctacgttctttattctaaaaggctgtgcttttttgtgagcattgtcatccttttttttttcctttcaactccttctgttcatttaatgaacaattccgttctttctggtgttgatactgccacgttttactgattttccattattttattaattcctacttgacaagattcttatcgaacaattattgtgaatcttttagtaggaatctcgtaaagcgccagtgtcgcattttcctttgaggatctgatttttcccatcaagcaatggtgggatagccagtagtaaaatttaggctttcaggctcactccacatcagaaaattttctacttacatactatcgtttgtagaacaatcgtggaagtttatgcccttgctcaaaaaaaaaaaaagaacaatcgtggaagtggaaaaagggttccgtgaagcgcatagatcaataatgtctaatctcttttcactcataaaaatgttttgcaggatggatggacatacaaatggcactaatggttcctgctctaagccatgcgagccattaacagactactgcatccctgattacattctgaatcctgactctgaacaagtcctcgttgatcaggcaccatgttgccctgtagtagtattcatcaactctagaagtggcggccaactcggaagcagtttgatcaaaacgtatcgtgagcttctcaataaagcgcaggtacctaatctagtagtttgggaagatggaatgctgaaaagattcccttgagccatagtaggacttcatatcattctctcatattatctcatatttggatccacaatttttacaggtttttgatttatcagaagaggctcctgaaaaggtgcttcacagattgtattgcaactttgagaagctcaagtctaatggcgaccctattgcttttcaaattcagagcaacctaagactaattgtgagtagcctaactagaaaacataaagaatgatctttttgctttaggatatgtcctcttaactaatgatctttgaaataggttgctggtggtgatggcacagcaagttggctgcttggtgtagttagtgaccttaagctctctcacccacctcctattgcaactgtgcctctgggaactggaaacaaccttccattctcatttggatgggtatgtctatgactattgttttgttccaacacatatattctcttcagttgtgataatctcctccctttagataattcacgcttgttgtgaatttgtgatcatatacgagctgtttttgttgttgagctgtttgacaacataagaaggtttagcattaagaaacatgcatttttgaattaatagtgaaatagtgatcatacgcttgatacctaaattttatgtcttattgactgtgagctgtgaggggtgcatgatttttcattctaaagtagaagattactgaatctgagattttcttgttagtttgatctggattccttggccgtctttttacctagtctgcataatctgcagccatgatctctgaatcttccctggcatctagttttatacctctattaaatttaatttgactgcaggggaagaagaacccaaccactgaccaagaggcggtgaaatcatttcttggacaagttaaaaaagcaagagaaatgaatattgataggtaatatctcaagcacacaatgttatatttgtttctgttttttctgtcatgcttgtgaaaagtacaagtcctgcccaataattcactgcgacagctctttcatatatgttgtgtagcagtcatttttagttttaaacatgagtaaaatgtaatcccttatatattctgcatatgaaagaaaacactcatttgaatgtacttttttaagttggcatatcatcatgaggatgcgagctccacaggaaggtccatgtgaacctattgctccgttagagctgcctcactcattgcatgcattccaccgtgtatcaggaagcgattcacttaatatggtaagacaactcactgtggatactgtttttacttgattctttctattacagaagtagtagccaatagccatggactttcacttttgaatagtatggacaattggacaggctgagaactgaatatatagatctttaagcttgcttagcagttttttcttttatatttttgttcaggagggctaccacacataccgtggaggattttggaattactttagtatgggtaagagttcctctggtatccaaggcacagcatgatgtttttttttttttttggtttatgctagttcttgctctaacagatatcaaacagtcaccgttgttatccagtaccttttaatcaggacttgttaacaatattatcgtagaacatattttagtatcttttaagcatatcatgattaataaggcagtaatagaaacatggtcatcatgacttcacatactgcagggatggatgcacaagtgtcttacgaatttcactctgagaggaagagaaatcccgagaagttcaagaaccagctaacaaatcaggttcttctcgtttctgtagggcaagtcttgtggcacatttcattttgtttatgctgaatgttgtgatgcatttctttgatgcagagtacatatgct

SEQ ID NO: 64896 - DNA, 2843 bp, Oryza sativa
tatatatatatatatatatatatatatatatatatatatatataaagagacagagatatcatgcattttttttctagggttcaatttttaggggagatagatccatgtttgggggcatgatctgtgatattatctggtttgatgtgacggtcacatgaaagaaactacttcaatctttagatgcttgatttgattttggttcttcaggcagggtggaaactgaaatagtctttccccttggtttgggactttttcttctttgtcttaattagatcttttcctatttagtccgtttccacttttggttcgtcctttttccccctcttttggccatgaatagctactttcctaaagttccatggatgcatacatggtgcatatatatgtcactaatgctctctctctctctcactatgatctactatatactccctctattttttaatagatgacgccattgactttttctcacatgtttaaccattcgtcttattcaaaaaatttacgtaattataatttattttgctatgagttgttttatcactcatagtcaaacatgtgagaaaaaatcaacggcgtcatctattaaaaaacggaggcagtattatattacggtgccatcatatatattccatcttagacaaattcctaaaattttgaggtccctaattaattaattcctatctactgactacatttttacagaggaggggtagtagaaacttctcagacaaggaagatcagccccgttttcttctagggtgcgaagggcccagaaggaagagtttgtgagaagaacaatatttgtcagtgatatagaccatactgtaagatactgatatttccatggattgcaatgcgatgaattttattttctatggcttgcatatatggagtaatttgtcacatccaaatataatgtgtgacacttcatttgtttctgaaagataataatggtatgcatttgtgtgtttcaggttactgaggacatgttagctgaactgttcgggagctattgcagcgtacgcctcttccttcccatgtgtatatatatgtgcctgagtaaacatttttttagctccactattttttttatccttttctttttgcgaaacacagtgtagatgcaagcgtttatataaacacgcgcacacttagcttcactagttttctaggtatataactgtgatatgtatggtgattgagtaagactgctttcgatatatatgaaaaacttttgatattgtgatatatatcattcatatgcatatgtatatagtaaccaaagcatcatcatttgcaagtgccaagcacaattatgttcatgtgacgcactaatttcttttttatcctttgaaaggcttgaatcaggtggtggaacgtactctttagaagtatgtatatgccagtttgtaaaattttatggacatgcatgtttacttcagaagatttttgtttataacagggtcctcttaattatttggttctagctagtaaagatagtgttttcataaagttagattttaagtgaaacgaataatcgcttcgtgctatgctgggagcaatctaaaataacatgattttctctagtttgtaatgtcctaaacgccttaaaattcgttgctctagtttaatttgtccatatgttgcaacaggtggtggtggattgccgcatctgtggagatcactcatctggccttaggtttgcatttattgaatttcaagatgagagtaagtggcacatttcaaacctgaatcttgtttttcatcaatacaagtgagaggttcatacaaatataatctggagatataacatggaagccccctttttttttcaggtgatgcttatgctgcattggatcttgatgggtatgttcttggcatttgccctcttagggtttcaccttccaagactgcaatcatgcctgtgaacccttcttttcttcctcaggtcagtacagcccaaggaaccatgttattgccatgatttataatcaagatagatcatcccattttcaacatgttgtgtactcactcttaaattaatttgttcggtagtctgaagctgagagggagatgtgctcaagaacaatctattgcacaaacatcgacaagagtgtatgcgaaaccttaatcctccttgagaaaaaattctccaataattaagcagttgtctccaatgttaataattaagttccttgttaacttttataggtcaatgtaacagatttgaaatacttctgcgaggaacactttggtcaggttagaatataatcatctcatgaattgatattcctcttcattaattatttttcagcagcacacactgtatatatttgagatttattctggtccaacaaaaaatacctcgagatatcggcacctcatagtaccaaatcgtttttatcgttggatctacctggataggattggcattgttggactggagcaaatctcatatatatttatctgaattttttgtaccgtaatatatttatctgaattatctcgctttcttccatttcatggattatatgcaggttttccgcctaaaactgttaggtgatgatggtcaccccacccgcatagcttttattgagtttctgaggtgactctctcaaatatgtcagttctcaatgcagtaattttcgcacattggttggcttgaatttaagtatagtagatggtgtaggagcaatgtaataataaacatcctcattaatttcctcatcctaataagcaagctgttcttcttaatgatcgataatcgatcactagctcttggtttagatcgtcctagcttacagcccatttatatgcatatatgtaaatgccatgcacat

SEQ ID NO: 64897 - DNA, 6189 bp, Oryza sativa
cctgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctctgcttctgcctccgccctggctgctgccaactctgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgaacgtcggacatggcgcacctccggggggctgctgcgtggagagggggaagggaaaggggaaggaggagcagccggtgttgctgctgctggtggtggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattacatgcataggatggtgtgtgccatgaagaggagcatctggtaccaaacagaaatccacatccacatgaggtactataccttgccagaatctttccatggagtcttgccaaaatcagcgatgtcggtgggagaggtgctggggctttgttcccagtaggagaagccgatctccgtctgccggcgaagcatcgatatcagaggctcctccagtgaagggcaagcagtgatctttacccttcgaagggagggaagcacgttagtctgacctgcttgcaatccaccgttcccagcagtcacttcacagcgctccttgagcccaactatggtctctaacttgctgcacgatgatacggtgatccctgcaagggcatggagatttgacagtggaaggcgcacaagcttgtgtgagcccctgatgtcgatcgtacgaaggagagggaagacacaatgtggatggttttcaggtagccaccattcctcccatgcaaccaggttctgtaccaccaatgtctcaagacactgaaatggggcctcgcaatcgccgtagaactcaggccctatgcttctcaatttccacaggctcgtcagcttgagctgcttcaggtttggcaattgtccaagtggtggtagatgatcagtgtagtagcacttgcacagctccagttcttgtaaactaaacaaggaccggtctcctagccatgaacagaagttcaatcctctaaaaccacttattacgagttgtcggatgtagttgtgaggctgcagggattccagtacaacctcatcatggggtacgcttttgtaggaaggcagaggattccacactagttctaagcgagttaattttttcttgctcaggtttgcactccttggttcccaaattctgtcatgtgtgatgttctggagatccatgatgcagagctgcccttgaagagtgttaatgtccttgatttcatccagcgtggcagctccgctccctgaattggccactgcaaatgttgatagtgactgaagtttggtcagccggtggattcctgatggtattgtgacagggaactctctcggaagaacaaggtgacgcaggttggacagtgccgacacatttctgggaagagatatcgtgtcaaaagggtatgtgtttcgtagagtctgcagcttgtacattttgcaaatagcctccggaatttctctctgacagatcccaaggtagcggagatgatgaagaacccccaccgatttacccagcttgatctgatcacttgatgatacatccaggattcgtagatacttcaggtgtggtgaatgcagcagacaaccttcaaggttataccaccactggctctgaacaagcacctgaaagaacgtcctcaagttatttctaacacagcttctgagataagttctccatttactctgaaaagacagtgatcttaggggaaagtgtccagcaaccggaagagtaaaaggcaccaatttattgtctgagtagaagggcgttgttccaacaagaacagctaaatatcgaagatgattattggcactagtattgcaaccaccaacagatgaaccacaacactttttgacaaggatctctttacccccaattgatttagcaaggtcatgaatgaggtcgtgcactatgacaaacttctcccgtgaaccagccaactgcaaattttgaagaaatgatctccgaaccaattcatttacatacaagtgcccaatttcttccatccttttcacaccgtcctcctgaatgaaacccaaagcacaccacatatggaccagctcctctaagtcaaatttgtgacctctcggaaaggcagcaagaaatgtgaagcatcgcttcagaattgcaggcagactgtaatagctcaatttcagaattggaaggatgtggtcccatccagggcccagctcccagagatcacttgtcagtacataattccagaactccaagcttgtgtctaaagataacattgcacctagagtcttcaggactagtggcactccatcactcttttctactattttccgcccgattggtcccaactctgtttctctacaagcattgtcagggaatgacaatttacagaacaacgcccaactgtcatctttttgcaacccacctagatgaattaccttcttcgcctgcacaattgtggagacattctcgttgcgagtagtgatgatcatgtggctccctgtagcaacagcagaaaatggccgtttcatcgtctcccatttgatggtgtcctcattccaaacatcgtcaaacacaagcaatatcttcttacccttgacctcctcgtgcaattgcctctggagtggctctagctcagtcagatcacagggtttagcggtgaccgactcgattgctgctttggttagtctgacttcatcgaatacttctgaaacccaaacccatgcttgtatatcaaagtgattttgaacccttgcgtcattatagacgagcctagctagtgttgtcttccccattccacccatggcaactatagaaataagccttacagcaccagctttacaagtttcatattcatgttccttcaatcttctcttcttaaatgtaaggcacccatcaagcaaagaagatattattaattttttctcatcctcccggccgtagacctccaatggatcaagcaaagaactggtgcacctactaatcctagattctttcctacacaatccttcctgatcaattagcccaagatctacacgatcacgacagatctcatcaagaaatttcctaaccttgcttatcctgtctagtatattctgttgaaaagagggattgtttggtccaaagtctgtatagtctgttaccttctcttcctggacgggggtgctgcggagcaactcatagctgtaatcttcaagtatcccctcagcttcccatgtcacttgcttgagctcagagatccaaagcttcatagtctcgtcagcgatttccctttcatctgcatcaaccaacaccgcggtgattcggcgcacagttctgtccagcttggcacctcctcgttgacatgatcagtcagagatggtagttcagctgatgacagatatgattgttgaggaagcgcaggtgataatattctggatttcatcccaaaaaagtaggagaatagtgaggaagccatcatgaactcaaagagaaatactaaaacataatcttcagatcaagaaactgatataaggaaaatggcgtttgggtcaagtcaatgcctggccttgctccaatccaaaaggaatgagcttttacggtgttgcccctaagcatgcgactaaaatatattttttgcaatattcaacaagctcctatgagtctgtaaaaaactattgcacggtggcaaaactgcaggagtacaggaatacaggataaggccatataatgttcctggaaattgcaaatataaagcatcggtgttgttttagatcgaattttatttccatggttggaattatcccctttcagcagaaaaaaaaagtggcaggaagtgagaaatgggtggttacctgcaggctgcagaaaaaccagaatttgaagttgatttgggcctgaaaagtcataaggaccaactaatacatgttagtgatgctgaccagtgaccaccaagcggctactaggaaagtcataaggagcagctagtacataccggtgatgctgacttcaagtaaattgtaaggttattaaaatcagcatcatcctgaaacagtttaatctatgtacgagcacctagaacaattttatgcagaagcagtgatgttaatcacaaataaatttgcatgtacatgttagaccaggtaaatgaattctctacagttgcattgggcttttgtagataatatataacatgcttcttgtgccctgttacgtaggtggaatatacaaagttccagcaacagtaaaaattcaagtaagtagttagcattccagaaaaatcttaactgaactgaaattaaacaagaggtgttagtactacgctacaactgccctgcaatatagttaccgtcctccgctgattcaaccaactcactcaagagtcaagaatgatccagagaatatatataacagggaaactgttttaacaacttgagtggatgtctacccgtttattgcatatcatttaaataattatgaaaaaaattgaaaaaatatgaacaagatagatcaatatgtaatatatcactccacaaacatgcaagttaaaattcaaattctacaacttgtagaagttgaatttgaacttgcatgtttgtggagtgatatattacatattgatttatcttgtcaattttttgtaaccatctagttggcatgtaataaacggatggacgtccactcgagctattagaatccatctccatatataacatggttcttgcgcgatatggtgccagtcgaatatcagcaacaggaaaactcaagcaagtagttcgaattcatgaaaaatcttgactgaaaattattgttaccggtggaatttcatggaaattctggtactgtccccgtgatgctgcattgctgttgcattccttccctgcattaatccaagtaactcaatagtcaagaataatccagatagtagtatatatttccccaaacttgactaatcctttctcgttacgaaaacgaagaaggagaactgcgattccagaatatgaaaaacagattaaaaaacagtgcttggtgagcactgagctcaatcaacaagggcttgattagccgcagcagttgaactagccgt

SEQ ID NO: 64898 - DNA, 3777 bp, Oryza sativa
tgacttgatggcaagaagacgagatgtggtagataaacaggagtgtgttgtctgactatgcactttctcatcagcactagcaaccattctgtagaaagcttgggcagaggctgttggctcttcctcagaaagctcatagtcaccggctatgtcaaccaacatgtcatccatccgatccaattcatcaaatttctcattttctgctgaagttgtagcttgatcttcttgaccaatagaacactcaccatgttctgaccagttcatgtaattctctttgaaaccctcacgacacaaatgcatctcaaccatttgccttctgtgtgaaacatagtttcggcacaaggagcatgggcacttaatttttccactaacaacaacatttggcatggaaaaagcataatccaaaaaatccttagtttgctgtacccactcatcagtcggtgcacgaccacgtttccagccagtatacatccactcacggttattttccatattgtggttctgtatgttccgtcatataaaagttattttcgtgtgtttaaactaactatctagttttattgcaacgacgcactatatacagtactagtagctatattaatacaattctatatatgtgcatatatatatctagatagtcacaacaatgtttagttggtaaaatgaagaggaaaacttaattcagcaagcacatgcatggtggcaggtaacttaaaataaaatttgattcaaaattgcatctcaagctttaccttgtaattttttcttcaacggatctgtttggtgcttggtgtttggtgtttggtgatgttactgatatttcttcagtagactgaacctttaggttagtccctatataatatgagaagaattcagaacctaaacatctatgcattaacatctgaaaatagtatgttattttcataagcacaaaagactaataagcatagtagaaaataaaatgaaaattaaatggcattgtttgacatgcacactgaatagcttgcactaattctgtattgacaattcaaaagctgatccacccattccaataaaagaaagccaccctatctagttaagccacgcactacacagatctcagaatgcttgcatccatttaataaaaagatagtattaaattactagttcacaccgcatggaaatcattttaaaaagcaagaaacaaggcttacaaattgatacaacaaaactttctgcattggcatttcatcaaacacctgaagaacatcaatcaccacaagatgtacagaaataatagagagaagaacaagtaccagaaggttgatgatgaagattggggagcacctagcaccaatcaccggagaggtgagcagcagcgacgcgcatcccacggcgaggagaggaacggcggcggcaaggacgccacccaccgtacaagagcagcactgcgccgccgacgagggtggcgaggttgtgtcggccggcgggcggcggcccatatctagacgacagactttgctgcgagttccttagagcatcaccaacagtctagctatctgattcccaaaactgattttaagggattttagtccaaaattagctccaacagatccccttctctcctacccgagttttggagttcccttctcccgattcctcgctccgtttatatgcggacgtgaaactcgctcccaatctcgcactcccgcccctctcctcctattcccgcgcgtggagaaagcgatctttctgcgcgtgaaagaaaaaaaactgaattttctgttggtagtttaacagaagggcccacttttaagttttggggattgaatttaggctatctgttggagggagtagtttttttacttcctattttcgatttaggaaacccaaaaacaaatttttagggaaagattatacgtaagctgttggtgatgctcttaggtcttcacaggcagggtggaataagttcactttgggtccctctatttgtcccttgactgcaaaaccagatacaacccgtccctcaacttacgaaaaccggacaaacgagatccctcgtcggttttgatagcggttttggctgacgtggcacctacgtggctaatttgactcggtctttatctgacgtggcgcttgggtggcaattcgatccgaaaaaataataaagcccatgggacccacatgtcattttcacacataaaataataaaaaaaatagtggacccacgtggatcccacatgtcatgctcaccccctcatcttcttcctccctctccatctcccctctctccatctctctcctctcctctctccagcctccaggcgccacggctcacagagtcacggggaggtccgtgaaggtgcactaaaaccccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcaaaaaacaccgaaggtgattagactaggtttttcactttcgaaattgagtttaggaaaaaccgtactactaagaggggttttaaagtgtggttctagggtatacaaagtgctcttagtcatatccatgaatcaaaatatttttagaatcatttttgaaaaatgattttctccccgggacagagagagctacctggaggttctggccggaacttccgggcgccatttcaaagcaaaattttcctaagtgttgcccggaagttcctggcacttttgcccggaatctcctggcaggtttccagttcaaacttgtgagtaactagccgttatatatatggattttgtccccaggtcaccctttggccattccacttcagctctttcatgttctagggttttctagccactcccaagcttcctttgcttcctccactcaaatctagagcctatcttgtgagattgagagaatagatgagagtgtaagagtgtaagagtgttttgaagatggcttgaagattaggtttgattgagcactttggataccttgtgggctgtcacttgggcttattattcctggagatcttctcctagacggttaggtgtcgcccgtgagcttccaaagatcttgtggatgtcccgggaaagtttgtgaaggttttcctcacctccgcaaggaaacgaggtaagtgagtaaagattcttatgctgagttttcagaggttgtcctaggtagagcaacttgcacttgtggtcttttctagaaggaattgtgagttggatcttggtggtcactcaattctagaaaacgacctagaagtgttgagttgaaggctgtggacctcttctgggatctttgcataagtgaggcaaggggttaatcgagacccggctctttggagcacctcaacggagagtaggatctgtgtgatccaaacttcgggaaaaaatcgcctttgtgtctcttgtgcatgatctgtgtttgaatctgctgatatcttgtgatttttaccttgtgcaaccctgtgcctgattttccctagctaggacctgtttttcttctcatatttcgtttatctctgttgcccggaagttcctggctcaaaaactccggaagttccgggctactcatcactgccaggaagttccggtgttcatcaccaggaggttccgggccctgtcaatttaaccgttgcgtttgttgagaaaatttcaggaaagcctattcaccccccctctaggctacatctctgcacgttcaattggtatcagagcctggtgct

SEQ ID NO: 64899 - DNA, 7344 bp, Oryza sativa
gcaatcaaagagagcttgcttcaattgtggtgaatatggccacttcattgccgattgtcccaagtcaaatgaagccaaggctaagagaggcaagaagaagccggagcgtgctcatgtggcggaggcacacatggcggaagtgtggtactccgaagatgaagaagcctccgaggccaagcccaagcccaagccaaaagacaaggttgaaggagagggtggtgttgctaccgtcgccttcaagtcatcttcttcaagcaaggagcgtctcttcaacaacttgagtgatgacaacgacgactcctaccaatactcttgcttcatggctcaaggccgcaaggcatactcctccggtggttcaagttgggttgtggatagtggttgcaccaatcatatgactggagagaggagtatgtttacaagtcttgatgaggagaacaaaactcatgagaatattgtatttggagatgatggtaaaggaaaggtaattggtctaggtaaaattgccatctccaataatcaatctctctctaatgttcttcttgtcaattctttaagctacaatttattgtccgtttctcaattatgtaagttgggttacaattgcttgtttaccgatgaggatgtgacggtctttagaagggatgactcctccgtagcattcaaaggcaagttagagggtgatctctatcttgtcaatttcgatgtggatagagtgaatccggaagcttgtttgattgctaaatcctccatgggttggctatggcatcgtagactagcccatgttggaatgcggaatttggcaattcttctaaagggggaacacatcctcgggctcactaatgtcacatttgagaaagatcgtgtgtgtagtgctttccaagccgggaaacaagttgggaatctacatcctatcaagaacatcatgactacaacacgccctcttgagcttctacatatggatttattcgggcccgtggcttacataagtattggaggtaacaagtatagttttgtcatcgttgatgatttttcacgcttcacttgggtgtattttctccatgacaaggtgaggctcaagatgtcttcaagcgcttcgccaagcaagcccaaaacctctatgatctcaccatcaagagggtgcgaagtgacaatggaagagaattcaagaacactcaagtggaggaattccttgatgaagagggaatcaagcacgagttctccgccccctatgatcctcctcaaaatggcatcgttgagaggaagaaccaaactcttattgaagccgcaagagcaatgcttgatgagtacaagacttcggatatcttttgggcggaggccgtgagtaccgcatgtcatgccatcaaccgcttgtacctccacaagatcctaaagaaaacttcatatgagctcttgagtggtaagaaacctaatgtttcatattttcgtatctttgggagcaaatgctttattttgagtaagaggcctcgctcatctaagttctcacctaaggtggatgagggattcttacttggttatgaatcaaatgcacatgcctattgtgtcttcaacaaaacctccggtattgttgaagtcactagggatgtgacatttgatgaatctaatggctcccaaggagagcaagttgttgtacatgttgtaggtgatgtggatccaagtcaagctatatgtactaaggctattggagacatacgaccagtcgagacgtaggatgaccaagaagatagggaccaaccttcgtcatcgacatccaatagccctacatcaagtcaagagtctgttgactcggaagttccgggaccagatgatcggaacctccggacctctccaggccaggaagttccgggtccatctgccaggaatttccgggcagaggacagtcaaggcgtgcctacggcacaagtggatgggattgaagctgagggcactatagagcatcctgatcaggctcaggtcccctcggtgcaccatccaagaatacatcacactgttcaaagagatcatcccatcgacaacatacttggtgacataagaaagggggtaactactcgttctcgtgtcgctaacttttgttaacactattcgtttgtctcttctttggaaccaaccagggttgaagatgcacttggtgatccggattgggtgatggctatgcaagaggagttgaataacttcactcgcaaccaagtatggacattggtggagagacccgaccaaaatgtcatcggcatcaagtggatcttccgcaacaagcaagacgaacatggagtggttgtaaggaacaaagcccggttagttgcgcaaggattcacccaagtcgagggtcttgattttggtgaaaccttcgcgcccgttgctcgccttgagtcaatccaaatccttttatcctatgccgctcaccatgattttaggttattccaatagatgtcaagagtgcctttctcaatggacctatctcggagttggtctatgtggagcaaccaccggggttcgaggatccaaagttgccaaaccatgtgtacaagctccacaaggcactctacgggctcaaacaagcccctagagcttggtatgaatgtctccgagattttcttttgaaaaattgttttgaaattggataggcggatactactctcttcactaaaaaatttaagagtgatttattcatatgccaaatttatgtcgatgacataatatttggttctactaatgcctctttttgtgaagaatttagtagtatcatgactaaaaggtttgagatgtctatgatgggcgagttgaccttcttccttgggctacaagtgaagcaagcacaagagggcactttcatctctcaaaccaagtacgtgaaggacattctcaagaagtttatgatggaagatgccaaacccatcaagactcctatgcctactaatagccacctagacctcgacgataatggtaaatgtgtggaccaaaaggtataccgctccatgataggatccttgctttacttatgtgcatctcgtcccgatatcatgcttagtatatgcatgtgtgcttgctttcaagcggagcctaaagagtgccatttgattgccatcaagagaattctaagatatgtagttcatactcctaatcttggcttgtggtatcctaaaggttgtgactttgagcttttgggctattccgattcggattatgccgggtgtaaggttgatagaaaaagcacaaccgggacttgtcaattccttgggcggtcccttgtttcttggttctccaagaagcaaaattccattgccttatccaccgccgaagccgaatatgtcgccaccggttcttgttgtgcccaactcctttggatgaaacaaaccctaaaagattttggctacaacttcaccaagattccactcctatgtgacaatgagagtgctatcaaaatagccaacaatcccgttcaatactcaagaaccaagcacatagacattcgccaccacttttcttgagagatcatgaaaccaaaggagacatatgccttacccatgtgagaaccgagagccaattagccgacattttcaccaagcctttagatgagaaaagattttgcgagcttaggagtgagctcaatatcttagattctcgcaacattaggtgatgggtggttgactaatttatagccaaacatatgtcactaaaatgtaaattaaaaaaaatgagctttttgtgtcttgagatcacttcttgtgtagaagatggtcttgataccaggaataaagctcaaacattcccccttttttatccaaaaacctttttattgaaaatctttgcgaaattcctttgtgtgccttttattgcgaaaatttggtttttatcttctccttgtgatgtatattgaccattgttttgtattggttgcttgctggctggttatatacatcacaagtctctgcatgtccatagttctctattcctccttttgatttcttctctctaccatggttttgggcctgactgccctttatctgtcaggccgaaagttccgggcctccctgtccggaacctccgggtgtcggggagtatatatactcagggtgatttagaaactctagtctctctcctcatttcttctccctccccgatgacagccttagtcgccgctacagtgcccctagtggcgattttcacttccaaccgtggaaatttgattcatctccgtggaataaaccacattggtggctaggaggttcttcccgcgatcgatctgtgatttcctctctcaaggtagcacttttgatcctctcttttggttcatcatgtttttgccccgatctctaaatctgtgaacctagggagaaaaccacttggatagtcttgtttctgctaccttgtagatcaccgatctataggatttgttcacatgcgctggctatttttgaaacctctattcttcattcttgccagccggaatttccggtgttcttgcacccggaaccttcgggcgctgtccagccagcctgccattcttgcttctctcaaattttgcctaactactgcactctactttgttgattcctgttgcagtaagcactatgcctcgtgagaaaagacagaaagcctcttaggatgtgtctagtgatgagagtcctcctattcggtttcctcgtggtcgtttgggtaaagagaaagtggttgagggcggcagtggcagcggcactcgtacttctcctaggttcaccaggcaatccaacaaccgtccagttcatattcgggatgttgacagtggtcaaggaagtgatgctcctaatacaagaggttgtgggagaggtggtggtcacagttgtggggctggaagggcctctcatgatttcccgataggatctcgtgagaatcccgttcgactctacaagtctcttggatttgacaccactcctatgcaccacattggaagacccaagtccaactaccttcatcagcttgccaagtgcagaagggaccgtttgattgatccagagacatagcctgaggagtcacaggatcctcgtttcaggactttcactcaattggattggtataactcagtgattatggctagagaaaatccagtggttgagatgaagtggattgattgtgcttacatgaggaaaaagaacaatgaagtgttcaatcaagcgatgcaagtgtgccacaacaagaatcttggagatattcttgccttggagtatgattggaatgaagaggtcattgcacagttctatgcgacagcattctttggtactactaggaagggaactccttatgtgaagtggttgactgagggtgttaggcacaagatttccatggcacagtttgctgagatattgggcttagaggatgaggatctcaataggcctaatattcatagtgaagcacccctccccatgttcaagaccaagttcatgtatgctaaggatgctcctaggacttgtatgggaactactcatggtttgcatccaaattacaaggtgttgtactccatctttcgttggtctttgcttccaaaggttggagatgccacagctttgccatccaagcatgctcatcttctcagtcgcatgtgctacaatcagcctccctttagtgtgataaagatgattaagtcagtcaccggggtgttctacatcaaagatgggtgccacaatccttttcgcccttgtgctccaccttcctcttctccagtggtacctagatctattcctactacctcagctggtccttcttctagtgccccaccgagttcctcgagttcttctcccatcaagaaggcacttcaggcaattttctgtagtgtgctaagactgctaagaaagtgaagtagatcgaaaggcgttagaaggaagatagaagagaggctgggaaagaagtgtcagatgattctgaagatgaggtctatgttgatccatttgaggcttatgaggcagcccgcaacgttgccggtgaaggtccatccacctacttcaatgaagagtcttccaatttagatgatgatgatgatgatgatgatgagggtgacaccgaggcagctgctgaggatgctcccactgatgttgatgagggtgacacctctacacagtccgatgagtctcatctctccggcgataccgagattgttccctccgatggagatggagatgagtgattctcttcttctcttcatggtttcttgctttttggtgccttgatgccaaagggggagaaattgtgaattgaagggggtcatttaaatctttttgctaccttgactgttgtctggtcatttggccagaagttccgggtcctgtgatccggaggttttggccaggcagatttcctctttattatccctctcttatggacatgtaatcgtattctattatggttggatgtaatgactgctagatgctttattatcctttatgtcagtaagttagaccatatgaatgttgcattttgatgtgatgtagtgttcttttcatctttttgagtgattgccatgtcatctagtctttcttcttgcatatcactcatcattcaagcactcacatctgcatcttatttgtttgagggtagtgtgaagtttcttttgagctttccttcatttttatgcatattgtattcatctcatttcattatatgcatatctttagggggagcttcacacttctctcatcattccaaatttaaattctattatctttttgtgtgctttaaccatgttgtcatcaatcaccaaaaagggggagattgaaggtgcacttaaaccccctagtgggttttggtgattaatgacaaggtggttaaaggggactaacgtgtttatcaagtttattcacaggagtttagtcccacagcaagttgtgatggctaagaatgcaaggagacccaccaaattgaatgttcctaagtgtgaaaaacacagaaggtgattagactaggtttttcactttcgaaattgagtttaggaaaaaccgtactattaagaggggtttcaagtgtggttctagggtatacaaagtgctcttagtcatatccatgagtcaaaatatttttagaatcatttttgaaaaataattttctccccgggacagagagggctacccggaggttccggccagaacttccgggcgccatttcaaagcaaaattttcctaagtgctacccggaagttcctggcacttttgcccggaacctcctggcaggtttccagttcaaacttgtgagtaacggctagatgacgtcacctagccattatatatatggatttcatccccaggtcaccctttggccattccacttcagctctttcatgttctagggttttctagtcactcc

SEQ ID NO: 64900 - DNA, 3236 bp, Oryza sativa
aaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcattgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccactgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcaaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgt

SEQ ID NO: 64901 - DNA, 4742 bp, Oryza sativa
gatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttgcccgtaacctgccaaccaaagcgagaacaaaacataacatcaaacgaatcgaccgattgttaggtaatcgtcacctccacaaagagcgactcgctgtataccgttgcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaacgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgctatgtgtacagatgacaagaggaaaatttattgtaccacttgattgtgttgaaaatattgatgttaaatactttcaatttcatcactcccattccatctttatgtgtttcaagtcttcaacctaatcccctcttaagagtaaaacatcaaacaacaacctagttgcttacatagcacatgccatatgatatagattagttcataggagatcaaaagtatttgtgaagcattttgaaggaatcaaaactgatgatgaaaataatgggcagccatgtgaaagattgagaaaacaaatttgcagtgcaaattaccatattgctaaacatgcagaggattagcattttaccttgacaaaactatacgtgtctcagacattaactgatcaagcttcctaacatccttcagaagtgaagaatcatcaaagccactactggacacagccatcaactgtgcatacacattggcattctcaggtacaaggtagtttatccaagagttatcttcacaaagacccatgaactgcttcaatatttgtaaaattgtttctaggacttcatcaatgcccatagggtctttcagttgtttcctgcatattttcccatgaagtattactaagagaaacacaccatgttatataattctaagtaatttgaagcgaacacggaagtctggatacactctgatgaatcagtgctgtttctgtacaccctctgtcccaaaaagacttgatttctggctatgcacctggacaggtctttttgggatggaaggtgtaatgcttatttcagcaagtaaaactgaaacactcttctttttttctctttatacattaaatgctaaagtgctgatcatgttggttatacaatactccctccttccaaaagtctaagtcctatttctttttgcaccaagaccaaggtgtagttaactcattcatcatgtgacgaaaccaatgaacatgcaaccaataagtactaaaatgacttcttgagttcctatcaaaaatttaatatagcacataatgactacaaataggacttagacttttggaaaaaccaaagaatgaaataggacttagacttttggaaggagagagtaataaataaaaaattggtgatgtaatgaccatatggacagggaaagaaacacttactctttcaagatttctgttgcagcatgctgcatctttgtaattaatgcattgataccatatgtggcaaggtaatcagcagttgcaagaaagtctttgtgcccgcttttgctaaaggtgtcagaaccctcctacaaatggagacatttcaatatcagcaaatagcttgggctcaaatcactcaagcataattttgaattttaaccttcaagagaacaagcgtcaatacatgatgattaagataaagaaatatcatctaagcatctcataactttcatatagtagaaatgactgagaacaggacatggagggtaaatattacctgtaattgcgcaccatccgtaacacgagcaaaatctaagtagagatgtctgcctaatatggtgacctggactctaacatataagctaagcaacgtcatcgcccatattgaagaaacagtccttgtgaaacctaaaacaacaatataaatccataatttctcatagttcattggacaaagaaaaattcaacaaggcatgcaacacgaaaccatgtaagataagaagaagcgtactcaaaattttgatcttctcccaagtgtcatacttctcctttggtgtcagggcaggggcactggattctcccttcccgtgcattagcttctcagtcaggtgtgaaatatccaattcctccatgatccttgaacggagataatgcatagcaaaaggcagtgtggtcgtgtctgagatcttctgcacattttcaaagtgggtctgcaatctacaaaaagaagcatagaaaacgatcacaaagcagtctgttttggaaacaatggtatactcaagatttcactattctctatacatcagagacagtacattactacaacaacagccaaatcacaccttttctaacatgttgataccttatagtagattcttgttcttaaggtatgtaggatcaataacataaactccatgaacatcaatcacagcagtcctcatctaactagcataaataagagagaataagattttctctccatccctcttataaaaaaaaggcgatgtaaatcgtctaaaatagttaaaaggaccagaatgacttgggaaagtaacaatgcaagaacagaaatccccaacccaactgaacacaactaagaaactaatcccctgcaattagaacaataggcgcaccacaaaaggtttctattttttcctcaaaccccaaccgtagaatctataatcctaccctcaaacccccaactttgctgttgctaggctacccatcaaagacgaacacagcatgatagcaatgcaagaagaagaaaccccccgattaaaccccactcaagtaggtagcaagtagacggaggcgacgaggccgcgagcatcttactggttcttgatgatctcctcggcggcgcgctcctccagcgcgcgctgctccacccggacgagctgcctccggtgcgagtccaagtacctgtacgcggcgtagccggcgccggcgaccccgagcgagaccagtatcttccgccggtgccgcccccagaaccccctgcaacacaaatcccccaccagcgaatcaaatcaaatcaatcaatcaatcacccatcccacccaagcattcgccgaacacctcaagagcaaagcaaaaggaggagtccgacatatcccccccaagaaaccctcacctcgcggaagccagcatggcggcgccggggatgggtggtggtggtggtggctccgcccgtcggcgagctcgattggctcgtcctggatcagcaaagccgaggaggaggaggtgggagcgaggtggaggagagagagagaggggaacgaggggcttcgaaggaaatagagaggagttggaggggggaaaacgcaaaaggtagcggaggagacagacacagagcagagccgtctgggattgggtgtcggatgagcaacacaacacaagctctgctaaaaccctgtgtgtttagcagcggatttgtaccctgttttttctttcttttttcttttgagtggatttgtttgtaccttgtgttttattttagttctgcgtgtcgtgtttggctgggtttatcacggggagattgaggttctttttaactatttgccactcttacggagtggcactattgagatgctactcttccaaacttttttacacaaacaccacataagagaggtatttttcctaactagagtgccacgtcaacaagagggacttgaaatgacctttttacccctaatttgagaaatatgagagattatatacaaacatatataagaaaatattgtttattattcttaaaaaag

SEQ ID NO: 64902 - DNA, 1792 bp, Oryza sativa
agaagagacaaaccaaataacatgtcagcttctttattttcagattacatagggcaatatcccatgtaaggatatgatcacaactgtatatacaaaaagtgatttgttagtttagagaaccatccttgcaaaactaacaactactagatgatcacatcatcataaattctagccatcgtcatcagtattgtcatgacatcatggagcttaccaactgcacaagctacattacttctggaaattatacaattttctccccaacggtattgtatacccaacaatctggagaatttctgcaagaaccagaatagcatttaggatgaaattacattcaaataaggcggtatataagcagaaaaatgcaataccacagtgcaatattatgaaattaaaccacaaaatcatctcctcagctaatcaactagactgaatattttcacaccaaaagggattatcctggattccaatattattagggaagaacaacttcaaagcatttgcataccctaatctttgtcaaaacttacaacacaggaactgaaccaaaccagcacgcagtgaatatttattttttagaggcagtagggagtaagatttcttttttcccgaatgcgcaagtgtatcattacattacattaatagaagatgaaataaggcacccaaacacgctaaagaacagcaagaagtacaggaactcgcgccaccacaaaataacacacatgaccaaatataactcaaagtaaaaaagaacatcgataaagcaaaaaagaacactactgggttatgcccaagacttgcaaacttttcaggatacagtaaagcgtatggattttgcactcaccattcagctctgtccggtgcaccagccgatcgcaatgcatctctgattcaccttcaagcagctcagagagtcccctcctcgtgggcatgtccatgatgtcattgcagcgcttcatattgcaatggttttgcatcaccctcaccatcttcgctatattattgttctgaaatcctgcgcgatatttaaggaagagtagttcattgccgatctttatattaggcatgacagtaagttattgtatatactgcagtgtacggaataaccattagctgaatcctttttcagaaggtctagcagaaatcttgccaggcgtagattattaaggagaaacgaaagcatataagaaccttggtaggccaaagaaagcctaataaacagagcgcaaaggcgggttacagtgctacgctaatttagtaggccacaagaacttaattactgcaacggaaacttaccaactcagtgcaataatctccaaaagatctcaggaagaaattcggtctctttgtgatccatgaaagaaatttttggaattaattcatctcttgacatcgcatctatggctgaagctggtaagtgcaaaactgcatcggagacagaaaaagcatcctgatgagaaacaatatttaaacctttactagtttccaagatgatgaaatcggtatatatcatggcgcatatcaatctcgtaggtcaaacacaattcgatgagttattcatgtcccctaaaaatgcataaaacagtaggcataaaggaagcaacggtaggaccagtaaacatactgaatcctaaaagcatcagctcaatgaaccttaacaactcttgtttggcaaaaaataaatgcatgctataggtggtaatttgagtccatcaattaagccatagcagtaggcagtgtgaaatttacttaaaaacaacgccgccacaaaaattcaacaagagtagaattagga

SEQ ID NO: 64903 - DNA, 3493 bp, Oryza sativa
gacgagattgatgatatggtatgacactgaccaacttaatcttgcattagtaggaacattttatttcatacattttgtagtcctattgtcaaaaaaatgtatattgattgctcataattacagaaaagcaacagagtagtgattgtcggtgatataggcctgggggtattgtgtctagagggaggaggccgcccccaaactcatgtggcactcccctgagggtggtcgggcccggggttgagcagcggctgccccctcccagttaggggtcaggccatcccgaccccctccacgcacccccccagcatgcgtgagttaggtgggcgcgctcaacgcccaactaacagcatttaaggctggtgctgcagccgcataacgccgcattattaaatgcggcgtgcaggcgtggctgacaggctgagtgacactcgattgaccggcgtggcagggtgagtgtgcctgcgcgctgaccgcctgtgcactggcccgctgtcaggtggcgtgtggccggtgccgtctagtcacatcaccatgatgagaaatcccttgccccgtgtgcaagccggggatgatttcctactccaatttaaattagggtatccattccttagtgggaacgggtacccaaagtcttcagatggttaatggggaatgacgcacacgtcccccgtgtcacccgcggtgatttgatagggccatgctggagcgtcgaaggcatgatttcctctgtcagagaaataagatgtgtaataaatgtaaaggatgtcttccttcttccctaggtagatcttttgggcccctgtggtaaccccttgaattataaaaggaggtctagacctagtgagagggggatcgatcactctctgattgaaccaactagtacacggtgttcctcatagaaatcaagcacacacaggagtagggtgttatgcttctcagtggcccgaacctgtataaacccattttatctcatcgttcttgaggggcccgaccccctccacatcactccttgcaccaaaccttgattctcacccgctgccccccgccgaactgaaaggggggccccttagtcccccgctccaggagttcaccctccgacagtaatgatgaagagtgagaagtgaagtctggatccttgcatgttgatgtgtgttgtatagatctagttcatatttgcaacttagtaaattgcaagagtaattgttgtacttctgcatggaattattgttaccatactgttatcttgatcttggatgtgttaatttgttaggacttgggactttacacctgatgttatggcattggcatggaggctggagccatggatggacttatattttcaagcaatgcctggaagggttttggattattcaagcacttgatgttatatattatgcaagctgcacttaagcacttaagcaaaattatactattatggatgtgttttggctggtttttccttgagagatcatgttcagatgttattttactatcgcattgctgcttattgtattgctgccttcttgttgtatgtaatgaatagggctctcgctaggctagaaatcgttaaagaaacatgccttcaacaacaccatgaatacaaacataacatccgacaattttatttcatttccgaaccgagtttgcactgactctgtaccaaatccgccgtccgaaataatccgatccacatctgcatccacatccacactagtccagatcccctagagttgggtataactctaccgggtggagttggccaaatatgtgccattccatatacttcaggggctgggattaagccacattaatttatactttaaaaaccagtaactgaccatgcaacaaataaactcgcatcaacaacttatcacgagatcatttttattgtataattagaacaaaaatttcatgcttcatcaattatctaaaaaaatcatacacattaatattgatatggttcactgtttgcatatatgtgaaagcactatgttggtatacactgcgagttgctttagagttgatcgactatatctgttgtttggggaataacaaaacgttgttctgttacttttttttttgggggtgagaacttaatcaaatcgctattatagagcaaacacatgaaaaaactaagtttcctcggaagccttaaccattaatttaaggagttaatttattaggtgaaattgatgatgaatgatctcagccgtaggaaacaatggatagtacagatttggccaactccactcggtagagttatactcaactccaggggatccagacccggtatactaactagtagctatatatcaggtgatacctaccagagtcatgcatgatacttgctaggtatactagctagtagctatatatcaggtgatacctaccagagtcatgcatgatacttgctaggtatcatatgataccccataggtatcggcacaattttcaattttgatttcggcccttttggtagaaccgaattctgggaattttggtaattttggactgaaatttactgaaattttgacacaatttaactgaatttgactaaattcacaaaaattggagaaaaaccaaaaatttcagccgagatattggcatgccggggggaggggggagggttctgaaatttcgaaaatttcgaaccaaaattttaatcccctggtatcagccgatactcgtcggtactagatattgatatccactgatatcgcccaatgctcattgtcttattggtaccaagaaaaaattgattcgtaccatacatgggcgtatagcttgaggatggtgagcagatcttcagtggcccgaggggaggagtgactgtgagatgaagaggacgtcagtgatggcgaagagctcatcagtgcccgtgaggagcatatctgcctccatcgcatgcttcgtgaaccgcttgtagttggtgaggtcgtgtggtgaggagcttcgatctccatgatctctagtcaactctcgccccatacagtcacttggatgcgggcctatcgggagtggcgggactaccttcacagtccaccgtacacaatctcatcatctcctggagaagtgtgtccatcctcatcggctccagcgattcatgtctgagggattggagcgtcccatgcaggggatgggggatggtatgtgtcgcctagcattcgcgagaagataatggaacacgagagcacgctacaccatgacctacatatggaagcacttagactgtcggtataaatggccattagagcaagtttaataatatagccaactactagctccaattcatctatagctaatctaatagctcattcatacaatagttatatactacactattaatacatagacccacctgtcatacacacactgcgtcttggagtgtgctacagctggctacaaatctgtagcccactgcttttctctcttctcatttatctccttaaaatatatttgcagctggcttatagcctgctattgtacctgctct

SEQ ID NO: 64904 - DNA, 97724 bp, Oryza sativa
aaattgcctatatcgtaaataaacttttaatagtgaggtatatgatcattacagtttcatacctggatgattacattgatagactttttatgcccttcccttggaagctcaacctgaaagccttcaacacaacatgtggctttctgaacacaatatgcaagacattagtgcctcaaaccgacattacttagtggctcaaaccataaacatgaaggatccaagctggttttcaacaaaccttgataaacaaacattagatcaggcctcaatcgtttgtcgtttctttacttcacttttgtaagttgggtaactcgagtaacagaaagcacacaatttatacatgatgcagtgacgaaagaaagaagacgaactcaaaagaaaacagttcaaaaaggggcacagcgagctgaaaaaaagacgatgcaaatatttggtttttaagaaatacatatagtttgttagaacaataataatgcagaaaggcaaccaaaagatgcgcatcttgttctaaacattagacatttgtttcaccaaaaagactgaccagctgaaacatctatgaaatcgatactaaacatcacgccaaaccatggaaatggagctgcatgttttgctcttttgtataatacaaactgcaaataactcatcatgagcttagccgcttgcatttgacaaaaagttataagatctcttgtttattggagctgtggagaatacatcagccaagcattatcacttggaaagtacattccaaggaagaaatttgacaaagcaactactaaaaccattgccaaatgataatcatgattcactctcctttgcttgggccattagctcagcttgcattctctttatctcctgttccctttccatcctctctttctgcaagaacaaaaccactttcagcatattccaacaaacacagtacatgcacaaaacacatcaatttgcacacggacttccaactttcagtcgctgtggtttcggtggtgggtgtgtatatgggtggacaggtagaaacttgtctcaagagcacataggagtacagaacaccaaaacttgttcgcttgtctcaatctagcatttaaaaaattctgacagtagttaggcacctaatgttcacttgtctcaagagcaatctagcaaacgaggagccaaaagaatgtgaacatgcatacaaagtcgaattctacctgtacagaatttcctatttctaaggagtttggtaacaatcctgacgcccaagacaattttgatagaccgatgatcaatcgcagcatcacagtgctggtggagtacataaaaaacaactgatgtgctattttttgcaaatagatagcaagttgttcatgagcaattacccttaatgtgagacaaatgcaacaaatgaagaaatcaacaaaacagaatactgatcctagacttcgtacataggttataagccaaccttgggtgattcaaccttactaccttaggaggagcccagcataattaaatgaatataaccatatctaatgtgtcaaacaggttactagttgccttgggcaatttacgcttaatatgaacccctctgtaaccacagggtgtacagcattcggcactgagtattaacttgcacaacagtcaggagtttgcaggctgcagcaattaatccacacaacataatcatattgggttcacaggcgtttctgctacgctgtgattccctagtgcataaattgattttcttgtgtgcctggtgtgccttaagatgcgagatgcaaccattgtttcctcgattaccacaactctccatgtttcatttcagatgtattcatttttttttaaaaaaaatgtaagccacgacagtgcagcacagccaccaacactgcagaaagccaaagcatcaaatctgaaccctaaaactagaacaaaccaactccaaataatccgcggttcatcaggtcaggacggatccggcaacccccagcacagcctaacacccacgcggaccaatcacacacaggcaacgcctagatctaacatgccaaactgatgaatttagtggggaaagatagattagggcaggagctagtgttaccttctcgtcctggtggagggcgatccagacgtggaccctgtccatggactgccagaagaggaacgcgccgaaggtcatggcgaagtaggtcgccaccttcaccatcttccttcttctcctccgatctcccaccctttcgctccgcggcggatttgggatttggcaacggcggcgtcttcgggacaaggggaagggggagaaagagatacacacagacttcaccaataggagacggccgtacaaactctcttgggctgagcgggccgagaacaacttcgctagatttttaaatgggcctcgttaactggtgggaccaaccgatcaagctagttctgcgtgtgagaggagaagaaaatatcgaaaatatatgtaaacgatcggtatatgattaattaaatattaattattttaaacttgaaaaatattttaatatgatttttaggataatttttcataaaacacaccgtttagcattttgggaaaaatatgcatgagaaacgagggatttttctctatgtccctctctctctcaaaataatcttatactctcttcatcccataaaataaacctaagacatgatgttgtgagtttgtccgaagacccgaaaactgtgccattatcaaatcgaaatttaaaaatagagaagaaacacaaatcacacctgttagcttttccgtattaaatggatattatcttcgtccaaaaagacatcatttatctctaacttatgcacctgttgacgagtacgtactgtactaagcaacgatcagagtgcaagcacagaagcactaagtccctgaccataagacatgtttcattcacagttcttagtatttccctatgaataacatgttcatttacagctcatactaacccttcagataagacatgctcttagtacttccttatgaatatgatgtaatagttcatttacagcttccaagaagcttacagatacatacgacaacagcacaaactattagtacgacggcttgcagacaagcaatcgtgcaaccatccgaaatatcaaaaaccgagttacattgttatacatctctcagttacatcatgcatcgccgcgcagagttgctaaaaagatcgcttccttttcatctctgttccttgcacatgcaagccatcagagcaacagttatatatgttcaaggaggtatacagtcgagccctatgttgtcttcttgtttatagagctttgtctgaccaggctagcaatcgtcaacttgtgtgattcatcgtggcaccctcattattgcagcagtccacttctcttcccccaacccatggctactatgtacataaccgtgcagccagcaatggttcccaaagtggtttcccaaaatttcatgtttgatgctcgtttctcctcctcatttgtaggatcagcataaagcgatataccgatattcatcccaaaaagaccaacaacggccactccagcagtaatgacaacagttgcagtggagagcatgacccccatctgtagaagttgattttgcttgtcatccaacatgatgttgatataatcttctgtatcatcaacatactctctcagctgcaagcatagagaagaaacgtcaaatctcaactgcacataaaacaacatgaatttggtttataaaccctcaactgcacaactccctggaccagtttcccacagttgcatgcgatgctcatataggagaatcaaaataaatcattgtaaagaacctcccatgaaatcaggaaaaaaacagagcaaatgccaatggatccatgaaacgcaacgcacaaccttcctagcagcccaacataacatgcataaaacattataaaattgtagattcgttggtaatatacttgctgacaacaaataataggttgtaagaacactttggagcaatacaaggaacagggaaaggcaaagtcattacatgagatagcttattaagtgtgccatcaatttgaacaaagtaggcctccaaaagcatctccagttcttcaatgtgtggcttatagccaataaaggtaccattgcttacatctgcctcacttctataatcttcatccctacacagatataaaattatacatacacagagacaacaatggctgattatgggtggaagagacacaaatacatcctgttttattctttcaaggaaaatgtagacatgttgtgctctcatgacttacctatccacctccagttgagatgggtcatcaacctcaactctagatgaagtctcacttatttcttgtcgagtaagcttttctgtcaaatacatttcagccatgtccatttcatcatccaacaaatgctcaagttcatccctcacctataagaaataaatattttaacaagggtggaatgcattcagagaatgttgaaggaaataatattcagaagaaaggcaagcaagcttgagaggaaactatggaggacaacaaaagaccgatgcttgtgtgtgcatgcacatgcatgcgattgttgtgggctgcggttgttgtatttagcctttgggtgtaagtggtgtgggggaagtacttcacacaactatatgaaggttaaacaagtagtgttgcagccagcagaaggaaaaaaaaaaatcatgtttaataacacctgaccaattaggaagttcacacatttagcagttgcacttgatcaaaaaaatatgtttgatggcataaacatcagatacacactcagtgtttatctccaaaccatgagagcaacataaataagatttaacataggtaagaacgaaagaacctacaggtaggtgacatgaagtgtgattgaaaaggtacaatttcctaccttctgcacacgaccagagattgcaaccaggcggctcttaatttgcctaactcgctcaagatttagtgtgcttatctttgaagtcagctcatcaagtgccggatacgcctcttgctccagagtcgacgtctgaaggaggaaaaaggtcagacactataaacatcaagtaggctatgttttacaggttgtctggtttcataagatgcatgagtttctccataactaaggttcagaacacctctttcacagcgaatttgaagaaccatgcttcatcaaatttctatatgtctctcctaagggcttggcctcaagttaataaccacttaaccagcacatgtgaagataaattatctaatcttctatgtaaaaacaatgaccacttagttaccaaacaaccgaaaaatgtatcaaagctttttattaattcagttccatatatgcattctaaaacttcaccaaactttacatacaggtgattgcataagggaaagcacttacttcctcttctaggcttctacaggctgactcaaggcacacttcaagtgctcggaattcgaagggtaaaactttggtatttccatcttttgcagcagtcaatgtgggcatactgttgctgtgagtcattccgcctaccacattggaattcttgttagtcatctccaattcatttggtgtggttgaagtcagagcaggaaatggtgaagtaactgcagatgattcgccttccatatcagtaaattctgcagcctgataaagaagaaaagacatttagtgatataacccctaacacggtcagcacatagaagtaaaccatcatctattgttctgcctatgcattatcctggaccatttctccatatctatctgcacctgctaataaactttgtcttggttacgattacctcacaatggctactatcagtgtttgaggaagagggggggggggggggggagagataaacaatggctactacgcaaagttcattgagggaacacaacagaaattaacaagcatctacatgtgatctcgcaaatgtactcaagaagagtcaagatgagtagggccagcctgattgcaattctgataaactacaattaaaaaatatataattccacaaggtatgctgccgatatacagtaattcttatccactcgaaccactgctaccataccatacaactcctaaaacatacagtctataggcaaaactgcaaaagggcaaaatgattagaacccgtacaaggcagttcaatccaccataatctcggacctcataccacgattcttcatataaattagcaacagggagggagggaggaggagatgttggacctggtcggaggacgaggcgaggacgcgggcctgcaggtcgcagacaaagctcgcgaaggcggggtccttggagttcgggagcagcacctcggcggcggtgatcacggccttgacgcgctccaggttgacgacgatggcgcgctcgcgacccaggatcgtggaagggtacgacagcagcgggtccagcacccgcaggtcgcgcgccggcagccccgtccgcgccatcaccgcgtgcttcccggcctcctccacccgcgcctgccccgacgccggcacgaccagccactcccggctcgccgcggccgccgccgccgccgctttccgcctcccgccgccgccgccgccgccgcccgccgccgccgagggcctcatcctctctataccctagggttagggtttcgatcgacggaaaccgtggaaaggggggatgagttcgcgggagccggatgtcgggagatgcggcattcggcggtggttggctcaggagagacggattcgtggggagtaatacgcgatttagacaagggtgtttttggaaaattacaggatcgctggaaattgtggagatcagagtaagagtaagggtgtttttgcaaagtttttttgacatgagagttgaaagccatcattagccgttggattaatgcgggccagctgcatatgaggcgggaagagaagtgacgctaccatggggttggcattccttcggggtgatacggcaaactttgcatctgcttcatgtagagcatccatacgtgaccaaccgctggattcttagtttaagtctgtagaaattaaaaggagaacatggagataacaatagcatgtttgttattggtgctgattttctgaattcatttgttaccgaaataggtgcagtacgatgttagttacttgtaagatatggggggggatggaatctagctgttggtcacgtatggatgctccaaataaagcaacggcaaagtttgccgtatcaccctgaaggcagacgatgccaacccgccacaatgcatcccaaacagctaggccttcacttcagcgacgtgggcgaaaaccaatcgacgcaccgggccatcacgctggcaggaatttttttttgcaaatgcgtagaagattgcaaattaatattaatatattagatgatgccccacgctttgctgcggtatatatatcagataatggagaaatgatgaaatgatttggattgaaatattataaaaataatttgagaataatgatttagcatgtgaatgttttgttttagaatgaaataaattgtagatataattaatatgtgcttgcacgttgagtttgtgtgcataatgggtttatatggcatgcttgcatgtagattttataggagtgctaataaatactatgtttgcatattgagctttaggtgtttagtggacaataactttatagaaagaagatattagaaagagagttcaattatacaccacaatcaaccatagagggtcattgtccgggaataaggataaagaaaaaaaaactgagttaaaactggacgctacttctatacaagagagaggggaggcggagccccactgcactcccaacaagtccccaaaagacgcggcgccagcagctgagcataggtgtttttttagaatggactcgagaaccaccgaaactggcgagagagagagagagtaatctaacatagagttccgatccttctacagctactaggagacgaggaggactaaggaatcaaaacccttgtgacaatactcaggcaaacagaccatagaggtcggcctccagacctgaagagaggagccacaggccctaaggtcttgtttaaagagtttaagattataaaaaagctgattagtagctacggaatctggttcgtagtttattttaaatttttgtaactacactttttaaaatttcgataaaagaattttgagtgcttgagagtgattttgattttgggagaagctgtaaatgacagaagcccttcacctttgaaagcctaagaaattttctgctaagttgttggagaaggtatgccaactgtgtacgtgaaatagagttccctttgtttttttttaaaaaaaagatagtgttccttcaccagaaatatcacaaaatatattagaagacttccaggattcaagacatgtttctgttttcagcttgataaaatagcacgaggtattgatgacatgctggatgtattgcatccaagtgcaggtagcatatggggcattcgaatgaaatatatactgatctatgttggccgtcaagattttatttacgttatatatttttatagcgtccaaaccaatgagtacagttaatttctagcacacagtgatgttttcaagtgtggtattccagtttgttgaattgttgcatatttggagatctatgaccactgatgagaagcttgaactcagtgtcagtgagcgcttccgcaagtttccagataaggttttcgaacgcgtggtggagataattgggacaagaaaactagcaaatgagtgttcagcacaagaaaccttatgtggcttcatcaatcttcaactgtaagaggtgctactatttgatagaaggtcaagaatacatgaatcaggttcaacgcatcattggctcattgcattgttgaaatttcacgaaaccggcgatcattgacgaacgtttgtgtcaaattgcatgcatcaatcaaatcgcctcatccattctggcagctcaaaggaagctttaaagttatcgtcgtccgttcttcttgactttgcttttccaaaaggaaacatgatatgatttgcaccaagataatggatggattggaatgagagggtgagatatcggaagatacggtgtggctttaaagcatattctactgcacaaacagggatcttccccggctatggtatcaatgtttcgttcataaaaaaaagttattatgttatcgattttcctttgccgtcccttgcgcattaggaagatttgacatggataacgaaatagttccgttgtgttacagggatacagccagaacatgctatatttgcctatctaactcaatttccctgcaaaatttatcacaaaaccatatatttagtgctaaattgatcacaaaaccacacattcagtgctaaatttatcacaaagatttcggagcttgaatttcagcgtataaaccattttaaaacttacatgctgagttcatttttttgtggtggtggtagggtggggggagggttggttcattgtactttaattttagcaattgtttttttaactgtatgtaatataaatataaaagttgtacatataaattattatttattgcttatatggtgttttgcggcttatttagctgtaagcaaaacaatcaggttgatagattttagttataatatcacaaaatcacatatataccatcagttttatcataaacctacatattttaaatcttagatttattaaaaaaaatacagattttaagcctccattagaataacaatgttaggatggagcagttataatatgtaattttatgataaaggatatgctgtatatgtaactttgtgatatttatagtaaatttaactatatatagttttgtgatttttttttcaaaatatctacagctacttgaaatttactctttaaggaaaatctctctaattgaaaagctaatcccaagacgcaacatggttgggccacggaagcaacaccaagtatacccgtccgattcagaaaaggacaaaatagagagagacgatcgtagccattagatgagagaaaaaaatctgcataaattcttcacgaggctttgaggcgaaacgggcaaatggcatgatcatgaacaggaaggaaaacaaaatgagcggcaaaggaaaaaaaaatcctccatggtcactctcagaacctgatccaggcgctactcttcaagagcaagatgacttcaatgataggccggtgaagtgcggcggaggcggcttgatcttcctcatcatgccactgagtctgcctccaccacctcctccaccattgcatccactacggttcccgcctcccgatagctagatagataggcggagcgtgagagataggcggaaatggaaggaaaagcagaggaagaagatcctcacaggctttgctctgcctcacgcggatatatcctgatatcgatgccagcaaatctcgagctacagccaatgtgcttttaggagaaagaaaaaaaaaagatacaacaatgaaagaaagaaaatccagagagaaaatgatgtgaacacactcgcgaagggtggcccgatcttcacgacagtaggttgaaaaccaaggataacttgttgtagaaacagtgggtaactagctttataactgctaaggttggatgcgaccaagcgacggggagagagacaccgaaaccgtgagaacttcgactcgatctccgaacaaccgcaaaaccacaattcggaactaatccacacaatacggtgcagccaaactagaagccgtggtgcacgaactaggggacctcagagagatcttcctcacaagtccaaaaagaactcgcaagaacaaaggggtgtaagacactcaagcagcttggctgaaaaaaacattcaggttatcaaatcatcaaaagttgtttctgaaagcacataaggaatatttatactaggaacaaccctcctagataggtatgaaaagtcttgaaagaaggacatagactagcccaaaggcctcaacaagtgaatttccgagaagactcgcgcgtctgtttggcttatgagtagccttcagtaaaaaaaggtcgttactccttattggaaagtccaaatgacatggggtcagttgcgttggaaagctaacttaataagctttcacaccatgtgcataatgcactacgaaatattatagattgatacagttttgcatggaaagttaaatgtcatggcagactattggccttcggagcagtgtccactaatctggccataactctttagtgggaaatccaatggacgagcggtttgttgggtgtgaaactagactcaataagctttccaaaaaaaaatgctcattcaccttcatagcttttgagaatcaaaagttatgacgatttcttaaactggtctgttttgaagttgaactggtccgtttttcactgtagcggtttgatcttcatggtccgattcagcttcctcttgttgcataatcctaagcgcaaccaaagtagaacatttaggtagtataacattctcatctatagatgcatcaaatgtagcaaggagtgagttcacctgttgttgtagtttctgcgcacgactttgcgtaatcagtccttccattacttgatcatgtgtagcagtagttgaacttggtatagtcatgattgggatgtcctcatcagaaaactggcgactagcaagagacagcgacgcaggtgccgccggagtcagatgatgcacctagctagctagctgctgctggagaatggagatgatcgaaggaaatgaattgagaggatgaataaaagagaggatgagagatggaacagctcaccgctctagctagctgcgcctgcgaccgcctcgtggcttcttactcatgcctctttctcaatatcacgcctataaaataaaattatttatgaaagcacccctaggtaagtattcataatttttgttccaaaaaaccttgacattttgaaatttcaagacatcatattcatagctcaactgacagtatgcataacatgcggaaggacacacctcctctacagtacttccaatgtaatagcagtggctgatacgggagtctgattccatatattagtgtctgcggacaatctcattgatacagtaggagtatacagctatatacaggttttagttctattcatttcatataattatgagctaaatatacgtgctttactgaacatagaataaaatttactataatattacataaaattcaaattcatcttaatttaattttatatgtcactgttttatttggatttgattgaattttaatatttaaaatgggtaatttataaattttactatgagagtaagtggagtaagtggaattttactataaaaatgggtaacgagcgtcactattttctctaaagaacatattcaccactcctaacaggatagttaaaatcacctaaaatgaaatgatgataatccacataacctaaaaaattctagcgattggatcaacataaagaaaaaaaaaggcatgaaaaagcatgctcacgtgtgtagcaaatgcgtgaaaattatttctatatatattttatatttttttacatgttctcaaataatataatattattaatagattttcttacactatttatagtaggatggccatagtcgcgtgaatgcgcgagtacaaagactagtatattgtgaactacttcaggtctaccttgtttggtttgaagcaatcagcgactcaaccaaatctttataattttaatgaaatttgattattaatataaacactattaatattgagtagtaaagactatgatgcttcctcattaaatgagagattgttaggagtgcatagatgatttaagatcaatagtaaaaagataaataaagatggttgatgggatagacaaaactctaggaatacttacatttcgatacaaattttaaagactatgatgctactaaaagaatccacaatgtgtgttttgtaggtactaattaagaaaatctttttcctaccagccggccgtatatattgggcggcatgggttatacgaaaaagctaaaataatcgttcttctcttgtgatccaatgctttaaattagtaataatattatttttaattgtttacaactgaagaggaaaaacgagagatcgtaagaggcctgagttcaattttttgtttagtacaactgaagagagaaaaaaccgtttacttttttcacattgtacgactttttaaaattatatattatcaatcatggaccacatagtgccacgagaaaataactatacattgcacgaatcttgctttgctaacccgcttttctttgatgcgtgttgctattacctcgcggtgaaactatacagtacgttttttctcctatctaatactccaacgggtttcaaaaaagaaactatatacggacgcccttaataatggcaaagttgacacactgttgcgacagcaaacctacttgcctgctactaccctgctactacgtatactgtactgtatacgtatatcaccagactgtagtctgtttattaatccgcacaaaaggaaaaggaaaactcagtcggccacacaccacgtagcgtcacatcatcctcatgtaacagcctagctacctcacacgacagtattggttttccggccgttttcgatcgcctgacgcccaggaaaaagccgctattcctgtgaggccctgacgccgaccgaaactccggtacagcatatgagaacaaccacctaaccacccttcatccatccggttaaggcaatcatgcaagaagcaaacaaaaaatccgtttatgcctctgtttaaattggtgaatgtactgtgatagccagctattaaactaactcatgccgtaattaatatgggacaaattaagtatttcatagaaattcttatatattttagtttggaataaatttaagtgatagaagtccttatatttgttcacaacagcagacgacgtcacaacggcagctaatgcttctttcttttagagagagagagcggcacagcggctacagctagtgcgagccacgggtgcatatgcgaccgagctacaatgccgtcgaattcagctcatgtttccttccacctttttaatttctttaatttgcatgtctctccatcactaccaaattcggctgatcattcatgctttccattgatccccttctatatatatatgtatgaagtgtgcgtgtgtgagagagtgtgtatgtatcagtttgattgcatatgaaatggctgcttcatcgctcgacgccgaggcagcagctgcaggccaacaagacaaggccggcagcggcagctacaccactgcagccactgctcatcaaatagacacaggtgcaagcatatccatggtgatcgatgaacaaaccagcaattcttgatcttatccgttcgatttatagcaacaagaagcatcaggatccacgcattcttgacacatatattgaattgttaattattgatcggttttagtttaatcgttggacatgtacacatgtgcatgcagattcatggcagcaggtaggggtgctgctggtggtggggttcaactgcgcctacgtgctgagcttctccaacctgatgatggcgccgctgggttgggggtggggcatcgcctgcctgctgttcatcggcgccgcctcctggtacgccaattggctcctcgccggcctccatgtcatcgacggccagaggttcatccgctacagggacctcatgggcttcgtcttcggtgcgtttcatgtcagagaaattgggttgattaattagtgagatgaatagatgattaagttagctggaggctgaaaatgcagctgacgaaccttgttaatttacacggttttgtttgttttgtgaagggaggaaaatgtactacatcacttggttcctgcagttcatcaccctgatactcggaaacatgggcttcattctgctaggcggaagagcactcaaggtacaaaatttgctgttaattgtatcgaatatccgattagctgtctatctatgaccaattgtaagctcgcagtttagttagccgatttagttattcatttttttttcactgcaacctgcaggcgatacatgcggagttcagcagcagccactcaccggcgaggctccagtggttcatcgctgcaaccggattcgtctacttcgccttcgcctacttcgtgccgaccatttccgccatgaggaactggctggccacgtccgccgcactgaccgtcgcctacgacgtcgccctcattgtcatcctaatcaaagacggtaatcactaatcactacagtatagtactacatgtctcaagtattctctgttgcggtgctctataatagtagaaaacaatctaaacagttaatcttatttgatcaaatggttcatatttacattatcaccttattagttagtaatagaaacatgaagagatattattatctaagaaaaatatgtgcggagagatataattgtcattagcagtgactaaactacagtaacataaattaattatagttattactattattaatcatggtattagtaaattactaatttacccctaataatactctcagcagagaacatcggagtattaatctttgatttgatcatacatgttcatgcagcatctgatcgatcgaacaggatttatatgttttttttggtttcgcatttagggaaatcgaacaagcagaaggactacaatgtccacgggacgcaggcagagaaggtgttcggcgcgttcggcgccatcgcggccatcctcgtgtgcaacacctccgggctgctgccggagatacagtcgacgctgcggaagccggtggtgtccaacatgcggcgggcgctgctgctgcagtacacggccggggcggcggtgtactacgggatcagcgtggccggctactgggcgtacggcgccgccgtgtcggagtacctccccgaccagctcagcgggcccagctgggccaccgtcctcatcaacgccaccgccttcctccagagcatcgtctcgcagcacgtacatatatcatataccacattcttctcctcctccccgttgatggcgtgagagctcagcctagaacaaattaattaagctttaagcggattgatacattttagaaacgtggagcaaataatccatattaacaattcgacaaataatatgaaaagaagccataatgatgtagaacgaaaaaggtgtaagattggttgagtattattcactaaaaaaatttaaaaaatatttatttaatttttaaagcattttttaaaaaaatattttcacaaaaaatattgtttaacggtttgaaaaatatgctaataacaaaattgtagagtaactaagttgaattttagctctttagggtagggcgtttaatttgccgtggattaatgcgtgcgtgcgtgcgggtggcgcagctgttcacggtgccgatacacgaggcgctggacacgcagatgcagaggctggacgaagggatgttctcgcggtacaacctcgggaggcggctgctggcgagggggctcgtgttcggagccaacgccttcgtcaccgcgctcttccccttcatgggcgacttcgtcaacctcttcggctccttcgtcctcttccctctcaccttcatgttccccagcatggtcgtcctcaaggtatgacgacacatttctgttgagaaattgatagcactataattctatcaagatcatgatggatggatggatggatggaatggtgatgtgcagatcaaagggaaggatgaagcagggagatggaacaggatttggcactggggcatcatcgtcgcctcctccgtcctcagcgtcgtcaccaccgccgccgccgtccgtctcatcgtccacaacgccagcgtctaccatttcttcgcggacatgtaatcaatcgacgccggagattaccatttgcaccgtcgattaccatttgcaagtgcagtgtgctgtgatcagccgggtttagagctttgcattcttccattaaggatgagattgcaagcgcagcgctgtgattagcgggtttacagctttgcattcttccgtaaggattatatcatctttgacgaacacattggacctaaccaatgttaagctatgccaacctattacacttgacgccgaacacgatattatttttaccgaggacggcatgataccagtgtaacatagttgaggcaatttgcaggtatgccggcatcagaacaaaagcaggggacaaattcactagaaaaaatggcaccaaaaaaagtcactttcaatcatatacgaaaactgcaaatctttacaaaaacgcatgaataaacaaacaaatcttgcatgaagacggcactggaaaacgaatcctctaaaacttatgtcggccacggtgacgaaaccaacatcgcgatatgtacaaatgttcgactaatcagacagactcctgttcgatccatcaggatttctccttttctttcttttcttcaattcgttagaatattttatcaacccacttcttgcactggagttcggatcattcctagtgggtttcaatacttgagacatcccctgctccacaatcttggagcagtggattgctggccttgcgatccttgtcgatgcaaacccagtacttaacgggcttgtctgcaagccgttcaaaggctttgcatggattgcacttgaagcatccaatacaatccatcgcccaatgtgacacaaggtggtctccagtatgccacccattcgcaaatgatccaaactgccattgctagtatagctttattcttgtggagattggactgcgacatattgggcacgattcgaggctctgcccacaatcacagcaggtctgcaaaattatatactttgttagaaaaggatgctgacgctgacgtttcaacaagcccacaaaagcagaaaatgacacccccaagaagcaagaaaacactgaatctagcaagagggtgaatgtctcacctggtgtccgcagccaaacgccatgtctttggggttcacaaggcagattgggcaaacctacaggagaaaaagaattatttaagacacaaaattatgcaaatgcctgccttaagaaacaagcaacagatagcatgttgtcaccgcacgcgaaggtatacctgattgtcataagtagaagaaggtacagcagggctcgaactctgtgcagtttcatagtgaggatatgacgatgatgatgtactactctgtgggtaggtacttggtttactaaagctttttgatccatacgagtaagcatcatggcttccaccagggggagggagaggaaccctttcaggcgacttgaaagagcgacgactgatgccacatcaatattaattttagtcagaatactacagaatgaatcaataattcaacagatcaaagcattagagtaataacgtgttaggggcgtaccctaaaattcctaattcaacagttgctttgtattgctgaggtatctccatcaaggctgaaagtgcaaatgctgcctctttccttgattggggcatgtttttgttcatgatctccgaaaaattcacaaactacacagataatagatcctcagtaaggagtaacaaaaatttcatctaccatatacaaacatgcctacatgggttcattagggttctcagtgacttacttgaaaattgtcaaaagcacgagaaggaatgttgtcgtcaaactctttcatcatgtcccaagggccatcaccaactcctactagcacaatagacaacggcaattcactgcagacgaaaaccagaaagcaaaacatcagcaacatccatgacagaggcaacgcaaactatgtgaacatataaagtaatcgccacaaaaacaggagtcaaaatgcatgggagttacaggcggtatgagcatatcaaaacaatgtaaaaaaggaacttatgaagtacgaacctagctctcacaatagcatcaacagtcttttgctcttgtgaactcagctgcccagatgcagtgtctacactccttgtaacctgtgataatatgacagctaataaggtataaagaaaatgaatgtctagtcgttaggttggtccaacatgtagaacaagcttcaaactaagaataacctcaaataaaaaattgctcgactaaggatcatgtaggacagagtatcaaatgacattacaacatgcttcagatggaacacaagtggacatagaacatgccatttctaatcctcaaattcaacagtccaccgatcccagcacgtgaaactccatatatgaaaaacatgttttgtcattcaaagctttaaaatagtgaactgaaaacaacgattcatatggggaaaacaaaatttcagcatgaatgttttatttaacaaaaaaaatatttccctttgtgtgttttacacagtacctgcccatcagcaattatcaacagaacatggtactgcccgccactttgttccacgatggtcattgccatctcaatgattggtgcaaaggatgttggtcctgttcaaaaaacaacattccaagtatgaattaacagtatagaaccagcataagaggcatcactgggcaacatcagcttaccagctaagcgcaagtgtggaacaagttccctgtaccggcttagagcttctgagaatccattgcaaggtctcaaatcaggataaaaacagaagacgtcttggtcatgtgttgttgctgaaaaaacacacccagttgaattatgattggacaaattataatatagtgcgagaaatggtcagctaatgaatagaatcgctaccatctccaaatccaaaacagggaatcaagttatcttcatcaaatttcgacagtgtctgtccaatgatcgagattgcttgttcatacggattaggtgcattgctaatgtgatgtaaactgcgtccatggaaggaaaattttcctgtaaatgaaaacaaaccataagcatcaaggggcaatgcaacacaaaagactgataagaaaataaaccaaacaacgatttgttagtactaacctaaccattcattgctctttgtgaaatcaatgccaacaataagattcgaagactcaagtcctgcttgagctagtgcatcagtaacctgcaattaatattaatcctgagcaaaccaattcatgggaataatagcaacacaatagaaactggattgtttgcttatgtgcctgattcttatactaatggttatgaggccagaatacagaaatgttagaaaagtttaaatacaacatatgaaacaacttttaccgataaacaactaattgtgaacaatagcgtaatgtgctacgcaaaaaataaaaaaaaaacattcagaaaacttagacatggagttagtaatgtaagcagaaaattggaagtgtgaaacattaaactggtggaccagtttatcccaccaataaaaataaacatcctccaattgccgcattttggacattgaggcaaggagcattcaggaagtacagaggccagactcaattgattaatgctaatttgcgtactcataagatctttgagaattgagaagaccaagcaaaagagaccaactacaaccaataatgatggttggccgaaagctggagccgccaataatgcccaacctcacaacaaacatttttttttaattcttcatcaacagtgattggcagttgaccagcaggcttaacgagtcgtctccttctgatttttgcacaaacatcaattcgatccaccactacagatcatcctaatctgaagtttcaagtggctacagctacagattgaccaactatgaagtgcaaatcggtaacgagcgattcgctaacaatcctaagatggaaaaacaaaaaaccgcgattaagggagaaaggcctacacgagcgggttcgaatcaaccaaatccgatgctccgaaaagcaggatcgaatatccaaattccacacgaatctacagaaccgcaggatatgatgctcgggcagatacctgatccacggagtggtagtcgtcggcgatccgcgagtagcggcggtcgaggcgcggcttggacgcgccccccgcccgggccggcggctgcgtcgccgctggggacggcatcggcggcggcggctgctgataagccgggtacggcgccgcgtatcccccttgcggcgccggcgcgccgtagtagcctcctccatgcgcatcctgcccatagggatacccaccgccgccgccgccgccgccgccaccgccaccgccccactgctgctggaacgacggcgagtggccgtacctcccgtggccgctcccgtcccgcgggctcctcgactggccccctcccatctcaactagatcgaccaaggaaaaaaatccaacaaaaccaaccaaccaaccgatcgatcgatcaaccaagcccgcgacgcggggggcgtatatctcctcgtgcgcgacgcggaggcggcgggggaacgacgacgacgaccaaggtgagtacgcaacgcaaccgctcgcggcgccgcctttgcggtttatttttcgggagaggcgcggcgaggcttcggggctccttccttcgcgttgcgtcgccgcttgggacttgggaggcgtgagctggtggtggtttggctgcttctgcagtgccacggcctcacgggtgcaactgtgcaaggaaggaaagacagtagtttggatttactccggtatatatacaacgcgtgttcgatccaatcaccacacggtccacaccgcatttggattggagttggagtttttcctcgtcaaactcctcacgtgcgggaaaacttcacccaggtttaacttcaccgcgtttaacgtacaatagcattgggaatctgtttcagggcctgtttgaaattttttgagtggattgctagaacatattatttatattttattaacatggtaaattagtattttataaaaaataaaattcacaaacaacttataaaaagtggcctatacattgccgcgaagaaattttatgaagaaatttttttaaaaaaccgtaaagcaaataatctaggacaaaaatcaagaaaaaattgaaaagaacaggggggcatgttaggaattttttttggtggcagttgaaaacttgaagtgttggatttattggactgggaatccaatgatggggaattggacataccatgggcactcattaaaaggcaaatgacttttgtgggagccatgtgatgctgacattgtacacattttatcaccaggtgggcgggccgcagaggtaaccgtgatcttaatagattagctaggaaaagtgttaatagaggttgctcgggcttgaatggaatgtttgtagtcttctaatcactactacgcgtaaaaaaccgtaaaattcatactccctccatcctaaaatataatgatttttatgtagtgtttagtcaaccatttttaactttaactattaataaaaaaaatattactagatttattattaaaaaaactatcataatatgcaactctttttatttttttaaaaaaaatcttatttttacagatattgttggtcaaagtagcatatcgaagactataccgaagtccaaaaatacttatattttagaacggagtgagtaacgttttactacaattgttttggctaaactattagaatatgttgtgactctagatatagtattttagattagataaattttgctatggtgcatttaaaatctgtatattttactggtatacatcataaaaacgtgtcaatattgaaagacaccttaaaaaaataataatttgttggacacactttcggtataattaaagagagaaaatctttgaatagatcataatacctctagtgccacaaactttctaacacagtgttgaagtgaaaatttgctttcagattattgcaatgtagcacatggttttattggaaaactgtaacttccctcatagtctattaaaaatattaatggatgttggatgaaactgagtttatgactattattcaagggtacaaataatcaaatacaaatattagaaagttaataaaatgattctaaaaggttttctaagaaataatgatgaagttttttaataaaaaaatcacatcatttaagatgttttagaaagtgtggtcgtggtaattcagtggatgtaatcgaaaaagaatgacttcatataaatatatgtcatattgtttgtgggatcgcggttattgataaagttgtcaactttgttacgttttcctcaaatatctcaataaaaagtagtgagcaataatttattcagaaacaattgcagtcttgttatattttagatagactccgtatgtaggctttttatggttataattagtcaatgtcatggtttgtacaaattcctcatccgccatttttttttatatttaagatgttcttggcatgatgttataatatatttgatttggcatcatttctttagaaccccaagacatggtctgtaaatttaccttatgatgttatgtatttgatacacatgaggtaccttgttgaagccttggggagataattcattcaaaaccccgcacaaaaaagctaaatctatcactcaattttgtgcatataccacttcacaacctaattgatagttatagaagtttttttaataaaaattccgtgccaataccacttcacaacctaattgatagatgtagcatttttttaaataatgaaatgaatatttcagttgttgtaaccgtccatcctatagaaccgtgtagctcaaaccatccgatagacggacccacttatacatagtaccctgcttacactttcgttctctgtgtataagaattaacccataagtggtatggttggagcgactcgttggttccactttttctcaactagcaagcaatgtagtactaatcaagtgcacatgtcactcatgtgctacataggccgcatcctaattgaattagaatgtcacaactgcactaggatatgcacaaagatattcttagctaatatgtcatttaagatttataaatatatacacacatgtaatatgtgtatgtagtgaattgcttagattgccttgctgacgagccaatacaattggatcacattacacatcaattgtaatacacgtttcagtaagtgtcaataaacgcatttgagtggtcatatatgttgaggaattacatatttaagaacctgtccattattataaaaaaacatatttaagaacctaatctcaagaacttcttcaagttattgcaaatggccacatgctaccactaactattggtccaagcaaataattaaccgcctaatataatgattacttcaacgttccatggcaagttggccgattgtactaaattaaaatatgtaccaagtgcagtggactaaattacgatagataaggtatgcttaaatgtttagtttgatgtcatttgaatcgttgaatgggccttaaataaagagtttcttaaggctacgatacactaacttagttttatttttacaggtgcatcggctatatatgcatgttatccaaaaaattctccagccattatatcacacttaaggccttttctttttaccttattcaatcaccggatactcgttccgtgctttaaaaaaattttcttctactgcattacttaaaccacttattttaaaaagttatgtattatgtttatgttttaaaaatatagtttatccgtataataaagtcgatagccagcactgtacgtaataatttgctcaatactctaaattaaacaaaaactacttgagattaaccatccattgggctacatcccatttgatactttgcaagtgaagaatatataattgactttacctacaacacactagtccactctaaaggaaaataaataagtagattcgcgggactgcccgcttgcaccacctccaccaccaccggccagatttcgttgaagactatatgtgttatgcagtcttcaacgacaacggatttatcaagtcgtgttagtaataaaccggtaaagtggttggcattttccttgatatacacctcattaattataaaacacaaagtggtagttctacaataatgaatgatatcgacaagctatccactggctatatatatcaatatatgtgaattcgcaatgtatttgtacgctagctagtggcgatatgatatatattaacatgatgatatatacttaactcagaagaaaccaaaagggtttgcctgctaatcaaggttagcagccagctgggaaaccaatcggtcatttcgaacgaaattgatcatcatatattcatatatatactgatcgatatacacctgaatcgtcatcttcaccgggttggcgcagccggaagtattttattgctgcttttttggtgttgacgttaattggatttgaaccccaggattacgtgctggaccggattaagtaacaccaaacacatctcgtcagtccttaatttatacggcccattttgctaatcacattagctgccttgctctatcggttaattaatgctgactaattgccaggttgcaggactaggggtcaaatggttagtaggagaaggaagcgcggggtgaagacgaagacgaggaagaaattaggccgaaccatcctaatttgcaaattgtccactatggtaattattttgttggagtactaaaagttcggcaaacggcaatactagggttgtgtttagatccaaagtttggatccaaacttcagtcctttccatcacatcaacttgtcatacacacacaacttttcagtcacatcatctctaatttcaaccaaaattcaaactttgcactgatctaaacacagcctagcttacgagttgcaaaacgcgaaacccattccacaaaggaaaatgggtacgtaaaagcgccatccttttctcgatggcttagctaccagaaatacagtttctagattggctgatttgcctagtactcgtctcaaggctttaacaaaaatagcatttgaacaaagatggacgaaacgtacgtgtcaatatgtcatacggagtgatggcatacttcctccggttttattttaattaacgctttagacaatgacacgctttacaagatatacctttaaccttatttttttattataatatatacaataaataaatgcatgtatatttttattatagtgttttaaaagacaaatttatagttttttaaactaaatatttttaaagttattgataattaaagttataaaagtttaaccttaacattgtccaaaatattaattaatatagaaaccgagggagtatatacgtatatatatcgagaaaaagaccttttcaaacttgccagggacgacgcgccgtctactactctaccactcgtgtctctcgggtttggattagtttgctgtgtttgcgtgcgtgcgtgcgacgcgcgaggccaagaccgccaaacaggaagccaacttccccgcgaagcgacgcgtgcgtggctggctgccgcctggtgctttcaactccctccgtaaaaaaaaaaaaataaaccgtaggttttcgtaccaatgtttgactgtccatcttatatgaaattttttaataattagtatttttattgttgttagatgataaaatatgattaatactttatgcgtaacttatctttttaatttttttcataatttttttaaataagacggacggtcaaacgttggatatggaaaccaaggtttgtcttttttttttttacggagtgagtagccatctaggcggagtatatgactctatgaccagcaaccagacgtccagatgtgttcgcgtagcaaaggtcagatttcggttggttgtatgtacttgtatgacgaccctgtcctgatattgatggcgaagtgaattgccgtgaagcctctcaaatgaggaggagagtttacctagtcggctggtccatgtataaactgtatgcatatatgtcactatcattagaatgttctgagtctgtgtctacgttaaacttatgacttatcacaatcgacaggcgtagctgtcaaatttccaattttcttttccggtgaggaactgaggattatacgaggtcatgactcatgagttttttttttcacattttatcggaatgacactaacattacaggcactaatgtatagggcaatagtaggttggaactcgcataccagtaactataatagtaatgacattatggtagacgatcctcacccggattttgtttgggcgagaaattggattaaaccagagattttgttatacatttgtcgataaattttcttctaaaattttgacagatgtaaatataatacaatcgtaatgtaattaattacattgtaactggtaagtaactataatataactcgtatgcaacttcgtaaagttttaaacattagatttgctttagaatttgtgcaagcgaggaagaaaagaatcacagttggcgcctatgtgagaagattaggtcccatgacctccgtttcacactaatagcatgttacctagagaattttgaaagttatatacaaattagattatagttacatgcaagttacaatgtaattacattatgattatactatatttacatatatcaaatttcttcgtttaaatttgacgacaaatagagtaaaatgtattcaaggtgagtcaacttggcaggtgagtgcaaattggtgcaacaacttgagaaataaacgtcatagtgcaacaacttggcagatgggtgcaatttagcgtaagaactttataattgaatgtataagtcataacaactttcaaggtgggtccagttttgatacaataagtagaagtgacgcgacaaataattattttgagatttttctatacaaattcaattttacgtacttatactaatgcaaatttgtgtaagcatatttaaatttttattctaataactgaaagtcaactaaattttactaagtataaaaatattatatttcggttgagatttgagaaggtgaagaaaacaaaatccaaaccgttggtgcaaattggttgtggaacttaattcttatggtcgagttcaagattataaggtaatatttgtaagattgctatatgagagcatattgattcagtgaaaaaaattatctaacactcatttaccagaacaacatatactttgctaagttgttgtaccaaaaaattaataaattgtatttgtattagaatacacccacttaccaagtaattacacttggacgttcaattatcaattttttatactatatcgtatctatctaccaagttgctagatcatgtgtaataatttactacgatgaaccttgttggcttgtactccctctgtcttaaaaaaatgaatctagtactggatatgacatattctagtacaacgaatttaagattataggtatgtctagatttgtagtgttaggatgcaggttagttttttatgggacggaggaagtatggtttaatatatttgggccgatttcaacccatcagatttgggctaatctttcaaaagagaacttatgggctctctcccttcagtttatgggccttccacagtaaaaagccttgtgctcttttccacttcgtcttcctcctgcgaacagtccaacccctccgcctccgcctctgcagtccgccgccggcggccggcggatggccgcctcccgccgcctcgcgcgaaagctcccgtctctcatctccaagcaccagcgcctcatctcgccggagatcgatgtcgagcaagccgccgagagccccgcgtcgtcgtcgtccatcccgctcgacccctccctgcccattctcccgctcgccgtctcccacctctcgccgccgagccctctcccggcgctcccctcggtgcacgcgtccaccccggccgcgctcctccgcatcctccgccgcgcgcggcaccacccgcgcctggcggcgctcgacctccacctcctcctcgcggccgcgtccgactccccggccttccgccccgaccaccgcctcacgtcactgctcgcctcccgcctcgcggaatcccgccgcctcccctcgctccgccgcctcctcgagctcgtcctcttccgcccctgcccctgcaccgacgactccatcttcgcctgccccgagctcctccccacattccgcaaggccatcctcgccttcgccgcctccggcgacatccccgccgcgtctgacgccctcgcgtccctccgccgcgccgctgattcacctctccccgccgaattctacaacatcatcctccacgcactcgcccgcctccgccgccacgaagacaccgtccgcttctacggcgagatgacctccacccaccgcgtccatccggatgtctacaccttcaacattctcatcaacagctcctgccgcgctgaaggcgttgatgctgcgatgcgctggtttcaggagatgcgacgttggagctgttcaccgactggtgtgagtttcaatactctgatgcgtgggttcttcagagaaggaaggtgcaaggagggcattaaggttgcacgcgagatgcttcagcttggatttgggctatcggttgcatccatggagatcatgatcaatgggttgtgccgtggtggggagcctctgaaggcggccgaggttttcatcgagtttttggtcgatggagtggtgccggaagggtttgattgcttggatctggttgagtctctgtgccgtgttcggaatgtggagaaagcagtggaagtggtggagttgatactggaaaggaattgggtatcctgcttgggtgtccctgctggtgtaacggttttggagtgcctgatgaaggaggggaagctggacaaagcatgccagatgatggggaggatggttgctgcggagatagttccggataccatttcttgtaactatatttttgaggcgctctgtgaagctgggaggacagtggacgcaaacaggctgaggctgcaggctaaagagaaaggttttcaggctgatggctttacatacagcatcattgtgcagggctttgggaggcagggaataaggaaagagggggaggctgtattggatgaaatgctggatgcaggatatgtaccaaacattgcgacttacaataggctgcttgatggcttacacatggggagatctatgcaattacaacaaaaatgttcaaggcataggaatgcagcaaactgaaagaatatcatagagatgaagaagctagcttggatttcagagagatgctagatgataccttctcaattgctctgatacaggttagaattttgccaaggatttgaactgaagcgtttctgattatacttttccactgcaaattactaatctcgattgcgtcacccttatgcattcttagtaaaagtgcctctatatcttctccacaggctctttcatgtgtgatgttaatcatatctggctatcggcaaacaaattgagtatttttatctatcttcatgcacattttatgtttattctgttaatcactttgcttagattcctagtaaggccttctatggaacaaaggaaaaaaaaggttgtcagggttgtttaatttatattatcttaggttgtaatgttttatctgtataccgtccagtggtcagttttaggtttttacacagatgcagcctagataaaccagaatttgctaaagaaagttaaatctgattttttaatagtgacgttgagcattggttttgtaattacttcatttacctcccggcgtaattacttcatttacctgttttgagtaccacttggattttttttcagggatcataaaccacatttttatagcatttttatgcatgtctctatcagtaaatttggtatggatttgaaatgtatcatcccctcagttatcttggctccaagaactgaataggaataactttgtaggaaccttgcctaagcaacgaagggtcaaatatttcatgaactcgtccttttcttttcaggagcttgagatcagagatcaatcagcaccggtctgccacagcaaccatccaagcctgagctgcgcgtggccactgccaaacgagttgcaactgcactaggccgaggttgcctatccggtcctgtttcagcccccagaacaccaccaccacctcatgctgctctgctcactgctattctcttggagcaggaggctgccgttgagttgctgctcaggatttccagtaagatgtttccttgcgaacacgctggcggtggtggcaatgtggattcagtcatcaatgatgggaaattgggaacgacatcagaggcaacaagtactgaactctgcaagagcctcagaattttctgaagggaaaggatgtgaggatggtatcttgtgcctgtgaatgtgacaagcaatgaagcaaatccctggaagttttgacatcggcttcacccaaaaacccgttgtcacatcaggtaccaaaaagttttggcaaatatattacaagatgatcttgtcaatctttcatatgttggatagaaatgctttaattttggtcgcttcagagatcatgcatctacttgtgacgttggctggcatgcatggctatttggtcatattggttatgtgtactttcggtggttgagcatttcattcaattatcatttttagattattgttgttctaacatatgcagaaattctgaagtagagcaaagtattcttgttttcatctattaggaggtatactcaaaattcgttcatttcagcttacaagttttgagtacatgcatgaacccttgggatttatctccacagagaattgacatcttctgattccgaaatcccaaccaaacttcttaaactggatttgactaacttgaaattcttcagtagtttaccgagccacatttactctggaacattggtcgatgcatacaaatactctgttttacttcatatttacacattttgtcaagtagagcaaccaatattctaccagatatccctaattcgttctaatatacccgtgaaatgcaatcgatgagcagcaaaagggtcagcaccgcgagcgtcgcagtgcgccgctcggcggcgggtcgagccagagcgtgcactgcggcttgacccagtatctgtacctgaagaaccaccggtcgaagttgagctgcgtgcggaaccggccggcgagccgcagcgccaccggcctgccgcccttggccgtcgcgttccgccacaaggccgcgtcctgccgcgtcacggacacactgctgaccaccaggtgcactctccggggcacgctgccgccgggcgccacctgcactggcgccggccacaccgcctgcgcggcgaccacgctgtcctcgaagtagaggtcgaaccgcacgtagcgcagcacgatgccgatcttggtgttggggttggagatggcggcgaggacggtgaggttggcgctgatcgcccgccgcgcgctgtcgccgcgctttgtcgatgtgcgccgctgcgttcagggtggcggaggtcactctcagccggggtgacttggggtggtaggcgagggagacggcgacggtggccaggcagacggcgatgatcagaagcaatacgtggatgtagaacaggatgtggcagaacgccagcggcttcctcttcattttgatctgatagtggagactcggtgtcagcggccgtgctgcgccgtcgccgtcgcccgggtgcgccgccggtgcgcacggttgtcttcgggatggtgatagtcctggctggccgttctccggctagcaccactaccggcgtcttctctgcctgctgctgttcttccggcgcggctgcgcgcggtggcgccgcggcgtgacgctgcttcttcttctcctcctcctcctccacccttctctgccacaaaggcacataggacggccgtcgcggcggcgcgtgcttctgccacggcttcgtcgcggggcgcgacgccatgccggaagcattcgtcttggtgtctcggctcgccgccgccgcccgcatgtggcgccaacgggcggttgcccatggctcggcaaggccacacacgtacgtgaaaggagcacgaaacggagtagctagtcagtgtccttgaatttatgggacgaggaagaagcgagaattttggagggaaaaggagaagaaatgagaattttggagggaaagggagagaaggaaggtatccttgcttatacagtggtagtggtactgactagtaggtggtagccaaggaatttttcgctggcttggcaagcgagcttacttccatttttctgaaaaggaacagagagcttccttcattgccacctattccaaaactagctcattaatccagcagagaaatcactctgtaacacatcaggtaacagaaggttttggcaaatattgtccaagatgatattgtcagtcatcctaatgttagagactttctgtttcatgcacttgagcagatcaaccccatccttgtgaagcattgcgtcttcaatgtaccgatatcgtgatcacatagattctattcatttcagcctaagtttcgagtacttcacggcttcaccggctcctggatttatctccaaggcaaaactgacatttgctgattcccaagatccttaaaccggtaatcactaacgtttaaatttgcaaaagtttatcatggaaaaacttgcacatttttgtcaagtagagcagccaaatattctttgcttgccatctctaattaactctatccttggttccataatcccattcgagcagcaaaaattgcagaagaattcaaattaattcaatcaaaaaatagctaatcgaagataatagaccagtagtttgtagtttgctcttctaggctgatgaaaacgaccagaaattaagcagattgacgcagcagcagggggacgaacgcgcggggtcagctgcaccgcgcgcgacgcagcgcgccgctgggcggcgggtcgagccagagcgtgcactgcggcgagacccagtagttgaacttgaaccaccggccgaagatgagccgcgcgcggaagcgtccggcgaggtgcagcaccacgggcccgcccttgctcgttgcgttctgccactcgtacacgtcctcctgcgtcatggtgacctcgctgacgacgaggtggacgctccggagcacgctgccgcgggggccctcgtgcagcggcgccggccacaccgcctgcgtcccgatcatgctgccctggaagtagaggtccagctgcatgtagcggagcacgacgtggagcttggtgttggggttgtagatggcggcgaggacggtgaggtcggcgttgagcgcgcgcgcgccgccgacgatgccgagctcgtcgacgtacccggcgttcagggtggcggaggtcacccgcatcctgggcgactgcgggtggtagatgaggaagatgacgagcacggcggcgccaacggcgatgaccagcagccagaagaggatgcagcacgcggtgaagcagaacgccaccggccgcctcttcttgtcgttccgagggcgcagcatcggcgacttggccggcgtccgcgccggtgcctccgacgatggcgatggcgatgcgtacgacccaggctcattgtgcggccgccatggtgacggagagctgcggcccggcagcgccggtgtccccggcgacgtgcgcggatgtcgcgccgccgttgcgaacccaggctcatcttgtggtggccgggcggccgggaaggtgcggcccggcggcgccggttcggccgggtaggtgacgccgtcgtcctcgtctctgatcgtgctggtgcgctcgatactcttatgggtgtctaagatcttcgccggctttaatcctggtggtcctaaccgcggctcctgcggttcttccggcacggcggcgggcggtgctgggtggccagcaggcgccgaccatggcgtccggccatggctaccctcctccgcccttctcagccgcgcaggcaggtaggacggcttcttccctggcctcctcgccagggcggcttcctccccggcgacggcgtcgccgtgaaccggcgattgcggcacttccgttacttgggtcacgaaacgagtgcgtcggtccggacgggcgctggtaccggcgccaccgtcgcccggcgccacggcgtgccgtacgccatggacgatctcttcttggcgacgctcctgcggcggcgcgtgcgtctgcggcgccggcccccgcgtcgtcggcgccgcagtgccggacgcacgggcacggctcctcggctcgctgccgcccgccggctgtttgcccatgtctcagcaagtcacacagctacacaagtgagagagagagagaggagaggatggagatggatcggaagtgtgagaggttcttggctttcttcttctagtgagcaattcagcgtccatgcacttgaaggagaagaggaagaagaagaagaagcaagaaatgggaattttggagggaaagggaggcaaggaaggtatcatttgatttgtgactgaggcaagcaacttagcagccatcatgtctggctgtctgaacatgcaatttcatagtattacactggagtacttaccactactagtagtagccaaggaatttttcatggcttggcaagagggcttcctttcttcgctgccacccagctccagctgagaccaaaacttgtactatgcatccagcagaaatggctgccatgatctgcacaaaagtggtttttgtcgagaggatatatagatgtttaatgattttatctcccattggttcattattactgggcaatctcgctgacgaattaagggtgcgtgttagtgacccatgttataagcagaggttaaaaatgaccttatcagccacactcaaaatgagaaatataattaacatataattaattgagtattaattattaaaaaaaatatattttatttttaaaatcattttttatgtaagaaaactttcatacaaaacatatcgtagcgatatgtaaaacgtgttaacaaaatttgagaaagtagccaagccaatcccgattttagaacatgcgctcaacgtgtgcttaggggctgttcaaattgatgccattttcaatcatatcatttttggtaaagttactaaaataatatctatgtttagtttgttgctaaatttgataaatacataagaaattctgctaaaattttggcaatattgccatcttgctaatttggtaagatttattttggctacaatctgaataggcctaaagtgcttgcttggttcggattcaggtgttcttttgcgttttttttttgatttttttctgtttaagaaaaagttttctaaatcgagatcaccaaaactccaaaaagcgatcgtgtttagtggacgagtctacgggtcgggcgcccgattggtttggagaaaaataagacgctgatgtcccgatttacgtgcaaaattactttaaattgattttttattaaattacttattcaaatcataatccgattgtaccattaaattcgttgcaattaaatcttcaaaacaagaccacacatggatatattttgacgaaatttttttagcttattattgaattatttttaaatgttgcatgatgttccaccaggtatatcggaattgttttattaagtagatcgaaaatgtttcactcgttaaaatcgggtgttgtttcaccttatataaaaacaatgtttcagcaaatagcgaaagaatatttcagttcactgcaacatttgatccatacatagtgaaacattataagtacactaggtgaaacatttttcggtggaacaaaaaataaaacgaattcccttaatagggggtttctaaaatatgtggttttttttgttgcaatggaatattttagttcactgcaacattagacctatatatagtgaaacattgtgagagtctaagctgcgaagggttggtggtccctgtagctccaagggctccatcggagcttttctcttgcctttagaaagctcctctttcggggactccacactccccccacttggtgctcttctccaaacggcatggtttggagactcaaatgatggatatacaagcgtgataacttatatgcttttccatatctccataaatctacccacttttgcttgcattgtattatttggtctacgtaccagaattgataacattcgagattatgcaggattatacacgaaagatccttttttggctctttctttagctgtacactaggtgaaacattttttgatggaacaaaaaataaaacgaattcctttaatagggggtttccaaaatatgtggattttttgttataatgaaatatttcagttcactgtaacattagatttatacatagtgaaacattatgaatatagtgaaatatttttggtgcaacaaaaaataaaccaaattcctttaatagagggtttgcaaaatatgtttgtgatttgttgcaatgaaattatgtgtgtggataagtagcaggtggggacagggggcatgtggtggaagcccagagaagctgctggtgtacacgtgattgggggaggggggagcgaccaattttttcccatcccccgtgtgaccgagaaggagcattctcgtgttggaataagttcatcgtaggtcccttaacttgccaacgaatctgattttcatccctcaaccgaaaaaccagatacaacggtccctcaactatcaaaaccggtgcagattaggtccctcggcggttttgagggtggttttgtctgacgtggcgcctacgtggctaatttgactcggtcttcatctgacgtagcattgacgtggcgcctacatgtcaattcgatccgaaaaaataataaaacacatgggacccacatatcagtttcacagaaaaattaattaaagaatggtggggtctatgtgagccccatatgtcatcctcacccctcttcttcctccactctccccatctcccctctcttcatctctctcctctcctctcctttctctctccaggcgacggagaggcagcggcacacggcggcggagctggagccacacgcgcggcggctcccggtcgtcgctggccgacttgtgcagcggcgccggaacaggaggaggtggcggccgcgacgccaactacgacgtgctcgtgccgtcgtccttcgtgcgcaccgacggctgcggcggtggcgagtggtgaccgcttcccgccggtccacacgtttggcttcggcaaggaccacgacgcggtggcgatgcacaccatcgccgaggtcaccggcgggacgttctccttcatcgaaaacaaggcggccatccaggacgggttcgcgcagtacatcggtggcctcctcaacgtcgccgtgcaggagttccacttcgacgccgagacatggagaggaccggacggaccacgagtccacgagcgtggccggcgacgaggaggcggagtccggcgtcgccgagcgctccgtggaggtggaccgagctagtccgggtggaagccatcgacgacatcgcgctggagcgcaagttccgccgcctcgacgagaactccgtcgtggtctccttcatgcagtggttggcgcggagctactgattccaaccggtgctgagaaaactcaacaaactaacagactctgaaactgaagaaaaaactgacgcgctacagtatctaagactgaaaataacaaactcaggagaaaacacaagtttacatatattccaacagctaccaccacgtcgcctgccacgacggcttcaaggtgctccaccagctgtagaaggcacctctacaacaacaacaacctctagctccgccgccgtgggcaggagtccgacgatgatctcgggttcacgttgtgcgacgattactactcgccgccgccgaagttggtggacttcgtcgccgaccatccgttcgcctccttctagctactccacgccacgaccccttcccgtgctgccgctcctaggcactgttgcgaccggtcacctcgccgcgcgacgccctgcgaagacgatggattgcgacctctcctcgacgatgaagccctgcgaggacgaggagctcgcccgccgccgctcctcctctgctcccccagcccgcttcgcccgctcgtccacgcctcgccgccgaagtgctgtcctgctcgtcggcctccacgcgcgctcatcggcctccctccgtcgcctggagagaaaggagaggagagagagatgaagagaggggagatggggagagaggaggaagaagaggaggggtgaggatgacatgtggggcccacgtgggccccaccatttttattaatatgtgtgtgaaactgatatgtgggtcccatgggttttattattttttcggatcaaattgccacgtaggcgctacgtcaatgccatgtcagatgaagtctgagtcaaattagccacgtaggtgctacgtcagccaaaaccaccatcaaaactgccgagggacctaatctacaccggttttgatagttgagggacccgttgtatctgtgttttttcggttgagggacgaaaatcagattcgctgacaagttaagggacctcagatgaacttattccttctcgtgtttagtgccggccggcccacgcaaggtatgctgggccggacaatgcaccgcaaaacggcgtaaaaacctctccccctatttttttatatagaaaggatttggacggatgtgattccctcgcttccgatcggacggacgggataacacccatgggcccacttgtcattgagcgtggagacgaccagccaccccacccgacgcctcggccccctcgcaaatgtaggaaaatcagaagagaagaagcgaaagcgacgccgcctccactccgccgcgcggctgctctctctccctctctaaaaccctagcagaggagcacggcgaggagaggagaggagggggaaggagggagaggccacggggaacgcgatcgccttcgtgccgcccatggagacgaccatgggattctggggtgcgttcctcttgcccccgaaccctactactgtttctcgctcccgattcgacgccatctttaattttttttggtcgcgcctagtcgataggggaaattttgaggggtaaaaatggtgtggtggattgttgatcctcggtttcttggttaaatgctgggtttccccccatatgctccggagatctggggatattttcaccggcaatgcttcctgataggatgcggtggtattttggtgtatttgggggagaaatagaagcaatattcgtgtaggaaaatgcagtcatacccttgaactttaatcaggctcttggcagaactgcaggaaatttggctattccattgatgagttggattcaagtgaacaagttgatatctaggagtaataaggcagtagtttgtcttaatgaactgtgccttgctctggagagtaatacattccctgcttctgtttggtggttcctggatttagtatagtttgtattttcatgttatggttggatgatttagtgcttcagtttttttaatgaattaagcatggcatgaagcttactggagagtgttgactggcaaggtcgatgttgattggtcaatctttgatttttcaggtcttcatgattgactatggtttcttcttgcccatgtagatatgaaatatttatcactgaaatacgcgcattcttctacttatatttgccttcgattatgcgttgtacttattctgaacacaagtgtggcattcaaactgcccgttggcatgccactaatgttttttcccctctgtgtcaactgtgaagagatcttttgatcgcgttggacacaagcgtgatgggcatatttgtagagcttaagaaagaagcaaatgtttgtcattcccaatttcacgtgttgctcatttttaccaatgtttactaatggctttcatgaatgtaattcacatttctaggagttgctgtcagacctggagagacagtgatgtgtgatccaccaggagaattctattatcatatttcacaggtttgtttaacaaattgtacctaaaagctcatttggaggtggatcaagtttgtttactttaagttcccattttcactgcagatagcgttagagcctggtgagctgaatgagaacgtgcaagtttttggtgaagttgatggtaaaaggattctgctcggcacactttcagttgaacatcgtcctcagttgtcaattgatctggtgtttgaaaaggagtttgagttactgcatacctcaaagacctacaacatcttcttttctggctaccaagctgcggatgcgagaagatatccttttgcatttataatgatctttcttcaaataaatcatgagtaggaatatttttccttaaccttttgcctggctgtatgcacatctgactctcctactgaagaaggtatgtgtccttgttctttactagtagtaattggtcatctctgatgtttccgctgcacttggcctgattctcataagatgtgatgtttcaggtgatgaatctgatgaggaggttccactggctattccactattccccaattcagatggtatataatttgctaatcgtaacaattattttataagacttaagaagatagcatggtaattgaacttataagactttatatatttttacgctagaatctgatgcacatgctaatacaagctggtaagcgaatcttcgaatgatacactcttttatgttatctactttcagatgataagatcaaagaagttcaaaacagtccaagtaagtttgccacacttaagtctgctgctgctgcatcccctacaccagaggctattgtagaggaaagaaagaattatgggaaatcagaagctgatgatgatgacagcgatgaagaaagtgatgcttcaggcgaggatgaatatgatgatgatgaggtttgtaaaacagtaacactattaaaactagcagcatgctgattcttgttcagactgaaaccatgacatggttttggacttcggtaggtgtgcgaacaaagttttctttatgctagatatgttatgatcatgcgatatatttgtaggatatgattgataaacaggattctagtgatgatgatggtgatagttcggatgaagaagagactccttcaaaggtgtgagcttgttcaaggctagcaaccccaattatggacagcaaagctggtcggaaactgtttcttttgatttgttttcccccctaaattcactgttttttttatggcacagagattgcatttctcacttgtagatcttgtgtgcaggaactggcaagagaagtggctacgtccatgtcgcgactccttatccagcaaaacaggcaaagaagacacctgtaaacaatgacatggctaagcaatcctctggctatgtccacgttgcgaccccttatccagcaaaacaggcaaagaagaggactgccaataatgacatgtctgagcattctgctggttatgcctgcaagccatgcaacaagtaaatttttgttcttttcatttgaatgatttaccttagtaatgctgctatatcctcacatatgcacttcctattttgctcaggactttcaacacctctatgggtctggaagctcattccaaggcgaaacacactgcaactaagtgatctgaaataccttctgggcaatcctgtgtaggtgtgttagtgataggtaactgaattctgaagctggagatccagatattttgatgaagcacaattttggagcacttgccaagtttctgaaacatgtagatatatggcgcttttttaatgaatgcgtatggatgttgcacgtttcattgttctgggatctgctcttttttttttcctgagtgtgtttggacggacaaaatctggtttaacgatcccaataccgggataaaaaactgctcatatcggacacaatctgggttaacgatcccaataccgggatcaaaaactgctcgtatggtatctttggatttcgtggaaaccaatgataaaccaacaaaaactggtggtgtatgtctgtaaaaaaaaccgtttcgtctgtgttttagacaagtctgggatgtccagatttacatacaaaacttgtactaaaattctcaaccgttcgattccttaagtgtgattagccacgagtccatgatcgtggcaataaaacaaatcattgccttggagtgcagaaatcagcatatcatgatttcatcgcagagttgagttactccctccgtacgtttaggataatgttcaagggtctgcttagttggtgaaatgaaaatttttaggggttttatcggacgtttgaccgggtgttggaagggttttttttatacgaatgaaaaaactaatttcataactcgcctgaaaaccgcgagacgaatcttttgagcctaattaattcatcattagcacatgttttgagcctaattaatccatcattagcacatgtgggttactgtagcacttatagctaatcatggactaattaggctaaaaaaaattcgtctcgtgatttctatacaaactgtgcaattagtttttctttttatttatatttaatgctccatacatgtgtctaaagattcgctgtgatgtttttggaaaaaaattttagaattacacagggcctgtttaagtcaaacattgggaatataaatcatgaacaaatctcaagttgttgagtttgaaaatataaaagttatacaaatatatttgtcttgaaaaatattttcataaaaatatacatatatcacttttcaataaatattttttatagaaacaagaaccgtgtcgctgtttaaaacgacttccgttacaagtatggagggagtacatgcgatcgtgtgcacagaatggaaagaaaacgaagaacttgaccaaatatcaaatacccaaaccacagtagagcatagaagacagagtataaaacctcgtaaccaagaaagcagactagtctccgcattgtcacaggccatcacagcacaaataacatcgttttgtaattaatagtcacacagaccatcacagcacaaataacattgttttgtaattaatagtactacctagcttgtaacctcatccaacttggatgtttctggatttttaagcaacgttttcgccaaaaaataaaataaaagaaacatttagcaagcaaaattgggtatgccccaggttgtagggccaaaactgcctattagaggatcatctttgaagcaaaagcagctgcagtcaaacatgccaccagtagttcacttggctggatgtcttgccttctgatgagaccggagtgatttatcactactaaatgccctgtgagagaaaagaaccatctaatgttagaatgcttgtgataagactgcatcttatcacagcataataataaactgccaagctgtatacatacttgctgcaatacttgcaggcatgggtgccggaggattcgggagtctccttatttggtttgctgattgccggcgtcttgccatcttcctttgctggatgagtattcttatcacctttagtaaatgcgaaaaattagctaaagttgagtcccctgtgtgttgcaaggttaataaaaatagcgtcagtccggcagagctaacctgttttctggccaaagtgtgttgcagtctttgacttcttaccagaagaaagtgtagatccagcagctgtcagcttgctgctctcaggctgccgagcacaaaacaagagtcagatcgcatcttagagacaaatcaagagtcagatcgcatcttagagacaaatcaagaacagtggcagatatcgggcatactttctctggaatttcatcttcctcatcactttcatcctcttcatcagtggacaccatcgatgaagatgattcatcctgcccatcactcccatcctcttcttcactggactccatttctgctggtaactcatcagatccatcatcctcatcacctgactcatccttaaggggaaaaaagtgagcaatattacaaaaactatacataagactttcttcgtcataaaactatacataaaactttatgagggtaaatgcactttcatcataaacttacatcatcatcatcggatgaggacgagtccaaagaatcatcatcatcatcagatgaggacaagtccataccatcatcagaattatcctttttaccttcctctgcaacaggccttcccagatgtttaccttaacaaatatagtgatatacagcaatcccagagcattaattcagccattgtcaagaaagcgcatgtgtgatcttaaacgcgcaactaataaaaagaaaataaatctgcatacccataatgtcacagatgtcagacatgttttcatcttcatctgaaataaggacatactagttagtttatgttataatagaaatattggatacttaaacaatagaaattatttcagaaatatcagtcaatgaatttaccctcatcttcacgagaatcggatgtgagaaaagaaacaacatggttaaggaaacaaggttcccaaaggatatttcaaataaaatctaaatatgattcgaaaataattccaagtgcatatgttgaaggatattcatatgggttaggcatgtcagtcttgtaaccacacaggaagacactagtagtctttgaactgtgtgaaagctcaaagtcattgccaataaacaaatcacacataaattgaggatgatttttagccgatagatttccaataactgtcttcttgccatcaactttaacagatacaactacattctcacttcctgccttctttgtttctcccagtgcaacctaaaaaaagtaacaataacatgaaaagatcaattatgtaaggaccgagattgagaacgaacacaaattataaataatcagacaagttgtatttaaattttattctctccctccctttttttgttcgttgtgtgtgtttggaagatgagggttgagggtgctaaacctgtgatatgtgaatcacacactcatcatcaacgttaaatgaaacagcctttcctggcttcacttcaatacctgcatgattcagatcaatcattcaaactcccatcataaatcacactttacgaattcccttgcatagctggagattgaaaatgcagcccatagtgcattgagaaaacgtagagttatgccaaataacaaatcagcgcttgaaaagctcccacaatctagcatcaacaataagtcaaaaaaaaaaacttttcactacttgaaatttgacaacccactaaatgatcatcccatcaccccacatataatggcataggagacccttatcaagttatcatcaaactacaaggctttctacagggaaggaagggtgatacttaacagtacatcataaaattcagattataatacagacaagatggcgaatttctcaacctcggaacacaaaaccgatgataagcccgttcctcggcactagacaaaacagagcctaaagtgggatcgcggagaagctcgttgacgagaacaccatctaaaatcgcacaccccccaacaccgtttgaagcattaccaacatctcatcacgggaacacgacacgcccaaaattcgcaccaaaataattgcaaataaaatctccccgagaacacaacacaaatataatcaaccagaatcttggagagagagaggggggggatcttaccccagaattccatcgctgcctcgttgggacgacgaatcggaggcgcggccgcgcgaaaccctaagatcgaggaggaagcggggacgcggggtttagggtttaagcaggggatgcgaagcggacggcggggaaggtgaggcgacgaatctgggccgtcgattcgttccggtagccgagatctgtggccgttggttggttggctttcccggttttgattttggaggagggaaggggatcagggacacgaagtggtggagcagataaaattatgaaattgggctttgtctgggcttaaattgagaacgtggcctgtttagctgggatggtatccatattcggcccaatttcacatttgatcccccagaaaatcacgatttccattttctgttcatatttacgcaaagagtaatcgagtgatcactgatcagatgtcaattatacatttgatgatcaccataacatcacgacttccatttttctgctcacattcacgcaaagagcaatcgagtgatcaaatgccaattatacatttgatcaccataaaatcacgatttcctttctgttcatatttatgcaagagtaaccgaatgatcaaatgtttactggagtagtttttataagaaaaaaagtccggtatgtttatgtaataatagaacaaggaaacatgatttgaaaatggtctctctttttatccttgaacaattggtttaacacctacaggctacaggggcatgatatttgcgtgtttatcgtcagcaacaactttgggggcttattcagtttctacgcagataacatatggacaaacacacataacaactgacacacaccagaaccaggtcagctgttctccattctttgggtaccctcttatcataattcagaaggtgaacactggagaagatgtacaaagctgagtggtggcaagcaactggttggtctattattccaacttccaagcaactggttggcaagcaatcagttgtcgttccttcacacctcctggagttgcaaagtacctcgccgctgaagctcatagagcaagaacagggcagcagaatcctgtgagctcttcttatctgcacggccatctcctgtgaggctgatcacatcagcatttggtatatgcaatgtaatggttgaagcgaaagcgaacgcttggggggtagctttctgagaggaaccaccaggggaggagcacacgctgctaaagctgaaccatgaaagattagtaagttattttgcactgttgcatagataagtaaataaacaggcattcacaggctagtatgaaatcttagtaccttggttgtactttctcagattccattgtaggcattggccattgcaactttttacacaactcatataatgcaatgcgtggtcctcctttactcgttttcacaatcacgtgcactgaaacaagataaaattgttgaactttatcaaattgattcgttctacagacgtggatatatgaggtcctgatatgaatgaaagcacagagataacaacaaaaacagaaccactggtgattgagaacatacatggtttaccaagcaggggatcagaaatgttccttgaatcagctgcgtttttttccttggttggttttggagtctgtgtatccattgcatcgacatgcaaattgttgaagggattagtgctgccacaatgcttttcaaattgttctgtcttgcttgcattctttgggattattagtcctttttcctgcaaaaacgaataaacctgtcagcttatattatcccctaaaagaacattgcaacatacactaccaaaatagtggagcacaaaaataggacacctcgagatctttgagcagtaaggaagatgcatgcgctttcgcatcttttcttttcttgctaaaaccttgcctcacaagaagcacctctttgagctgtacatcaagagtagccactactgtgtctccttgatctctacagttaattcctacaaaatacccatgtttgccacaccattcgataagctctctgtatggaggtaactccagattctcaggtgtgacaattggggaaagaaggggttcaaaaataccccagactacatccaaatcaagtttggtgtctaaaagaattgcacctgcaatactttctacaatatcaccaaggacctgtatcacaatagacaagtgaaatatgatatattaatatagataaattgtaaagatgattgtgtatgtcaatactggaagatgacactaaaaaggacacaggtaatgcaatgcaaataacttgtaaaaagtatattaaatacatagccatgcatttataagatgctctaacttaaagcaaatgtcattcatatgaactgaaatcctaacgtattgacttgattttattctgataagagcaaaccacacacatgttaaaacaaagaaagaacgtactttaggcccttttgggagtccatctgataacagttcaactttgtccatggatgaaccttccaacctattcacatattcagtaatttggtctaacagaagcccagaagaatgctggagaaagtgatggaagttgtgctttactgcaacttgtgcaaagttttcattattgactgatgcagaacgtaagtctgtcaactccccctcattagtgtctttatgactattgaaaagatatcttgttaacagaatgtctaagaccgcatcaccgaggaactctaggcgctgttaaaaaaaaaacattagagaagttgggtaagttaagacacaatatgaaggaccagcaaaatagttttatgttcacccgatacctcgtagcagtattttgcacctaactcctgctgtgatgggtgagtcagagcctctaccaaaagacctttcaccgagaaagaatagcctagttttgcttcaagcatttcaaatacattgtcttttggaagataagtctgcacagaagcactcaatatggcctgcacaatcaagtcttcttcaatttcagccccgatgcccaaccatttgagaactgccatggctgctcttaaaccaccccctgcataatatgccccaataatagcctcaacacaatcagcaatggttttggaacacatccatctgtgtcccttgtcacacgccttgcctagaacaatagccttgtcatcaatgatatgaatatcgtcagttacaacctcagattttacagggcattcacaaggagatggacgaatagagagctgtcctggtgctagccatcgacgaggatcaaatgcagcatcacgtacgtaaccctgttgattacattccaccaattgtcaacttagctcagacaattaaagctcagtgtgtccatgaaatacaaaatctctagacactgccaaatgataatgtgaatttacctgtacattgcgttcaattccaagcttataaagtgtggcattacaaatcatatggcaccttatggatgatagctgcccctcatccttattaggaaatttcaggaaaagatgacaactcactgcatacttcaatacagagtctcccaataattctagacgctccatagagaaatcctcagagcacctaagcgttgtaatagcttccagaatctaaagaacatgtgccaatatatcatttcatattaaagaaacagaaaatgtatgtatagaagagagaggtataagcatctataccaggaaacttgatatattagaatcgctgtatccaatttcacttcttagttgactagctaacgttaatgactcaatccgatacatcaaagccggaaacaaatagaatgatctcaaaatttccacaggtaaatcaaggggaatcagcaactcaggaggcatgtggacacggttgcttgttttatttacaactggtgtgccattactcatattctccacaacattacctaaaaaaaagcaacagcaatcataaatattagatcagcctatatacgacataatcaacttggctacaaattacaaaaataaaacagtttatgcaaaagtaaccagtctaacaaatgggtttatcactaatcatcgaagtaaaaaaatagagatgcttcaaactaatcttgcttgaaaaaactaataagtaaccagttagggaagacaaacacaaggtagaacaaaactaactatatagaagaatagatacagaccttcatccctgaacttcgaggaaagaaggttgtgaggattatgactaggcttcaaaactagtagtggctgtgaggggtggcgaagtactatgccatacctgtaaacgaatatattagacaaaaaaagcaagattatacctgagcaagcacatggacatgcacaaaactatacacacttctttttgaaatattctgcgaatgtccggaatttacattctttcttatcagatgcaccatcaaaagcgctatcgccagataattcagtaatatcaagagcagtatatatcttcccagtgtgaactgctagaactaccatatctttgaggctgttagccttacacgacttgttagctaaatgaattaaatctccaacattttggtcagaatcaaatattccaagtaattctcttttattctcagaataaatccttctcataagtttaactgccgtagctgccgcatcaatgacactccaattaatacaaacgttggagtcaaaagaaggatttgttggtaaaagcaaatatacactcgcagtgttccacacaaatgtatcctctttattaagaatgaattccctcggagcattaggtacttttgatctagtaaacagctttccaaacaaaccattgaagagaagcccttgaaacaactttgcttgttccatctgagacaaaaaaaaaggataaggaatttttcagattaaatgggaaaaaaacaaaagtaggggacaaacttcatcatacctgttgagcatccaactcaagaagtccacaagaagaaactgaagttttgaccatcttgtcgtgcaaatataggtcaatctccaaagtagcgacttcatccggtaaagttgcatcaattaacagaacaaattcagagtaaatctgaccagcttggtcacaaacaaaattcattttgtagctttgaagcttgagtgcagttttctttgacacccaattgccagaccaagcatgaattcttgttgtaccatgtagctccttccgtttggttgtaccttcaagaaggtaatagagaacattaccatgacatctatttctttgtaagaagtataatggagttcagtcctacaaataagcttgactacatacgctggttacaaagaaccagccagcatatggcatcttaacttggagtaaattgcatggcgaatccttaaacttgtacacaggactaatctaggtacatatatgtagaaaatgcaaatctaggtccaaaagtgcgtaaagtagattattaactatacaatccagaagaaatggcattttatgtgtggccgtccctctctcttctcccttagatatctcccctaaattgttgtactattttgcggtggatgtcacaagtaacaacacaattcatggagatggaaacttaatgaggtgatgatgaagcatgcaggtgatgttcactcatgctcccagagatgcagctgaccttaggtgcagcatctagttgacaaaaacagcatttgtgatgttgcactcgtggcacagttttttttgggagggttggaggttgtggggaggggccggggggcacaaggatgccagatccacctcagtgtatcatgtccacaaggaatgctagttacccagatggacctaaaatgaccaccttaatgtactttatggactaaaatatgtagtttctaagtacaggaacccagatggtgaacaattagttcaagttagaggaccagtgatacgatttactccttataaaacttggcaatcacatacctataccagtacccttatttttgcttacaatttctggaactggatcttcaacagatagacaaaggtggtcatcaagtgctcctagctcatgcaacttcttacatgcatcaaggcaaacgagctgttttgctttgtgcatgtttcttgcttttgggcccaccagaatttgaagcacagcacttggtggtaatgctaatgtacacacatatccatcatcatgatgagtgaactcaaatgtaggttttggggagtagcacctgtaacacaagcagaaatggcaagaaagtgaattggaggtctccaaacaaaaacgataacagactgaaaccaggtattgcagatctatttataggtgcaatctgtgtagtcatgtaaaaagagacaactgaaaatgagatcaacatacttatcctgcggaagcttctcacagtatcggtagacaatactgatgcttgaatcagcagttactttcgctcctgttgtgcctacatggtattcgtttatttcttcattgggaacaaaaccaggcgacagatttccagactctctgcttgaagcaatcttaaccattgaagtctcacttctcacaattgcagatatcaaatcattttgcttcacgttccccctgcattagaagaaatgaattatgtatccttgcatccttcttgtttgccattcctctctgcattcagttaaaagcacgtgaataaaaggtgtaatggggtagcattaaggttataccgttcaatcatgagaatgtactgagagtcttcctggcgtgctcgtccacgtgactgcacatagctacgtgttgtccttggcaaatcaaatcgtattacacaagagcattctgggacatggataccctcttcagcaacatctgtagtaaatagtaagttcacctgcattttagaaagggaaaacaaggttatatcatgagaactatgcttcagtttctccaagtgttgacatatcttaattacctttccagagcgaaatgaatccaatgtatccttctgcattttgggtgtcagagcatccaccgaagatctccctccagtaagaaaagaaactgtgaaatgtgcaaggtggccaattttcttaatcatccggtcaatgactctagcagtgatctttcgatcaacaaaaatgaggcatcgagcatgacgagagttactgttaggaatagaaatgtgtcacgtcagtttaaaggcacacaattgaaaaaaataaacaagtggaccttccccaagaaataatacctaaaagagtgaaagatctggatgagttcatagagctttggggaaatatagcccgtctttgctgcttcaacacatccactttctgagtttagaagcatgtcgatacctggaagatagcaaatagtttagagaatacacagaaggactgagcattttcatattgagaagagagccaaaagactgaagtaccatcttcatgctacacacagacatcaaatgaaaggataggaattcatcaaggagatggtacatgatacttcctatcaaacagattcatcatactccataagttcatatagggtgttgcagtgctatatatgcttagatccattggctaatggcatggcataacagtgtaaggttgcaaataagtttacagacattaccagtccattattagtttatctacatagtcataccttgttggaggcgtttgtcaattaaatgcaaggcttcctcaaagaacttcatatgaagcgctgaattttctgcaaataggcgtgatccatttgcatcagtttgctgatctgtggcatcaactacttccttcagccaacctttctcctggcccctttcaatgcagatttttgtggcctaagagaatgaatgataagttattatttacccatattaagacatgaactctgaagcaaagtgacggtaaaagaactcttcaaacatagaaagctaacgttgcagtatgagagagaaaaaagaattactaagagatgggatttttttggttaagaagaaagtaacccaaaattaggctgaaaaggatttaaataggttgtgaggcgtgcaaacgcgcttcgcaccaagttaagctcagttcctgtaacataagtagctagaacaaatgaatataacaaatacctcacttgcacaaataagaccaacatcatcaaggcagtagcaaatttttgctatagatttagaaaggcgtctctttgattcttttgttatatcatcagcatctttatacatgtcgcttcgcttattctgcaactctgttatcaatgcatcatactgcacatacataaaagagtgtgttcttagaaacattaaaaatgctgagctgcaaactttgatgacaaatttgatcaatatagaagagaaaaaagagatataaaaccttggaacataaaactcccaattcttcactcaaatcttcaaaacaaactggtttcgagtcatagtacctgcacatttcttttgcagaaggaacacaaaactctatctcttctctatctgaaactgtgtagatctgttacagataaaaattaatgagaatcaaagtacgcagataaccgtatcacatttttaaaaggggtcataggtgtatcccaaaatggcatgggtaaaacagataaatatatatcacctaagctctcaaaacgaacacaacagtaaaacaatttgcatttggttgaaaaccacaatcagtaaataattggaattcaggtatgtatatatccttgcacttcaatagacaaagtagaatagtgtagttatcagaactaacatgtcctgtataatctaacccagcttattcaaataatatgtgtggcaaagcaggaaactgaacataccttagcatctaacaggttctccaattcacagaactgaccttcacaatccaaatgagaagagatacctgcaaagaaaaccatgaaaactcaaatcatctaataagactaagtgatgcgaataaatcaaatctgccagaaatattggcatttatgaactctatggccaaagtgaaattggagattatgcgcacgatcattattcctggatatttctcttagatggcaggtcagaattaacacatgtcctaaatgccactgtttacaagaaatttattgctgatcttttctgacttataagtctcttaacatcccattcctccccccacccacacccacacaaaagaaaagaagaagaagcattctatagctcttgcagataactgaatacttgccttttcttataacaggtgatgctgtcataccaaacacacttggcttatgttctgatttgtgatagaactcctgagatagtgatgagttataacatatgacaaacacaaaaaagaaaaacctaaatgctaatgtcaaaaaaaaaaaaacatgataagatggtatttcacaataccttcattattcttgtataagggtggtttccagttgcatgatggcattcatcaaatatcatgagactaaccatgtccaagattaagaaagcattgcgtaaagcttgtaggaacacctgtggtgtcatgaccatgacctgcaattttattattataagtgttgaaagcatcaacaagtagatagaacaggggaaaaacatctatgggatattcttaacaaaagatgttgagtaaatttcacaaaactatggatacttcgatcaaactgtcacaaaactacagagtttaggtgttatatcacaaaactacagatttagcatggaatttctcatagaactacagatttaagatagagtatcacaaagataaagattaagtagcaaatttaccacaaaactacaggtttagtgccaattttaagcacaaaactacaatgtttatagctctaacgtaacggtagtgctatagatttatactctagaatatgttgttttgtgataactttagtattaaatctgtagttctctaatacttggccttaaatctgtagttttgcgataatttggttaaaaatctgtagtttcgtgaaatttactctataatatagtgaacagaagactgcagatcataagtgctgctagcatggaatgagtattttctttagcacatatgatgaatcagtgagcctttaaaacaacaacaaataaatgcttgcctggtattttgagatttgctcttgccatctaggacctgtccattgatcaaccccctttgcaccatagtattgttctacctcaaaatctgtgtggatttcaatcacctcgcattgctgtggcaaaaaataatgttagtataaattacattacagttaggataaaacgaacagtctacagactggtataacctgtgtaacaagttgaactgttggtgcaagaaatatgatgacttttccagcattctttgttctgtttatctttccgaactccttgataagcatcacagcaatcattgtcttcccggctcctgtgtcaagcatcgcaatcgtgtttctccgcattgcaacctcatagacatcaagctgatatctgaccaatttcagcatcacaaagcaatgtcacaggattgcactctttttctgattatataatatagtaactgtgaaaaggagaactccgcagaaccttctgggagtgaaatcttgacactctctcttctgcagtttctgtttgcctgcttcatgttcctgagaagatgattccaatgacctctttaaagggttcatgtttactgccattccaacagagaaatttacaaagtgaggtcatgacaattcaccattgagaatattcacacccaaatagaacggaattagtaatcctcgaagcagtggcggatctaacatgggacatggggttcagttaaacccccaaactttttgggaaccattgaactgttattagtactattttctaaggttaagtcagtttctagaacagaagctaggattaacgcaaatccgagaaaaagtgcgtgggtagaaagaggatgtgcgtaacggaagcggcggaagcagcagtacgaacgacggcgacccagctcgctcgcgcgcgcgatggatggggatcgacgcaggcggcggtggcggaggaggtgctcaccaggatgcggcggatgcagcaggacgaacgacggcgccctgctcgctcgcgggatggatggggatcggcggcggcggcggcggcgccgcggcgggcaaactgacgaggaggggtcagggtaactcacggacgacagaggccactacgtcaaaatggcgagggtaatttcctaattgagccgagcactcaattcaccgggattctcccgggattgcacatctcatcccatccccaacctacccaaacggtgaaaatctttccaaacggagcccttgggactggacctttttaagatttttattttaatattttataggattgagattgttagataaatattaagggcttctttggatcgcaggaatgagaaaacataggaataggaaaaacgcaggattttgataggaatgtaagtgtaaaacagaggattgcaaaacacaggaaaaacacaggaatggttgtttgattggaccgcaggaaaaacgcaagaattataggagagataaagactcaaacgaaagtttccaagaggttttacctcatgttagaattcctccaaaacttgcatagcattacgcaatccataggaatttcataggattacataaaatccattcatttgattcaaagggctatataggaaaaattcctatagtaatgaaatcctctaaaattcctatgaatttcctttgaatcaaagggggtctaagtacatctgagcattatcggattaagcacggctcaccacacaggcgtgtcgtgtcagcccatatgttgaggctgaagcccaggtatggtctagtgagatgtcaggtcgtgttgtgttgaccttgcacgactagggggcgtagcctgtgtggagacccgttaacctaaatttgatatataccaaggaaaatatgctaatagaatccattcgatcctcctacacaaactccagcaaagctccggtgaggttctccgctccgatagcacattccttttcctcctcgccaagcaccgtcgtggcccttcacttcttacttccttcacctgagccgataagcccccaaggaccaacatacttagtggatgtgcttgtgaatggggttaattgcaccaccacctactaacatcgttgacatgcataccttcgggcggagcttaaaaatacattctacataaaagttgtttatataacttatccaaattcattttttaacattttaatatctaattaattaattcgtttgtgttgtaacatagacggatataccccctcaaccccaatctacaatgaacgggttgtcatgataccaccaaccaaatcctgacgagctgtcgataacctattgtctcttcattgcaatttgcaagctgtagatgcttaggggcaaatttactacatgacaccaaaattttatgtaatttactgacagacatcgaaaaaacgtgttacggctgatgacattaaaaaaactagtaatttcctagataacattttcagctcaattggagagatgaattcttaaaaaaaagataagaacgcctctatggtcacatgcttcaaacatggtgttagagtaaacttttagaaattatgcaactcaaaatttgccatagcccaaagtggcaaagtacatcactagcatacatcatatttcattttcactctagtctcggctaaaaaaacgtttgaccgggtcattgtcttatttttaaataatttatctattcaattgagctgaaaatgtcatccaacaaattaccaattttagagcgtctttcactcgtgtcacttttttaggatgtctatcatcaaattacacaaaagttgggtgtcctatagcaaattttgccatgtcacatcgacatcatcccggcacgtaaatcgaaacatgtgttaacacataattaattaagtattatctaaaatttcagaaaaagatcaatatgatttttaaataattttcctattatttattaagaaaaacataacatttagtagtttgaaaaacgtgcgtacgaaaatgaggggtttgaagttgggaacaatgacttaagaacacagcagcacctcgaaacgaccactcggcgctactacgatacaagcagccgccccccgccggccgcggccggccgaatggccgacccgaccgtctcaccctgcacgctgtcgtccctctccctctcattgttccattcatctccacaccaaaaaggcaaaaccaccttctgatcagccaaactcacgttagaacatctcaaaaacaccaaccggccggatacgtacgtgaaaggatcgatcaagaggtttggttgccatggaggtggagggggcgccggacctggccgacttcatgaacgactggttcttcggcaccgtcggcacacggcgcagcggcggcggtgcgtacgacttgaccggcgatcagagcagcggcaagaggccttcggcgccggcggagaagaagcagcagcagcagcaggggaggagcggcggcggcggcggtggtagcgcgagcaagcagacgcaggagtggttggaggaggcgaggaggatggtcggggccgggtcgccggggaggaagggcgtcggctcgccgtccaggcaggtgcccaggttcgccgccgccgccgccgccgggacggagccctcgccgtcgctcgaccgccgcgacccgatgtcacgctccgcccgaaggtacgcatgtcagtgatgtcactacgtcgtcgtccgtgcacgtgcgcgcgcacaggcgagctgtattagcggcccaatcgtcagatgggccagtggcccaacaaagctatattagcggcccagttgcaaaccacatttttttggtttgccgcccatggcggccccgcgccgccgccgccggcatcccgctgccgccgctcactgccggtggcgccgtggcgatttccttctactatgtattcgcttactagtctctcttcctccggcgagcttgcaggcaccggcagccgggaggcatcggcgacgagattctgcagcgcgcgtccatctcctcctcgcctccgcgcgccgacccgttcgcctccgcgccggcttcccccgcccactccctgcccccaaacccgccgtcttcccgccgcaagtcccgcttccactacccctccgcccctgacgccttctcctcctcctccgcctaccgccgcgccgcatcctccgcctccacctcgcccacctccgccgcaaagcctcaccaccgccgccacgcctccgcctcctcctcctcctcccccgccgccgtcgacgtgttcgacgatggcgtcgcgcgcctcaactccttcctccgccgccagcgcgccgccgtcgctgagctcggctccggcggccgcccatcctcgaggtccacgaagatcgtcctctccgacgcctccaaaagtaaggattaccaccaaatccatccccaattgctccaattgaatctaccccaccacacgctcacttgcgatttcctgttctatctccccgcaggtgtcagctcaatcgcggcggcgatatgctacgcgtggatgctggcgagcaaggaggacgccgaggcggcggtgccggtggtgaacatgcgccgcggcaggatggagaggtgcaggcaagcggcctggctgctccaccacgtcggcgtcgacgcctctgctctgctcttcgctgacgaggtactacacgatagtgatttgcgtgagctttcaggccgtttagcttagcgtgggggttggattcgtctccgacaaatcggacaactgtctaggccccggagttattgggcgtttattctgggcagaggcgacaaggatgggcaatatacagcaatcacattgcagtcgtgtcatgtgggtgttccggtttttgattggcaccatgtggctgtgatttggggttttgtggttgataggcttcttgcaattgtagcttcatgtgctgatatgggcatataaagggaaagcaattctagcaacaataagcaacataattttgaaatttgatgcatttaacatctgcgtaagatcaatttgacatgggcatctgtaatagcacctagtaaatcttattgatggcctatttccttcaaactgtttccagttttatgggcatataacatgtcaggttctccactttgaaaggaacaatcaagatgcaagcacaccattcatttccttcaaactatctcctgttttatggtcatataacacatatgtttctccaatttgaaaggaacaaccgtgatcaagcacgctgtgagtaatggtaaaatgtttatgatactgattttcataatccgacttaggttgacatggaggggctaatgatggataagcgagtcagcttggtagtggtggggcaggatgttctgaaaccaaacgataaggtaatgttatgtacttgtacagttgtactggtacttctcaagactcttgccgaggttaatgtatatgattccagcttttacttaataagcatgctcgattttgtcccctagatgggctcagtttgcacaatcctcaccaataattattgtgaagatgcttatagtctacttcagagcctggacataaagaaacttctggttagtgcatttgctatacataaaagagactgttatgcataatttagtggaatgttctgaccatgttttctgggttccccctcagcttgcaggtatcctgttagatacgaaaaatctttccaacatgtgctcaaacagagattcagaggcagtgcaactgctcttgtttggtacctctgagcatatgaggcacgaattgtttcaacaatgtaatatagtagtcttcttcattcatactatatttatttatgagtatagaatcaagaagtagcaaaaatatgtagtaatttccattcgtaacttgcttttgctgttctcttgttcagtgcttcttgatcacaatgatcattcttttgtcgagtacttgaagaacaactacagagagccgtccacaaaaggtgagcttttattcatactatatttaaatagattctgaaatccttctgtacaattttattaactggatgtatgtacatttatgttaaagacaaatttcactgtttgtcccaattcttcttaaaaatttaaacagcgttggtatgcaacagctcatgctattagggcaaaatattcttgtagtaacttcaatacccatttcacttcttacaaccttcatgactaggatgaaatatctgatagctcctcctgctgggttatattctatcactaagatagctttgattcaagtataatgctgacttactgtcatcgtcgtatatgtccctttatttttacttaacacgtgttgcctgtttcttgttattcctgacataattccattctgttgttcatattaggtgaagggaacagtcccctggaccagaaacattcagtttcagcatcagggtcatcccaagatgctaagaagcccaattcaagtaattttttctagcgcctccagtattatttgacaagtagattgtctgtaaatagttgagcaattcacagttaatgatgaggtcacactttgctggtttgaccatgacttaagaaaggaaaatacaagcgatggcttcggcgtgattatatcaaatattgaaccctggggattttacatctaatataccactaagactaagcgaaattccaaagtcaattcatagccaatgcaactttaggcagccctcccgcacacctttttttaaaaaataataatgcaaatttcttaaaagaaaaaaaacattcaactttggtatgtggtatactcttgctaatttggtggcaactgttttgcattgcagataatcagagaccggtgcacgggaatggtggaaagacctcagatgaaactccccgtgggaagaacaaatatttcttagcaaaatggtttggttttggatcaaaatagcatgttttgacttatactaattcatatcaaaatagcatgctttcacttctattaattcgactattcatttgatttacatgttgagaattcatgatttgtcacaatgttgaggaagtataattttagataacttatttattgtcctcattatatattattgtgaaaagagcactatatatgaaaactattggaactagcaattttggtcaaattaatatattttccatggttacatattttaatttttactaccagaaaatagtttttccatggtcaaactattgggaaagagcacttcctttattgtatttttgggattctgagaagagcacttccttggtatatttctggcattcctattttcaatccggatgtcaactaatgaggacatgatgattaaaaaaacatcaggaacagaactttatgaactcagttgtcttccaggattctgttttctttttcctgcatcctgtatgacatatgctaactcatttcttccagcttttttcaattacttgtaatgtttaatcattatatgattgaaatcttaactggaattgtggtggtaccaaagctacatggtccaaatgtgttaccgaaaaccatgatgaaaagtatgcactccttgactagttgcctttaacaaaagtacatctgaattatacaagtgttgtactatcaggggtttgcaccccaatctactcttcctttacttgaggataggagaagaaactagggtcaaagtaaatgagtaatagaaaaatgagagaggaggagcagagcatagtactagataggagggaccagccaccagccattagctggagtttctctggataaataagcatgaatgcatgattgggaaaggcagtgccattgtgaatcctacctgtcaccaccccctatgtttctctatcaggaccagcctgttcctactcccaggactatcctgtgcgtgcccctctaatgcaatcttccatgtgcccaacaccctctccatgggagaggaaatacaaaatggcatcaataatttcttccctcttcttcttcttctatcttccaatccattacatgatctgaattaccagttcatagcatggttaaaaaaaaaaaaacgtccgcccgtatcgcagtaacaaagtgtgtaggctcattcaaccttccatgcgtacagaaacaggcagaaatctgaatattcatcggtgctgaattcagagctcgctcccggcggcgacggcgacggcggctcgggcttgaagatgaacaaggcatgcctcatccctgtgccgaagagccagtcatgggcgtcccagtacacctgcaccttgagcttgttgatggagatgcactcgttgcctctgaacttccactggaggtgcctgacgaggacgctgacgcagccgtcgatcttgatcgccatgtcgacgtccgtgccgccggtgaggttgctgctgctgcactcgatgctgatgtcgtgcagcttccccctgtcgctgaacctggccttggtcacgaacctcttcttgctgaagacgtgctccttcttgcacaccagcaccgcgtcctgcagcgacggccgtgaccccgtccgccggaacgcgtccttcttgaggttgccgaggaggaggacgacctcctcgccggcgaccaccgcgacgtagtagtcggacagcggctccggctcatcggagaacctcgcgctcctcaggtcccacaccacgtcgatggcgttgccgtccacctggaactgcttcgccccgtacttccgccagaagtgccacggctgcatctccaccttgcacgcgctgcagctcttgccgccgccgccgccgccaccgccgtccgccgccgtggcggcgacggcggcctcgccgtactccctgccgatcttgtccttgccgttgcccgccgacccttcgatcgacaccgacaggccgtgcgtgagcaggttcctgcaccacgtcacggtgacaagccggcggtggccggagatctccgcccggtagaccagcgtcaccgcgctctgcctggccgccgcggccgccgccgccgtgccggagctcgggatgtccggcagcttctcgccggaggagaagcaggacggcaccgagaacaggtcctgcatcatgtactactgtttgtgtacgatgatgagacgagagataggactaggagaggctatacataggcgccatggagaggcatggagccatgcagagatatggagttgggcaagaagaagaagacgatgatgatgagtaggaggaggagaccatgagttagcaaaccgagctggaaaggaaggaggccaagaaagtgagctgtacatgaaagtgagtggaggaagccctcatggggtgtttaaaaactggaggaaccttctctgcctgcttggaataaatgctctatctttcatggaccaatcttgatttctctgcagtacatcatgctcctgtttttctactcccaactctcaccatggggcatctctcaagattaaaaaaaaaaaaagagatcgaaaaactcactattgggaggaggaggcaggcacaggccaatggctttgaggtatgagaattgctgcattgtcgaatcttgcacccttccctcctaactgtatgtttctcccatgcattggacttgggatccttggtggctcaggtctcagatattgcaagcaggtgcatgtgggtaacatgctgaagatagcatgacatgtggtggaggggaggcactggatttcttatggcttagggagtataactgtattgtgctgaacactctgcaggcaagggaatgtaggggattaatctgtggagtttgttgaccaactttaagctggattaattcagtctgcaaaaggtacttaactaagactctggaataactgcttagcaaatcatttgccacatgacacaacgaatctcagtcttcaggcagtagcaggatctttctgtttactggattccttcaggtggatcagacgttgaactcactgtggagtgtggactgtggtttgcagggggcttgaatggatacataagtggatggaataaagtttatggatgaaatgcacactgcagctaatggcagaatctggccattttgtgtgtggaaccacaggaaagtgaggctgtgtcctagttaagccaaaagagtggtcaatggacacaagtgacttttggataagagctctgattttcctgaaaggcaggggctttagcttgataaatactataccctacctgcaaaatcttaaaaagaagataagaggctgtggataaacttgtgaacttttctgtcgttatcagaagccatcaggatctatctgattggtcgactgattgttgataggaggctggctcccttggaggagctttgcctagctttacaaagcttttgggaacggtgatggatgcagtgtgagttgatccatcatccatgtggacttgatcaacggatttggtggcaaatggcaagtgacagcagattcagagttcctgaaaaccttccgtgttggactggaccagtgattgttagtactagtttatccgatttaggcattgaaatccaaggtagaaaagggaagaaagtttcagcatgtgttgaactgggaacctaaatgaacaaggaaagaagggctcaagagttgtctagtcaagaagttggtaaatgcaagctatactagtacttgcagagatcagagaggttgactagcgtataatcctatcccgtggacatcgcatcactaaaaaaatatagcgaagtcgctctggaatatagaagaaaagtgtagaacatgtacatttggcagccaaatttatcagaatgcatcggtaaaaagaactgtagcatcgtattttttcaacgtttaatcatccaatcaatatatgtttaaccgtaacagtagttaatttaaattaagaacatagacagttatttgccatctgctgcaggtttttttttcgccgggatcctgcagggattttcacattggaaatactatcctgccccattgttatcaaggttcattccgaaatcgttagtgtacaagtctacaagataactcccataagcattcaggccctattatccaactcaacggatcggagtccctggagctgaccaatgagtaacgcaagccaccgatcagaagtgcaacgctgaggcacatacctatgtccgtgttccatccccagaacaatgaaaccgttcagcactcattcataaagaaaatgtgttccatccccagaacaatgaaaccgttcagcactcattcataaagaaactgtggtatctacgttccagaatcttttcacataaagtgttccaaaattatgttgaagagaccatcgtctcgaatcctaatattgtttcagatgaggctaggaaatagctgcttcaaaaatattctctctctctcccggcgaaaaaaaaaaattcagttacctatgactaacaatctaacacagactagtgttatctcgtatcaattggttgcagggtgtttcgcctttgaatgatccttcagagcaccagaggagttgaaagtcctgagcaagttagcaagtgcctatgtgaggatatagcaatatttcaatggtaaatcattaagtaaaaggaacaataatttactttttgcatgagttgcagacatagctagcagaacgcttaggcgtgtcgttctttatgggcgtcctctttgcctgttttgctgggtgagggtttgtaacttgaagatgactacctctcttgctagtattagtacctgcacacaagatcaacaagaagtatgaatttgcaatcttcatgacgaaaaaattgtgagttcaacaaaaacaaatcaaaagaaacaaattccaaccagttttgttgtccgtaattggtgcttctatctttgccatctcatgtggaaatgtcttcaagggtgttaccactggttcattttcctctttagtattctgggagatcaaggaaacaacaacaacaaaaaagttacaaggtttctgagaaattaagcatcagaaactatcatccacttaagtatctcatactgttggtgtaatatgcaactttatgagggacctacttgtaattctgttgaataaagatatgtatgtgtgggggtgctgatcggtggtgaggccaacaagctcattccacccctctctcaggcgttaggcagcagcagcaggaaggcgggagaaggtagcagcaggagcagcaccggcgtgcggggcagcagcagcgccgccgcgccactcggcgcgctggtagcagccccgctgcgcgcacgcgaggccctcaggttcgtgggcttcctggaggagaggagctctgtgtgcgcaagctaggaggaagaaaagacggtactgttttgggagttggatttgggactgatttgtgagcttgttgtgggaaagagagcaagtttatttctgtttctttgttgacaggtgcgggaagaagcctggtccagttatgtgatttgggttgctaagagcacaagcgaggatatgttcccgttctttgcttgctgaaaacttgatggaataagagttgccgtgattgtggtgaacacgggcagcaaggagtgttagttggcatcgctctaggagatggatccattgaaaggggttgaggaatcatcgctggtcactaaaggcgagatgaaaagcctactacaagacttgatagctactgggatgatggggcctagaataggaggggcatcacctgaaataaagctagagcaaatgccgaatgaagttaagttggaggagagccaaaattacttgagctggtctagaaggacaagattgatgttgagggcaaaaggggtagaacactatttggaggaaacttgtattgaaccagatgacaagcttagtgtggactggaaggtgtggaattccaccaactctacggtggcaacatggttaatgacctcagtggctccatccattgcgaggatggtggagacaatttctaatgcatcaactgtgtggaagacattgagcaaaatgtactcaggggaagacaatgcaatgatgatggttgaggctcaagacaaggtggagaacttgaagcaagagggaagaactgttcaagaatatgctagtgagttgcaacaattatgggcagatttggatcactatgagagggggactgggaggaggattgggactggagtcaggcgcaatgggttgtggtacatcaataatgaagaagtaggattggctgcagttgcaggaaatgctgaggagattattttgcttcattgccggttaggacatccatcatttgataacgtaagtaagctatatccaattctctttaatggagtgaacaaaagtagacttgtctgtgacgcttgcgaatttggcaaacatacacggaccccatatgttgggagtggcctccgtagttatgaaccctttatattaatacattatgatgtttggggaccatggccagttactttagtgagtggatttaagtggtttgtttccttcattgattgttacactcgaatgacttggatttatgtacttaagcacaagaatgatgttcttcgatgcttccaagattttcataaattcaaatcagtttgatgcaaatgttcgaatcattcgaactgataatgggactgagtatatcaacaacgaatttgtctcttatgtcttggatcaagggatcatacatcaaaccacttgtcctggaacccctcctcaaaatggtgtagctgagaggaagaaccgacatttgttggaggtggcacgttcacttatgtttcagatgaatgtacccaaatacttgtggaagtgatgactgctgcatatcttattaatcgcatatcttgtggagatgacaaggaagaatgatggggaccaaattagggaatttgcacgggagcaagttgaagagtctgaacaacctgagcatccagtccaagaatcctccccgtgcctctctcctccaactcccttgcccctcattgaaacgtctggtgatgttccccctatacttgaacaagtagaattacctcttacacaacgtagggaaactagaagtaatgctgggaaacctcctatacgtcttggctttgaacatattagctctaagcatgacattgcaaattatatctcatactcccacatttcacctgcatacaaaactttcattgcatcattacaagcagtgcctgttccgaaagactggagatgtgccaagcaagatcctaggtggaaagatgcaatgaaggaggagcttcatgcccttcaggagaacaagacatgggaacttgtgagacttccaccaggaaaaagagcagtaagatgtaagtgagtatttacagtaaagcaaactcctgaagggaaggtggatagatacaaagcaagatcaattgcaaaaggttatagtcaaacttatgggattgactatgatgaaacatttgctcctgtggccaagatgggtatagtgagagctttggtgtcttctgcagttaactttggatggcctctacatcagctggatgtgaaaaatgctttcctttatggtgatctacaagaggtctatatggagattccccttggatttggaaataaccaaacggtaggaaaggtatgtaaactcaagagatcattatatggtttgaagcagtctcacgtgcatggtttgatagatttaggcgtgcactatgtgagatgggatattcccaatgcaatggagatcacacggttttttatacacataagggttcatgtattaccatcttggcagtgtatgctgatgatatagtgatcaccggtgatgatgggggaagaaattaggtgcttgaaggaaatgtttggaaagacctttgaggtgaaggatcttggacctcttcgatacttccttgggattgagattgctcggtcgtcaaagggaatcgttctctcccaagggaaatatatccttgatctattggcagaaacatgaatgcttggatgtcgttcaagtgctacaccaattgataaaaatcatcaactatgtgctcagacaggtgatccagttgacaaggaggcttgtaggacgcttgatatatctgtgccatacaagacctgatatctcttatgtagtgagtgtggtaaatagatatatgcatgatcctaggtctggtcttttggaggcagctcatagaatcctaagatacttgaagggatggcactatggtgctccattgtgataataaatcagttatcagcattgcaaacaatccggttcagcatgatcacataaagcatatcgaaattgataggttgttcatcaaagagaaaattgatagtggagtgcttagcctagagtatactaaatcttgtgaacaactagctgattgtctaacaaagggattaggcccaagtgaatgagttattttgtaacaagatgggcatgatcgatatcttttgcccatcttgagggggagtgttggtgtaatatgcaactttatcagggacctgcttgtaattctgttaaataaatatatgcatgtgtgggggtactggtcagtggtgaggccaatcattccccaattcccaaatcaatctacacatacctttgcaggagtctcttcttcatcagaactctcaccttcctttgcaggagtctctttttcatcagtactctcaccttcctttgcagtagtctcttcttcatcagaactcttaccttcataatcagcatcatcacttgaatcctatttgtcaatcatatcatacaaatgtatcgcaggattataatatatccaacacaattcatgactgctcatttttaataatgtcactgttacgtacctcattaccagtagattcaccaactactgaaatatcacggtatcgttcattgttgtcatcatcagcttttgatttctcatagtgctctatttcctttacaaaagccttttgcatggcggatgcaactgtagcagactttgcaggaagtttacttttctgtgcttctttgatcatattatctgaaagtttaacataaaaaaatatatcattcgaagattcgcttaccggctcacattagcatgtctagcagattctatcataaaatgtaacatggacgaagcacttcaaactacacaagcatactgatgtgaccatggttaccatagatacaaccatagttcacatcatagctcaactagaagacatcgccgtagaagttctaaaatccaattcggtcacctgcaacagtgctgatttcaaatggccgccaaatgtgcatacaagctccgtttttggcccatgagtacttgatggaaagctcttggagtcttatttccaactaatctagtctcatctccaaattccatctcggtcgaccgcaatcacagaaactaggtgttgcgtcatctataatggacgtataggcttgtaacttcatttagggcctcgacccaagtgggatgtgcccaacctggtggagcacgactctagagaccccatggtcgtcctcccacctctttaaataactaggtacctcttcagggtttttcaggttttgtttagattaaagtttagctttgctactttgccatataatctcgtgacttgttagatcgttacggaattctaacttgttatttgtattcaattcttatttgcaatttacattgctttttatctcgctcttgcttgtttcttcgatttgcttgcgggaacaaggttgatctacacccgtacgatatgggagaaacgtttacgacctgactacaaccgtacgagacgttgttgtgttacgccttaacgatcgatacaccttttcgtgggttgttgatcttgccggtatagattaaccttattcctgcaagcaaataaaaaaaaaacaagcaagaacaaaataaaaccaatctaaattacaaatagcaattgaatataaatgataatttgggattccgtaacgagcaaacagacgatctaacaaatcacgggattacacggcaaagtagaaaagctaaactttaatctaaacaaaacccgaaaaaacctgaaggggtacctagctatttaaggaggtgggaggatgaccatggggtccctaaagtcatgttccatcaagttggggcgcaccccacatgggccctacttggaccggggtcccagacgaagttataaacccataggcccattataggtgatgcaacacctagtttctgtgattgcgaccgactgagatggaatttggagatgagactagttccgttgggaagaagactcgaagagctttccatcgagtactcacgggctaaaaacggagctcgtatacacacattgggaatcagcactgttgtaggtgaccgaattggaatccagaacttctgcgacttgatcgcgatgtcttccagttgagctaatgtgaactatggttgtatctatggtagccatggtcacgccacatacactttatggaagttgaattagcgtagtattctataaaaaaggtaagcgttcttaaggcttataaagtaattattatgattagcaaagcatataccatctaacttggggtatagacgaatacctggtggaacctcctcatcagattcatcacctgaaacatcacatctcaagaattgtgattatcatgaagccaagtgtaggggaaacattagagatgaccaatttaccttcagaatcagtgaattttcccaaattctttacttgatagccacaaaaggcaactttgctgattagtgaggtgtggaatagttgaaagttcttcttgaaacagaagtcaaccttgatatgcggatgccttttggaggaaagcgtcccaatcgcaaacttctcatcattaacttcgacaaatactttcacattggagtcttttagcccgtaagcctcatcaagggctacctgcgatttaagttataacagtaagatgagacatcactataaataatgagacctggtaagaaaattgataatatgagagataacaagtactccctctgtctccatcctagaatatagcaacctagaacccaacttattacaatcctaggttgctatattctgagatggagggagtagaacataccgatgttagatgatacagggtatcctcaggacaaaagatctccttcttattgcacggctcaattaccactcctaataaacaataacattaatcacaaagttgtttttttttaatcttaatgagacagttgttatttaaatacactaaattggaaagaggaaacaaaccccaaaaatcgacgtccattgctgcttttgttattttcttcccgagcttttagagatttggcctgttaaatcaaatcaacaaatggattaaatcagcatataattatcttctagattgacatgactaacatttaggtcaacaatagatgcactacaaagatctccaatgcatgcataattattgttagttatgaatgcgccaacatcagattaagaccatcccagaaagaatttcacttgggaaacccaactttataatgcatgtaaaatcctagattttacaggaactcaaatatatgtactgaataaggctaaccaatcagacaaataattagttcacctagaatttcaaggtgctaaaagcatgctagatcaaaagggactaaaagaaaaaaaaaattacaagaaaatacatttgactctcaaagtcttcatttgccaaagaaagcaaatgtaaagggcggcggggaaacactattaacattatggtctagggcttatgagccggagagagataagagatgaagcgtctacctaccacccaccccgctcagcgatcaactgctataacggtcactggctagataaagcccctattgaatcgtccttgtcccgggcggacgttgtacaggccccgccggtcagcgcctgccctcctaccctatcgtaggtggatattgaagccggtttggcatctggtgcaacacaaggtgtaaagaagggttcgctgccatctggccaacaaccgcatttactcgttctgtgtagccagctcgccctatcctgcgttggctccaggtgaggtgcttccggtgtctagggataggccatcttaaggtagattgcaaggggaacatcggatgttatcgttgctggtaccttggccatgttgagcatttctgcaagtttaacaaagaagagcacaagcgctcccctgtagctgacggctcccatccttgccacgctgcggtggcgatgtcctttgcgctcattatggctaccactctctctcgtgcacgcggaagaggggggctgctacgacggctgttgtacccactcataagatggattgcgacgatgatataggtgttggcgatccttccatgtacccaccctatggcttttgtgtcctctcttggacccaagggatggtggagatcgagcagcgtctgtgcaagcaggctttggaggcatccgtcttgatggggcgctgagagatctccttggccatggtggtgttgatgaaaaatccgcgtccagccgatgataatgaatctgtgttgacgcgaaccgtgtcgacaaacatacgatggcttgggagatttgcttagctccagtgtaggtcctaaaattgatgagatgcgggcatgccattcagtttgatcctgcaactgacaagaacagcatatcaaaaagccgatcggctgacgagccgatatagtgatactagccgatgttgataccagtcgatgctgatggggttttgagcaatcggctatatgtccaatgtagagtctgactcttgaatgaataatgatataaagataatcaactgatgataatgtaataaaataatatataattcaatagaaaccaattagtcaataatgatatgatagaataattgcttgatccgaaggttaaattaaatccataagattcgataatcaatgaaacctttgttgcaatcggctaaaaccaacttgtatgtaatccttgtaagccaatgcaatgtccagataactcatcgactgaaatcgcaatgaaacccttattggcaatcaaaggcagcttagtttttatgattctaagcacgacttagtaggtcaaatccaattgatgcagttctaaatatgaaaagaaacataaagtctaaacaatcaagtcttagactaattttcaaggtggtggataccttagctaatctaaattgataaaacaatttagctgataccaacaaaaccctagaaaagatctgtcctataaaggtaaattgagacatcgacttagattaactaagatatatgataaataggtgtttacgccgacacaattagtgtcgaggccctagccccgccaatacaaacaaccataattagtcttaccccttgtcggagattgaagccgatgcaacccaacttgaaacaagaactcatcgagaaagacgaaaataaaaagggtggcgatgcgccaaagttctattgattgagagatagattacaaaaaccccaagtgtacatatttatacccatgggtagatactagtccatatcgaacacgtcatatattttctaaagataaaaggaaagataaaagtcttgatcggacactaaataaacatttcctaaagataaaaggaaattactacatcctacctaattaatactccctccgtttcaggttataagatgttttgactttggtcaaagtcaaattgcttcaagtttgaccaagtttatagaaaaaaatagttatattttcaacccaagataaattcattataaaaatatatttaattattaatttaataaaactaatttggtaatgtaaatattactttatttgtctataaacttagtcaaacttgaagcagcttgactttgaccaaagtcaaaacatcttataacctgaaacggagggagtagatagaattaagtcaccatgccgtagtcttcacgattccttcttaaactcggtcttttctggataagtttctgtcgactgactgctctttctttaaccgaatccactaaagaatcttaccaaattttgccgttaacaggtgattgacgcgttgggccgttcctgtggcatcctgtgggctaacgttagagttggtgatgaggccctctaactttacggggactgcacaatggtgcggcacacaatccagccacttccaggtagacaatacctggttgtcttttgccggtggcaccactctaccaacacaaggagtaccaggatgccatacgtcatcaggctagcaattgagggcctacctgctcatacctgtgagccagaggccctcaagcacatcctcaacaagctcaaccgctagcttatcgagcactttgagccactctaccaacacaaggaataccaggatgccatacgtcatcaggctagcaattgagggcctacctgctcatacctgtgagccagaggccctcaagcacatcctcaacaagctcaaccgctagcttatcgagcactttgagccagcggatgcatgcacgttcaaggtgcttgcctgggcagtaaatcattctctgatccctaaggagccgcctctggacatctcagaactgatggtggaatggtggttgtccagaactgatggtggaatggtgggaaccaccagaggacgaccaccttgacatgttaggcgctatcagtgtaaacaccgccacgcccactccttaaagccgtgcttgacattcggcctcctcatcttggagacggtcgacccggtgcccccacctcctgacaccctgcttgcacacgtacaacacctcccttggctagattgacggcaccaaccctaggccggtgctaggcaggacatgacgagggaggggggaggcgtatcgtttcgcatgacatggcaccgggatgacgtggcgcctttttcttccaaggagttatcatgtccggcattcgcctcggcgtgcttcaccactaaaaaaaattatgctttcaagatcttcctcaggatctccatggcaatgctgcatttatggagccagtgaattcctagccagtaacctcagctgcttccccgcctgagacaaccactgctttgctcttttttacagccaagtaggagacgagaagttccaaaccatcaggaggcgacaacatgcttgggccaagcaagcgcttctccagcctaattacgaccttctctaggcgcgcagccccgcacgacgcgagggccaggagggtggttgatctggatcgatcggcgggccaggctaatgggctggttgagcatctcaacctaagccaacctaaggtgacagaggttgcaaggtggcccagaacgacatgtcgtcgagggctccaagtgataaagctagggctacccactctgcagcaatcctcgtcaccgtttctgcccaaccgccatcagctacaaaggcggcgtgttcttcacaaggcagcaccccattggttgtttaagcaatggcggacgtcatgcagtctccagcattcttggtagtcagccccgcgcgttggtttagaacaagctagcggtcttgttcacaccacaccacaatgggcgtatagaagtgaagaacggcgacaagcaagtgcacacgacgaccaaggcgcaatgatccataatgaagagtttgggcatcatggcggatgagaacaaggtggatgaacatgatatcctttgatacctagggctattcaagagtcctctcgctccgtcgcatgtttaggcccttgctaccttgtgtgatttgcaggcgcatgctgctatagaagctcggtaagcatctattaagtttgtgcccgtcatggacttctatttcttatgtcatcgtgttgtatgttggtgtggaatgtaagggggctcaatcaggtaaggaagaggtccctagtcgctgaagtggttcaaaatgcccatgtgtccattatcaattatcagaatccaaattagttgttgttggtaaggtgtttatcgccaagtcctgtagtcctgtagtatcggttttgatgtgttcgatttcctgccgactgatggtgcgatggaagggggagggtgtctcttcacagcctagcgaagcaatcgattcgttgtctcgtgtcagaaaaggaacttggtcactgagcttgtgttctaccaatttttaagggcggaagggggggagtagggatggcaatggatcgagtcgggcacgggtagagcaaaaccatgcctgacccgacacccaactttgcccacccgaactctacccaatagggttagcgggcaaaactctatgcccatacctatgcccgacgggcacaggtatgcccggtggatacccagtgggcacgccttccgcctgccgttgctgccgcctgccgtcgctggctcaccattgtcgtcaatgtcgtcgccctgagccaccattgtatgcatcacgctaagacgccatcgccgccatcgtggccctgagccgccgccacaacggtgagaagggagcggagcggtagcagcagtgcaatggaagaggcaaggagcggtggcggcgtgcgctctctcaccagatctagcaacagcaaacaccagatgcagtcaggtgagcgacggcagcggcagcagtgaactcattgccgcctgcatgagttgccgccgccgcttgttgcgccgccgccggactagggagagaggtagacgggagaggtgggggtggggaattaggttagagtttagtgagtgagtatatgtgtctctgttaatgggccaaatggactaagaagaaggggatgagaattaagagatgggcaaaaaatagctaatatatatatatatatatatatatatatatatatatatatatatatattatgtacatgtatctggtcgggcataggttactcacgggtaaaattcaaaacccggctattgcccactatatcttcaagcatcgggtgggcatgcccataggtaaaatgttacacccatgcccgtgcccatcgagtcgggtatccgcggttacccggacccatgggcaaaatagccatccctaagggggagggggaagggggaggatgtatgggccacggttggtgcaaaggcaaattgtcattcctggaaaaggtactatcggtcgggcaagagtttgtgcaaggggcctggtgtattgtcgggaacttcaaccttttggcagcggaatctgataaaaacaatggcaatgttagtagaaggctgataggcaagttcagggatgtcatgaatgctttggagcttagggagctgtacctttttggtcggcgctatacatggagcagcgagcgagaacgactgactctttccaagatcgataaggtggtagtgaatgctgattgggaggaatcgaggaagtatacaaggatgcacacctgcaagccctcaactcctaagccccggatcactgctcgcttctattgacttgtgatcagccgatgcaccagcaccgaaagttcaaattcgaggccttctggacccggatggagtgcttcgatgaggttgtgcagcaagcatggaattcagctcgaccaagttccaacttccaacgcgattagtgccttccatttcaagcttcggtcagcggcgtcgatgctaagaacctggggatcaaacagaattagtgcccgcatgatgcaattggcagcggcgcactagatcatcatccagctaaacaaggcgcaggacatcccgtagcgcctcctccgcacgtcgcttaaaggccgttgtctagcacttgcgtcgctggattgaatcaggctgagtcaacgggcttggctatgtttcctcaagcatagtagcaccagcactcaattcttctaacccaagatcaatgcacgacaacacaagaaagcaattccaatattatgtcacgtcggcgaatgggtgacaacagaaagcaacaagctgagattggttcacgacttcttccttgacatcatggggcgccttcctctccttcatcaagcattgatctagacggcattgacttgcctcactttgacctatcaaagctagatattgagttcgctgaagatgtgaagaaggcggtcttggaaatgccaacggactgagcatcagggccagatgggttcaccaatgaattttataagaggtgttcggagttgatcaaaggagacctgctcacaattctagcccttgtgttgcaagtgaattcctagcacttacatctattgattgcactcttccccaagaaagaagactcgatacaactctcgaattacaacccaatgagccttatccatagttttgcgaagattttttctaaaatcatggctaccagattggctgcacaaatgggtgagctagttggaccagcgtaatcggctttcatcaagaagaggcacatccaggagaacttcatttatgttcaagggcgatcgggctgctacattggtcgaaagtgaccaaccatcctgctcaagctcaatatcaccaaggcatttgatagtcacttgggttttgggggaaaaaatgcagggatggcattgccatcatgctgggaagggcgtcaacaataatctccatcaacagctacaacgcaaaaaggcatcgggctcacaatggggattgcagtagggagatccatattgtttcccctgcttttcgtcctcgtgatggaggcgtttggggcactctgctccacgccggtgcaacgaggggtgctttctccactagttgacgacgtgatgcccttgcaagtgtccttgtatgcaaatgacaccatccttttcttccacccctcgactcaagatgttgtggtagttcatcctgcagctaatgggtcgtgtctctggtttggtaactaatctagccaagagctccatgactattatccactgctcagacgaccaaatagtcgaggtcgcaacgatcctcagctgccaggtgaaggatttgcctctaacctaccttggtttgttgttctccgtgcgcaaaccaaccaaagcacaagttcaaccaatgatagaccgactaacgaagcacacggcaaagagtgaaaaaaatgttgcggtttcttgtggaagggcgacggaaaagcatcgggggaacacaacttggtggtctgggacaaactctgtttgccggtggaatatgggggattagggatccgaaacctgtagcttgcgggggtcgcattgcgggcacgttggcccggctacgcaaagcgcagccagaacgaccatggacatcactctctcgatataaaagaaagtagcacggtgattgtggggaacggcaaggggacattcttctggactgataactggttacctaaagagggctcgattgttaattgtgctctaatcctcgcctccttcgttaagaagcgatctcgtagggtggcaacagctctacatgataatgcctgagtggctgacatcacaggggctctatctcctcaaggtctggcgaagtacttcatggtatcagaaatggtgtcaagggtgcagcttgctgatgacatcgacgataaggtctattgggctccaacggtggatggcttgttctcaatccgctccacctacgcctcctatgcgccgccaagacgaaatgtcgcctcggaaagataatatggaagtccatggccctgtcttgatgcaaattcttcatgttcatagcaatgcaaggggcctgcctcatgacggacaatcttcagcggcgtgagtggcagcttgccttcatctaccacctctacaacatggtagacgaaacttgtgcttcgatgctatatttccgaattacaacaaatgctatattcggaaacttgtgcttcaatgcccttcaccagaccctgacttcccgtcctggtggtgcgaggcatgcaagagtgttgccaagaaggaagagaagtgtttgacgctgttatgattctgattacatgcagggcagacctaccactatagcatgttgtggtgcatgccatagctaaccttcgtagagagcaccctcaccctcagcttcccagggatggctactaccacaaggaatgctcgaatggtctcctagagtagcattagaagctttggactcgtgaggaagatgacttggtgtgttaatggatagagatgggggtgtgagagggaatggttgtacgtgttaatgtgctaggttagctggcccatagcctactcattttcctcaatccccaattccccatcaccgattcgtcgtgctagggctgatggagtggtgggcattggctgctagctgcttgattaattagagcttggcgtgtttgaggttgccggcggattggtggctcaggtaggcgtcaaatggcgcgcggcggagcaaatcataggtggcgcatgtgacgatggacgactggtcattacctcagctttgatctatagcaggaagaggagcacctagctgactagctcgtcaagccgtgtaggtgggcctgattgtagcaatggcagccgacaaggacaacaaggaggcggctgctcgagacacggcaacagcgaagctggtcgccgtgcgtctgcgattgttcccaggcaatagggaaagcaagtaagcaacagtgacaatggccaagacaaccaaaactagtgcttagtgagtcttttaacttcattttcttttagaaagcatcaactactaagtataatccacctagctactttgtttatttggctggttcttcattattgtttcatcttgtttagaggactaaaacaagagtctcaaactgtgatatacagtacattagcttggtattttcttgtatgtactgagtttatattttccgtgtttgcattttcacagtagatgttgattcgaaatcactcggttagtatgtatctgcttatttcataaatacaatatgggcatttaaatgtttttcctgtggttggattgaaatgctcttagacgattcattcgtctccgccataactatgattttttccagggtccgccattggttacatggctggtgcggaaggaacgaaagtacgaaacacacggattttcaatggaaaggcgctgtcagtacaggccgggcgctctgtgcggctatatatggaggacaaatggaagacatggcaggaagctggtctgctaaacgcccagaatgacgacggaagcgcaatggggtggcgattggcgaaagtaacgctgtgtcgctgcgtatctggcttgagttgtatatatgtgctgggctggtgatgtgctctgtggcgccagctcgagtctctcggcggctctcgtgctgtagttcttcgagtcctgtaaatttgtggaacgttttttcccccaccttaataaacttcggccgcattctcgctggcccggcgaaataaattaaaattaagggcagcgggcagcctgattgccttcttctagtaccaaatatcaaactcatagtacatctaaataacaaaattagatacaactagctggtactcaaagcacattatgcaatcccacaaacaagaaccaacgagctttagtaagaaccaccaaataccatcagcataagtactagtttactacgtgagagaaatatcacgaaatttgcaagtaatgaatggtgcaggatttcctagtgctccttgaagctagattttcgtcctaaagttggcaagatttgtgttattgcaagttgctagagctgcaaaagctgaagaaaaataatctctatccccaaaggtgtatctcgagccagagacttactggaggcagcgccacggagggaggtcaagcggtgggcggcggcgagatccggcccggcctcgccgctcgccggcgcccgctgtggtgaaggggtgaggagagaagaaaaaaaaaatggtgaagtgaggaagaagaaaggggagaggaggaagaaaaaggaaaaatgacgaacacgatgaagatatttgcctcccagttgacagctgtttgccaattttgcaatcttatccttcgacttcttcaaactgccacataagggtcttctcttttttggctttttatttctggatccttagaaactttcttatttggcggttgagtccttagcatcaccgcagcgtcctactctctttcccgtgctcgcggagaaatttaacaatatgccactctataggtgtgactttaacatgatgccacctcataggatgaccttataaaaacgccacttcgtagatgtggcttcttaatgaaatgccactttaggatgattagaggcttttaatcatactttgggtgattagcacactttttaaccgaaccatcgccttctaaccacctcgccgctgaccacgacgacctcctccgctttcatcgccgctgtcgccgagcccctctgcctcgcctcccgccgcctcgccgccgtgctccacccgctgctcttcctcctcctcctcgccgccgccgtgctccacccgctgctcttcctcctcctcctcgccgccgccgccgccgtgatggggacgcattgctatcgccggtgggcggagagggagagaaggggctcacaggtttacgccttcgccccttctcacccttccacacggttgtcgcccacctcgccgctgaccacgacgacctcctcctgcttcccccctccatcccctatctcctcttcaacctccccgaccccgcttccgtcgccgccgtcaccgagaccctctgcctcgcctcccgccgcctcgtcttccttctgcctcgcctctcgccgcctcgccgctatgctccgcctgctgctcctcctccttctcgccgccgcttgccagtttacgcccttccgctcagtcgtcacccatccgcgcgcccgccggcgtcggctcccaggtggagggatgcggcggcgggccacatctcgcttgccggctccgcgcagcccggcgccgaggcgggcgtgggagtattcggcgaacgcgagggcaacggcggcagcacaagcgaagaagggaggaaggagtggtgggaagggccgagagacgtggagcaggcggccggcgaccaccacgtcagctccggcaacaggcggcaaggagccgcctcgtcacctcgtgctctccacggcaaggcagtgcagggacaggaaggaggacccgtcgcgcgttggccgaggtggggaccatgtggaagatgggcagacggcctcgaccccggcgagcgcgcaggcgagggagacagggtcggaaaggtcgacggcgaggtggtgggtgagtgggaacgtgaagaagtagacggcgtgggcggggccggtgccgagcgccatcgcggggaggcctcggtacaacgccctgacgccgccctcgccgtcgagctaggcccgtcgtcatcgcgtccaactaccacctcgttccagagcaccgcctccccgcggcgctcgaggacaccgaggtggctctcctttggctcgcgtcgcaggcgcctcggcggccaaggaaggtggaacggccgagagaatcctgttaaaacctctaatcaccccaaagtgtgattaaaagcctcaaatcacctcaaagtggtatttcattaagaagccacctctataaagtggtatttttataaggacatcctatggggtggcatcctgttaaagctacacctatagagtggcatattgttaaatttatagtgctcgcgttatctgtacggctgtaccgttcgtttgttgtgtattgcgggaacacgatttgcaccgaaagtttggaaatttgcctcttcaataaaaacttttttcataaaaagaattgtattgataaaaaaaagaagtgtaacctcgcaaccagccctaatggcgctgagatccaacaggttaacattgtgctaagtcttcactaataagaaaacattgtgctaagtccataccaccgccgtggctacctcgtctcgttatcgggtcaacgtagcaaatgggtgtacgccataccacttggcgttgaaccaccgacctcaacacaagggctactatagatttaacttacattcaggagatgcttgaaaaagttaaaacaatcctatcacatacttcctcctttccaaaataactcaatttagtatgggatgcgactcatcatttattcttcagattcgttgtcctaggatgggtcacatcccatcctatgttgagttattttgggatggatggagtataaaatcacaatgtcattgtagcatatggttaccgatgcttgttagttttaatttaagtgaattgtaatttgggccacattttattgctaaagttatattttgcactacctttaaactaaccttattatttttggattggataactgtgttttttttagtttggaccacccaaaaaaacttaattaaacacagatgaacttctacatccctatacaggctgtattttcaccataaatagatggtagacatagaattgggtggttcaaagaaaaactttatttaacaataaagagtggtttaaactacaatttactcatttattttttaggcatggatttgaccaacagtgttatttaaatatcaaatcacgtattatcttattgtaccttttcatttgtgtcctttttacactgctaatagagtaacgggaaaagccagaaggcttagggcttgtttggtttgaagccaacttttactttactacaatcttggtagtgtcataagcttggtaagttttggcactaacaaattgagtagtattaagattaaactttatggtaaaaatttgggtagcaaaccaaatatgtatttactactattgaagttacaagaatttagtagcacaataaccaaacaaagcccttaattactttcggtcaaaactaacaaatattaacctctctaaaatcgaatttggtaggatttgtgaagatttaatgcgccacgtcagtccaccttttgcaaaagaaccccgctcgttcagttaattccgcaccaggtccccgctacggctctacgtccaccgtccgatctcgcggtaggttcgatcttaccgtccatgtgtctcactgtgacggcctttccacaccgctcccccaccaccacgcgcgccgcctcgccccacctcgcgccgtcgccgccgccgccgcagctccctcctgctccactccctcgccctactccagctgctgcctgtccctcccaccgagcagccggatctcccagtgagtaggcccgggccgccagatccggtgaccccggtctcctcgccggtgtatccggcgccgcagggagggacgagagccgccggcgctgccgccctttctcctctctcatccctgccacgccactgcctccctcgccctagacctctacgcctcgatcagtgcggtgtaatatggctcggggaccgtctgactcatcgaccttgacagaaggtgagaagggaggggagagcgccgactcggccacgaccgcgacgaagacagccgcggctcggcgtcggcaacgacggctacctggtcgttcctgctctcctttttcctttttggttctagctcagtgccatgagaaggaagtggctggaccttagttcttgatgacgattacaaccttgatttgcttataatgtgtgtaaggcatgatttagttacagtgtgtaggttgtgcagagaaatttccctcggcatgtacttcaacactgtcatgtgtgatcaaactgtttagtttgaaacaatgcacactgctactcacatttctctatgctgcgattatttatttcagttaggaattgcatatacaactttggagggcaaaacgataatgttgataggtttatttgttaccatttgtgctgcagggcgtattttcatattcagacagttttggaagctgcaagtacacatggcttgcctcttgaatgtacatcaaaggagttttttatatgctgctgtactgtgttcctttcactgatgtgtgctatatgctccaagcgcataaattacaggtatgttccacaccaatttccatgtggtttatggttgtccatctactatatttcctgaaatttccatgcttacatatttatattagctacttagctccaaagaagtctgtaccactatttgccattatctctgttcagttatttcattttgtaatcttatcttctcgattggcaatgatgtgttgtttgcatctgcttgaagcagatatactgcatgcatgcttcagcttcacatcaatgttgatgtagtatgttattgctcatctaatatttggtagcattcttcattcattaatatttcatttatctcagtgaagactttcattctgtccaccattattgctgctcagtttttttctttccaactatataaacagtgttctaaaaatcgccattaggcggcacctcggcgccgtgattagcccctcggtggcgagttcggcggctgccctgccgcgacggtcaacatcggtccacctcggcgcctaggcggcctaggcacggtggcgactagtcgacgaggcggccgactgagctagctatgcgggctgctgtggcgggtatataaggtgggtgcatcctggctgcttgacttaatcccaaaatcagagtgcgtgaaggggcggctagggtttggagctgccttaggacggtgcgcaggcgcaggcgcaggcgcagccgccatagtagtttgatccgccggcagctcagctgctctgcttctctccgcgaccaagcgactagcctaccatcctctgttctttttcacacggtcgtgcttgcgcagttgtgcctcgactcgtcgatgactctgctcaggtgctcaggtgctctgctctgcccccatccttcctgccaaccaccgtgttctgctccaagctgccgacaccagcaccaccatggtgaacactggcgaatcgagcaagtaagccattctctttgctttgctgctctctaccctctactcctctgagctcgtctcaaatctcaatattctagtattactatgtgctatgctctgttactctactctttacttctttagtatttacttgatctaaatgttcttgtacaaattgctcttgtttttgttgtgggtgtggctggtggtggtggattggtgttgattgcttgcattacaatgctttcttgctgccttgctggaatgcttgtgcttgcttgcttcgtgctggacatgctatttgtggtggtggattggctggtggttttgggtggatgcttgttgctgctgtgtatgtttgggaagaagggagggggggggggtcatttgactatgtaagtatttagtgatctgtcatctgtggcatgaaatcaagatatgcatcgtacaacctcagaaagtgtctcaatcagtcaattgtgtgatgaaattgatataatctcagatttagatgttcaataatttactaattttggtcctcctgtatatgcaaattgtctcatcaaccaccagtgttactggggtaacagaagtaccctatcctcattagaggaactccaatgacatgggatgggaatgaggcaaaacattcaatgaatcaaacaaagatagggtccaatgcttattatgtggtcacaaaatgcaggatcaaagaacatattggccacattataccatgcaaagtctattcacatcacaagacattggccttgatgaggaagcacacgaagaagagagataccataaggccgggtgtgactagatttgctttagcatttctaaccttgcaaagcttgattgagaagaagcgtgagctaagggcaatggcgcttagtgtggagtgggattgtgggaacaatgcacccgcactaaaaaaagcaaaaggcaagatagctacctctacactaatgagtaggaccttttggaatgatgtttctcagtgtttgaaggtaatacaagcatcctaaccttataccatgtgctgtcctgcatgttgatcaatcaatatttgcataattgacatgtgctatttcatctcttgcaggtttttgagccattagtcaaagtacttcacatggttaatagtgatggtctatcctgaccttcatctgtggacaaattctagaggcaaagaaggaaatcatggtagctgcaaaaaacttggagaacacctacaatcccatctttgaacatattgctaaaaagatggagggtaggcttgatgctccactgcatttgacagcatatatattgattccttattacacttaccatgatcaatctatctttttggatccttctatcatggatggtttctttgattgtattgaaaccttttatgtggtgatgatgatcttcaagctcaagtgatcaatgaacttcccaagtttaaggactagctaggggcatttgggaaacctgctgcggaactggatgtcaaaaatcgcatttctcctggtaattttctgctgcaactacaatctgcattatatttgttccatgttgcattgctgtgtcattaactcgttatttcactatttgttaaatgataaatcatacttcttatagctgactggtgggcagcatatggatgccatgttcctaatttgcaaaagatggccataaggatcctctccttgacatatagttcctctggttgtgaaaggaattggagtatttttgatatggtaacttgtcaaccttacatgcagatgcagttagcactttgtttagttgctactttcaattaagtatttacttcgtcacttctgaatcataggttcatacaaagaagagaaataggcttggggctggtcgcctaaacaacttagtctatgttcaattcaatgcaaggttgctgaaaagggctgagaaacgcaatggaaaaataacaaagatgtgctcctagctacagatgcattccatgcgcaagggtggatcactgatggtggagatgaggaagatattgatcccatttcaggacttccattcagtctcatctatgaagcaagtggggctactaaagccatgcaacctcgtaggagtgctagagtgagggagcttcatgaagatgatttcaattctggagaagaagatgaggccaatgaagagggtattgactttgagtctgacaaggatgagatcgttccaactaaagtttatgaccaggaggatgaagattgactcaatccttgatgattgatgtaatgatatcaattttgcttgcttaatggctacctctgtttcctctactatgcttattttgtccaagacttgtgagagttgagaaactgagaactctggtttagtttcattgtgctgatatggtgtattagaactgctatttggcttttccgctttggcatatgtaggttaattattctgaattttggataatctgcttcaaccttcaatgtttcattgcttcttgcaccttattcttgttgaggtgataccgtatttaaccatttgtactactgtcctgagtcctgtggaaacagtggtgattcaaccaaggaaccaaagctataaaggtacattttctcttaccaacttatttttgtattgcactattgccaacttaaaagttgacaattttaattatactagcttaactgactatatgattatttttccattgcattgctggcatgctgcttgttgatgatgagcttcttcactgagctgaaggcctaagccctggaattggaggtgcaagttgctatgttcagcctttggcatgttggcaccatcaaacaaaaggtaatataaaatattcaaatcctaaacacatgtattttctccaagttggctgttggcatgctgcaatttgctatgttatataaatgaaattgataaattggcttagccattggatacaagttgcctgctgactcctccctccctagtcagacctaggcgccacctagttggccctaggcgctaggcaccaccctcccgcccaactagcgtctagcgtcttcttgaacactgtagataaatgcctagatggggaaaggacattctctgtacaaaagagaatgttcattttttttaagtagcacagcatcatttttttttttagattttatagaatgtcttagcaaattttagagaggttatgagtcaacctttgatgccatatttctgtacaaaaaaagatgagcaccaaaagaataacatgttgtttaaagaaaatgtaattgttgccagtctccagattatgactatacacacttttaggatatgtctcggacccgatcattttcattaaaaggaagatgactccaattttgagtcttgaaaacattcggtctctagaataaccttgatttattcatgcttcatgacatacctctatattccttttttattaggtcgcaacagaaaatggatggattggatccatcatggagagatgatttcctgttcatcttttaaacggacacaaatttcatttaaaggtacatttcaatttagtttgcgcatcaacttgttcaatggcaatgttttcctaaacatatcctaactgtatattgctcacgatgcaaaggtaaagcaatatcatgagtcaaatctttttatattttatctttgaattggtttgctttaatatatacatctctgtgctcagagatagattatttcattgtttagtttatcaatcttttttatacatgttttatttcattatttgtgaagccatgcttttgaatcctaaaatttgtgtaaccgatctgtttcgcaaggttgctgtggttcgtcaaactaagtgtaatctgctgccgctgtgctctacaaagctcattgtttcaacgttgtgtatttgacggctactgacaaaaggaccagggcagaaaaaaaatggagcctacatgaagaaatatgcaatatagtagtataactataagacttctgttattgcatccatgtttttgttaactgatcatgcaatctttagctcataacttgtggtagaaaaattgatttcatgtgtttaagagtgtgatgcgaggctgaaaacactctgtataaatggttgatactatatttttttagctgtactgacgttcctattcaaactttctactaccactgtccattctggttctgtatcacatgtatgcttagttacactacattttgggaccgatgtagtatacttttttaggtataccgactgatagcagtaactgcacatcacggaggattgttattgagtactccctctgtcccataatatagcaacctagtatttggattggatattttatagtatatcgaatctagacagaagagtgtctagattcattgtaatatgaaatgtcctatctggtattaagttgctatattataggacggaggaagtagctcattgtcaagaattatatatatatatccgtgttcgtctctctcgtcgaatcagcctagtcataccagtagacatgtaccatattatgtaccatatttatctgttgtgcacgatattgagtgccaacccttgcatccaatcatattaatatgtttatatatgtagttaatattattattttttggacggtgtaaaaataatgctagattccgtgctgacctgcataagagccgatctacccctaccgcacactaatcacttgtcaatttgtcattcctaactaatatcgactcgtgttctctttagcaatcgatcactcatacgaattacgtgcaaataaaatcttatatactcccttaattctaaaaaaaaggtcaacctaaaatttagattaaattatggatgggatataattagtacaacgaatcttgatagaacggagggagtagaaaatagcaactggagtagtacaattaattaagttatacacatcaagaacgccgtgatcttttgatccatcacgtcgaagctggaagcctcgggaggcagaaggaagcagcggccccagcggccgagcgtggccgtccgaagccctccgtctttgccgtacttgaggcggaacatccgcacgtacatgagccgactcgccgtcgccgccggctgctccacgcactcgagcagacagaagttgctgtcgctgcccatgtagtggagagcgacccctcggtgccgctccttgtccttgcagaagaggacgtccttgccgatcttgcacgacgggacccgccacctgctgtcccggcctctgatgcgcggggccgggacgtcggacgagcagaggcggccgggcttgtccgggtggcggcagatgccaacccaggcgtccagctcggcgtcgtagtgtccctgaccctggaacggcagcatccagcagccgtagtcggtccactccaagctctccgtgtcgaagcagaaggtggagcccgcgtgcagccacggccagccacggctcaacgtggggaagaagggcacgtccttcctcgccacggacacgaagaaggcgcggccgttggggtgcgccgcgtagaacgtgatcctcgacgggtcgaacggcggcgccgccgccgaagcgacgctgctccacgaccaccacccgtcgccgccgctcgggaagagcacctggaagctgacggcgcggccgctgtcgccgccgccgtccagggcgtacagcctgtcgccgacggggacgaagacggtcgagcaagacggcagcgtgctgtcaccctcacccggcggccaagctgggccgcggagactgcctgtgcccgggcatcgtaggccgggatggcggcgcgggtgggcgacgggtgtgtggcgatgatcttggtgccgagggccttgaagagcatcgcctgatgacgcggcgccttcacgcggagacaccggcgggaaggcagatactccgtcatcctctctaacgcgctgtcgtcgccggagtcgtcggcttcgaagtagtactcgtccatatcgattctgcggaagccgtagccgtgcttggagtcatccagcaccaagtacaggcgccgtttcccgccgccgccgccgccgccgtcgccgtgtgatgacatgctgcgctctgaacccgtcttctgttctacccacgtgtcacggtgattaatcgggttccctcctctgctttcgtaattcgtatcgcgctgatcccgtgctatatcgtgacaggttatataggagtagacacgtagctaggctgcagtgcagggtccgagtcggaaccgtacttattagttctaccgaccttaactcctagggagacgccatgccagctttgctactccatttggaccaactccaaaatacagcccataacttgtgcgcacaagtccttttgttccacggcccaccgtgccggcacgaccccatctcggcctgtcaccccttctaaaaatctctcccgtttgcaaatactgctacttaacatcagccgttgccagaattaaaatattaaaaacttttatcgaaatttattttttaccatacaattaaatcgctaaaaacatatatatataaaattcttgacaatgagctactcaataccaatcctccgttatgtgcagttagtgctatcagtcggtatacctaaaaaagtactacatcggtcccaaaaatgtagtgtaaagcatacatgtgatacagaactagaatggacagtggtagtagaaagtttgaatagtaacgtcagtacagctaaaaaaatatagtatcaaccatttatacagagtgttttcagcctcgcatcacactcctaaacacgtgaaaccatttatacgcacgagtcactgcgtgcggcagagatttttgggggtagggatgaaaacggatattccgatcggatatgatacctttcagattggatatttctcggatagttcggatgtggatacaaatacggatattttctcccagatacaaattaatacggatatggtacctgggtttccatcagatacggataatcagtggcggacgcaggattaaaataaagatggggggcgaagatgctattctcaataagaacaactaaacgcaaaaaataccatatttatgttgtaattatatgttatataaacatatagtataatcaataaattaaggcaaacaaaaaacaaaaatgatattaaaataaagtaataatttttgcgccatattcatcatacataaaaagatactagtaaacatatcaatttgtaaatatgagtcaattcagaaagcatagttgatagatatcttttaaaaaataaatatatgaaaagatatcgcatacccagaataagataattattattttgcttagaagggagagagagagaaaaacattaggcacctaactatagtaggggacgggggtgagtagtgtcgaggaattgactcaggaaagcatcacatacgcaggattaaaattggacagttgggctgcttatttatgggctaattgcaaattggatgtggtggtaggcagcccaag

SEQ ID NO: 64905 - DNA, 5016 bp, Oryza sativa
  unsure (1)..(5016): unsure at all n locations
tcctgcagcccgacaaatgattttttactggtagatgtctatctaccatatatgaatgcatgcaaacaaacagagatgtatggcatatcctctgctccaccagcaaaattccatgtcaaaattaaagatatgtgaggaagacaaaaaaaaatctggaggagcgaagaatggagcaacaccatctcgaacttcaggagggtgaatctgtggaggccacagcacggtcagcaaagacgatggtgccggtgcttcctcgtaaatccataaagtcatttatagcacacaagaaaaaatgttagtaaaattttggaaaccgatatgctaaatcagtggcggacccaggatttataccctgggtgtgcccacaaatacaagccctacacattggtctagagcatatacacaaaaatataggcaaaccgagcattttatacaccaaaatgtagagccctgtacatggcctagacaaagcataatctgaattttctgatgccttgctaaaagaagacaatgcccttgttcctcttcgtattaactgatttcagaattttcaatttttcaaccaatctctagctctcctttaaaagaaaattcagggagacaaagaaactaaaaatagtgagagactaaaagtcccaaagagtatatctgtatctgaagttttagatagatgatgcgaagctggacctgcttgcttgccttggtcaatgtggttgctgctagctgcattccttgcgttgctcacagactcaccgggctcgcatcgacattgcttcgccatgtctctaaatgctagtggctgcggctctcgtctccaccgtcgacgctccacactcgccgtccagccaatatcggtgctctggcctgttgactgtcgtgctcttcggtgtcaccgccgccgctcgctgaatgtggaacaacgcctgatgccctgaccctagctacctttcacacgatgccaagtggatacgcgaatgcgaggtgaagcggggaacttgcacgatgcaaagcgcacaacacatcacacaggcatctatgatgggctggctcatgcgttcatactcatcaacttttgccccaaactaatacatgctatatactataagtttttcgtttttttggtgtgccggngcatacccggcacaccccctgggtccgcccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataaccaatgtccaaatcagttattaagcaaaacatgtttaaaatgaagtcagggaatatttcaacaatattattctaacataagcattcacaataaaaattaaagcaaaattaaacaaggtgtccgtgcatttctagttcgtattaataattgaaaccactcagtgctagaaaatcagtgcaatcggcaccaacgatcatcatagtcggaaagtcagtggcccttaaaaaccgggcactgacgaagtgtcctaagctattgaccttattttattttatttatttattttcaaaaacgtgataataaaaagaaaggatcatatcacagattcacagctactgctggcgcaggtatttccacattagttcggcaaatagtctagtgcagtcgtgcagacataatatgatgtgcacttgcaccttcttcaggtacaaacgtagttcaatgtaccatcagaatgtgcagtggcgaatgtacaacgtgatgaaaatattattggggctttatattaaagtcataatacataataattataatatactttttcaaaatcctacgcggatagggaaaaaaagaggattaaagactgaagtgaactgaaaaagattgaaattaataggtataagagcactgctacacatactagttttttcttactaaatctttactaataatcatctcaaccgtttgatttaggtagatggaagttatgaaaaatctagatgaactcgtagcatgacacttcagtgttagaatttagtaagaaaaagttagtacctatagtcttttccatgtataaaggccatgagctgcacactgcaacagctactagctagaacacaagagtaaaaataatctacaatataattaatgatcacaattcacaaatgatccagctagtaataaacagcctaatgttttttcatgcacatcatttctttcaccctgaacgtctccagccaactagccatcactgcttggccgtatgctggttgctgtgcaaattttgctggcactatgaactcactacgcaacagatatatgggattagattcctgccaaccagagagctggggctagagccccaaccaataacatgttcaatatgtaatttggtgttaaatctgtacggaatttctcaaaatatattttgtttcatgaaatttactcaattatatatatactccctccgtttcgaaatgtttgacactgttgactttttagcacatgtttgaccgttcgtcttattcaaaaacttttgtgaaagatgtaaaattatatgcctacataaaaatatatttaacaatgaatcaaatgataggaaaagaattaataattacttaaattttttgaataagacgaacggtcaaacatgttttcaaaagtcaacggcgtcaaatatttcgaaacagagagagtagtactgtacggtgactagggttgactagtccctctcgtccaatcctaaagttggcatagctttggacagccgctgccgtctttgtgtgcacaacaataggctataaatgtagctagctttggcgtcctccgatcctatggttgtgtttagatctaaagtttgcatccaaacttcagtccttttccatcacatcaacctgtcatatatacacaacttttcagtcacattatcttcaattttaaccaaaatccaaactttggatccaactaaacacagcctatatacactactcactccgtctcagaatataagaggttttagagttggacacgattattaaaaaagtagggtagaaataagtggtgaagggtcgtgattggatgggtagtggagacaggtgggaaaaatgaatggtgaatagttgtgattggttaggaagagaaatatttgtggagaagtagttatattttaagataaattctaagggctaaaagttgttatattttaggacggagagagtagctaggaggctttaatacacacgtcacactgtacgctgtgaaggaacaatgggtttctggcgccggtgcacaccgtcgacatcggcctgtgcaggcgtctgtgtcgtcgccctcctccttgtggctttggcttgctgcccgacgcgcgcacgcggcgctgccccggcggtgtacgtacttggcgactcgcaggcggacgtcgggaacaacaactacctgccagcgacgctgccgatgtacaaggccaactaccctcacaacggcgtcgactacccggggggcaagcccaccggcaggttcagcaacggctacaacttcgtcgactaccttggtgagtatttcatcaacgcgtacactgcgcactcttgggaattaaaattagaggctattgtattggctatgtatatacatgtgaccattgtcttaaggctcgttcgggttggagagggttgaaggggattggaggggtttgagggggaataatttcacaccacaataaatatgtaataaatttccgctgatctctttctctttgggattaaccgaagatggccttaagggaaaatatttttttcacggcaaatacttctcttgttgttccattaattgcagctgacagtctcggggtggccagccctcctccatacctctctataagcaacacctcggtatacctgaggggtgtcaacttttcttcaggaggatcaggggtgtctaatctcacaaacatggtaatattagctagaacttgaaactgtacgatcgagattaatgtctttcgaatacgtagtactctggtccatgattacgcgcaagtagtaattaattttgtatacttttgcgccatgcatgcagggtcagtgcatcagcttcgacgagcagatagatcagcactactccactgttcatgcaacactggtggagcagctcggcccgcgtcaggcctcgacccaccttgccgaatcgctcttcagcgtcgccatcggcggcaacgatataatcaatcgcgtcctgctgagccagctcgtgggcacccaagaccaattcatcagctcactggccaactccctgaaacgccagctgcaggtatgcatgtacacacaaatgacaaatatacaatccgtccagctgaatgtatatcgaacaaaccagaaattttgacaaactaaccattttagagaacttgtttgaataagaaaccgtgctaaaaactaattctaaaaatataccattcactcagtaccaaaagtccgatggcatcgtatcgcataagatctcggtgctcagacattatagctctcatggctgatcaaatagtttatttttagtaagtttttgggtcagttcaacctttaaataagtttttgatactgacctttaaatatgtgatgtgccataaatttcagaggatgtatgacctcgggacgcgaaggcttttatttgtgggcgcggcgccactggggtgttgcctgatgctgcgggagcagagccccaccaaggaatgccacgcggaggccaattacctatcagctcggtacaacaacgccgtcaccatgctcctccgcgacatgagcgcgatgcacccgggcatgagctacgccttcttcgacacgtacaccgcgttgctgcagtacatccggcagccagaggcatatggtactagtactactttacagtgtagactactccatccgtcctataaaaaaccaacctaatgattcctccgtattttaatattccctccgtattttaatgtatgacgcc

SEQ ID NO: 64906 - DNA, 14125 bp, Oryza sativa
gtcatacattaaaatacggagggagtatataataccgttgactttttttactaatgtttgactattcatcttattcaaaatttttgtgcaaatataaaaatatttatttcatgcttaaggaatatttgatgataaacaaagtcaaaataaaatgaatgataattacataatttttgtaaataaaacggataatcaaacgttggtcaaaaagtcaacagcgtcatacactaaaatacggaggaagtactacatatgacacattctaatactacgaatatagtagagatatatctgtccagattcatagtattaggatgtgtcacgtccgatcttagatttgatttttatgtgacggagaaaggatagagcaatcagtctatactaattaagagtgaatttcatagaactatggatactttaatcaaattatcataaaactataaatctaagatattgttatataaaaaaatatagatttaatgcgaaatttctcataaaattataaatttaagatgaagtgtcaaaaaataaatattaaatagcagatttttcatggaactatatgtgcccatttaatcatagaacgcagtacatagactaaagagcaatcagtgtatataccggaatatctgaacatatttagtacgtatgagtgctcacatgaaaatataattaagaatgaatattttcacaaagcttccgatgctttaatcaaataataataaagctataaaatttaaggtattgttgcatcacaaaattaaagatttcatacaaaatttcttataaaataactataaatttatgatgaagtgtcataaaaataaagattaaatagtagatttaccatagaactacatgtaccaattcaataacaaaactacaacttataactccaacatatataacggtagtggtaaggatttaaagattggaatccgtagttttgtagtaactttaatagtaaagatgtagtttgtgatatttggtctataatttgtaattttctgataaatttgtcactaaatctacggtccattttattgtgatacaaggttttaaatatgtaatttggtgtaatttactctataattaatattttatatttcatattaaaaatacatctcctatgaattaatccaatgccattttggtgttttttcttttattttttttaggttatactgaggtgaaagcagcatgctgcggcctaggggacaacaacgccatgttccagtgcactccggcaagctcgtactgcgccaaccgaacaagctacatgttctgggacatcgtccatccgacggagatcacggccaagagactcaccaaggttgcgtttgatggatccccgccgttggtttacccgataaacatcagccagctcactgcgagttaggcatcaagtatatatatagtacttttgcagtgctatcgatctaccgatgcatgattacctgcaaaaattatctaaactattagtttaattaaaaagtactctaccaccagtagaaataattataaatgactcattgaaggagaaatgatataagatcgtgattgattctactaacaataaccaccatggaaataaacataaaaggggtaagatggatagtatttttgtctaatccactagctctgaaaccgatgagaaaagtggctacgtaggggtgaaaatggagcggattcggacggacattggtcataccatatccaacatcatttttttaagcggatgtagagcgggtgtggatgggatccagatcccctagagttgggtataactctaccgggtgaagttggccaaatatgtgccattccatatatatttcaggggctaggattaagcggaaactattctaatccctcgaggggatgttccctcgtttgctcaaaaaacatctaaacggttatgaaaaattctggaaaaatttgacaacattcatacaacacatatatacaactccacaaaatcttaactccaaactcaactcacacgtcgagatataaaaaagacaaattcagcgtataaatagtagcgtactgtttatatctaaatttgtcttttttgtttctcgatgtgtagatcgaatttgaatatgaattttggtggacaagtaggtatcattatactctacattatcaattttttttagaatttttcacaactatttacatcgaatttggaagaaacaggtatacgaggggagatatcccctcgagggattagaatccacgattaagccacattaatttatactttaaaaaccagtaactgaccatgcaacaaataaactcgcatcaacaacttatcacgagatcatttttattgtataggtagtccccttgctcttccatttgtctcgcgcgcatcggacgctgtcctgcacgcccaaaaacctttgccctgccggctggcttcgctctcgatcgctacgtgcgtgcagctgccaccgccggccgccgccggcgcaacgcacgcacacacaccaacaagtacgtatttgtgcgcgcacgcatgcctccgttacagagacgtcgtgcgtgtttgttaataagctacgaacaagctagctagagatcaagcaacgcaggcatgtcgtcgtcgtcgtcgtcgaggcggtgggcgtcggcctccgttacggacctgtcgtccgccggccggtcgcctctccccgccgccgcgctctcccccgtccgcccgagcgcccgccgctcccccgccgtgtcgcgccccgatccggcgccatccatcgcccgcacgatatggccttcctcctcctcctctaacagtggcaacacgagcactaggaaggcgtcgccgtcgccctcgtcccctgcgccagccgcgtcaaccccctcctcctcctcgtctgtggccaccacgctcgccgaccacctcgccgaagactctctggacgcgccgcctgctgcgctctcgcggcagcggagctgcaccgagctcccgcgcttcgccgacgcggacgccgaggcgaggaaggtcgtcgtcgccaggtcgggcggccacgcgagcgcgatcggccgctccatgcggctcctcccgtccacgaggccagccggcgtcacactcaccccgggccgcgtcgcgccgtccgacctccgcaggctcgacgccggcgccgacgtcgccagctccgggtcggagtgcagcgacgcctccaggggcggcggcggctccacaccgaggacgacgacgaagctgcccaagccgccgccctcgccgttgatagcgcgaaccaactccacccgcctgctcgggtccagcaacacgcagtgggcgctgtcgccggggcgacggagcggctcgccgctgaagacgacgctggcgacggtgccggagctcaagggcaagacgaagagcctaataggccttggatggggccatctctttagccggaggaaggcggcggcggcggaaacggccaccggagcgcaagcaacggcaacactgtcctcgccggcgtcgcggcggagcggtggaggtggtaatagggagatcggccatcagatgaagatgatgcactgccggctgttgcagtggcgcttcgcaaatgccaaggcagaagccgtcagcaagaacaagctgtctattttcgaggtatatatatatcaagaatgcaccgttcacatcaatattataagtacccacacttataatttgtgagcctatataataactaaaatttgttcagtttggtgacatacctagtttgttggatttcagcccaaactctcagcgtcgaacacctgcagctcagtgaacagtgaaattctcaagtattcgacgaaatgaaaacgagcctaatagtgttttttcttaatgtgttaacaaaatttgcagtggttaattttttttcccaaattgagatacatggtatacctgcatatgcttaaatgtacgtatgtatgtgctttaggccgcctttggaaattaaacatcaattcatcaaatggtatattatgtcgttatgttttattttactcctaacctatgtgtatataggtggaattcatgggtgcatgggctaggatatcagagctgcaaggtaaagtggcaaggaggcgtgtacaactcgagaaagagaagctcaaaatcaagttgaattccgtactttcttctcaggttgatacataggagtacatgtttttgttcagttcgatatttgtccgtcaaaattgatcctttagtgattacttctctgacattatgatgcatccatgccatggtgaatatgtgcagatgagaggtttggaaagctgggggcagctggagagcaagcatgctgtggctttggattctaccgtagtttgcacccaggcagccatttgtaagctccctcttaccaatggcgcaaaggtttgtatttttttttcatttaaagctctatttcttaaaaatatgcacttccaacataaaaagacgttgatgaatacacttaggttgtgttcggtaggggagttgggaactctccctccaaacacgtaaaacgagatggttcattagcacgtgattaattaagtattagctattttttctgaaaaatagattaatatgattttttaaagcaacttttgtatagaattttttttgaaaaaacacaccgtttagcagtttgtgaagcatgtgcgtggaaaacagaggaggtgtagttgtgaacacaagctgccaaacgcacccttaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggccttaggctgagtttttcgcacgcaccttaaggtgaggttgttattgcaactcgttaaaggtgtatgatattattggttacgacagctgatctgatacagataagtttttcacattattgatcattcatcaatgactagacccttcactatcacaaatgacggtttaagtacgacatagatgacatgttccgcaccagcatgatattgaattagcatgttataatatttcaaaaattcaaaaacatggattttatcatcgtttccttagtaggaatattccaaatatatatttttctgttttttctgacttttctatatatgacaaatatgaagcatttggaatcctctcactggccccatctacaatactccctccgtttcgaaatgtttgatactgttgactttttagcacatgtttgaccgttcgtcttattcaaaaacttttgtaaaatatgtaaaattatatgcctacataaaaatatatttaacaatgaatcaaatgataggaaaagaattaataattacttaaattttttgaataagacgaacggttaaacatatactaaaaagtcaatggcgtcaaacattttgaaacggatggagtattttactaaattcgcattttacttcttatcaagatctccctgccatcgatgggaatcatactacagcaggcgcttgacctcactatgaccaccaagacaatagttcggtcgtttactccaatggtaataaaaacacatcaaaataagttaatgtgttaactttatttttcgaaattcgatgcagcaatctgataaaaaaattgttaccattaatattaatgcagctaattaattactttttaattaaattgaagtattttccatgataccaggcccatgataccacattgctgatcacagagctagtagctgtggcaagagaagagcatgctctgttgcaagagtgtctcgagttgctgggccgagtgtctgcattgcaggtagctttgagtcaatatgttccatgaaagaaaacagcatatattcttttcccttatttttatttaacgcgatgcttatgctaatcttcattgatcgtgcaaatccgcaggttgaagaagagagcttgcgttgccatatgcttcagtcatagttactgaatcttatgtccgttgatacagtatgatgacagtagctaaatgttggcttgttcgctctgttatcatttttaaccttaccaaactaaaataggttgaataacagcagtaaattaatatttttaagctgattgcatcaatcagctgtagacatcacatttttgtcagtatacgtaggggctacctaatgcaatacaggaaaaaaaattgaaaatatactgtttattttttctaaaaaatactataagcaaactttattatatgaatagaccatcgtcgcgcttgagataaacgaacttgttaacgatatcatcgtgtcctatcgccgcggccactccgccctagccctcccgccgccaccagacctcacctaccgccgtcgtcgctgacatgtgagatgtgagagagaagaggaggggatagagagagaagagagataggagagctgacatataggtccaagggtatttttgacattccacatgatttctctctcctattcaaccgaaaattattattttaattggtgcagtgtccaccagcaaatatccaacttttgggagtattttccccaaagtcatttcgtgtcatgtcctacagttaaaaccgcaaactcacgatgtcatgtagcaaaatttgcctaataaaaaacaaacagtggatccgctgcatcgcgctcccgacaagcgaacttacacgattaataattagtatcattagtaattgattaattaactattatttttctaattattgttgtcgtgacccaaggtcacggacaaatagggggatagacgggagctaatccctttactcattttggcatttgagtcgtgccttttcgttttttgtgccccctcatctgcgcgtgctccctccacctcgcgcctatataaaacattgttggtcactatcagagagcctcacgtgctccagttttatctcgttctttgaccactttctctttctactcgaactttctatagttttcgagtttaaccatgggtaaaactgtcaagaaaatcgccacaagcctaagttcaaacagtcttcttcaagcttaccccctccgtccaaaaaaaaacccaatcctagctacgaacctggacacgcaacacaatcctccaaggcatccagcaacaggtggatagaagagtggtggctaacggccgtgtcatggaccccccgcgcgaagagcagctgagcatggcaagagcatggaaaagcgaagtaggaagggctcccgacatgtcatcccctcaaggcataccatcatgtcgttgcacggcagctcgcgcgtatccgtatcgtggtcacatgtcagccacaccatcgggattggcgagagaatctccaagagacaggagatggagtacattgtgatgcctgagcacgatcgcaagcaccaccagctccatgagtgtccatgcgtgcacacaaagagtcgctaaatcatgggagaggtgtgcggtggccggcgaccgacagggagaagggtggcggtggtaggtagaatcccgacggcgatgactggcgatgggtgggagaaggcttgcagctgtcgagaagcttcatagtgataggatgtggggagaagggcgtaggtgtcgaagacgatgcgaccacagtgtggagtagatggagttgacctcgaagacgatgtggcgaagccacgcgtgctcctcagtggaggagaggcagagctcagggacacttgaacacatcagcttttgagcagctcggcgggggtggctctgagcttgggggataggagcttggccagcgtgacaagacggaagccctagccctcacgcgcgtaggtaaagatgatattgtcgttgcagttgggacctgggcgcaccacgtgcgcgctcccggtcgttgggagccgcatcagccggtggcctccgctatcgagcttttccctatcggcccacaccattctccccatccattggcggctgccttggaggtttgggttgagatgggaagagaggtaagtgaggtggaagaagattgctggctgacatgtgtggtccacgtgggccccacactgactcggccgccacgtcaacaaaaccaaagagcataccttgggatcaaatgtgacccggttttgcaagattagggatacattatatcttcaagttcggaacagttaaaactcgacaacaagataagggaggttaggtgaactttttccgagatgaaaaatttccagcctcatgggcctgtgcatatgacccataggaggcggcagacctccggctcctcctcgcccgccgccctcgactcccgtctcctcgcctgccgccggcgccgatctccatcctgctagcagaggtggcgccggcgttctcctgctcccgccacatcatcgctaatccatcccatccggcctcggccaccccactgcttctacgagttccatacccagaccgccgccgccgccgccgccgccattggtgaagcccgtcgccatcgccgtcgccgcttccacgcaagtccgtagcagcggattcctgcagcgccccccgaaacatcccgaatccccagccatggcggccggagcagcagcagccacccgccgcagtctctccgcgctccttctctcctcccgcgctctgcaacgccgcttcgccccgctcgccgccgccgcctcctcagcctacctcgccccgtgggcgccgccgtcacgcggagcgaagaccgcgtcgtcgggtgggtctgggtactcgccgctgaacgacccgtccccaaactggagcaatcggccgcccaaggagactatcctgttggacggctgcgactacgagcactggctcatcgtcatggagttcccgaccgatcccaagccctccgaggaagatatggtcgccgcatatgttaagaccctcgccgccgtcgtgggaaggtatatgctcttcttctccaactatatttgagaaactccccttgaactgaagcagattagactaattacaatagtgggcctatacatcttagtgatcgaactgataataaccaaaacatggctgttgcatcaaatttgcatgatgagaaattagtaacaatatatatgatgaatgttgtatcaagtttgtactgttagttgtatgtttcaaaaagtcgagtttacattgtggttttttagcatggcaattaggtagggaaatgattgttcacagactatttttttggacatgagttgccatcagacattaaactgttaatttctgtcttaaaggcatgaagcaaaaatttcacccactgaaacatttgtgaaaattgagaaaaacctagcggcaaccacatggtgacatacagataaaacattttgagtagtagtatgcatatgcaacatctaaaactattcacttccagcaatatgcacgctttctgcaaacactgcaacttcagctacattcaggacaaacagtggcaacacttttaaagtctgactgtgccaactctcaaaaagttcaaggagtaatatatgtgacattatgaaacctgactgctcaacatttttgtttcacatgggcaacatcagcatacccaaaacacgtaagcatggctgcaagtaagcttgctgctgctccgcgttgctccggctgccacatcacactacccttgaccaagagccatgcaggcatcgagcttgctgcttggccctgagagccatgggttgtatcatccccttgctcactcctatggagacacctccatggagatccgctctgcgaatatcccccacccccactgctgttgtgttctcccatcaccttgctccctgcatttcattccccaccgactgtgtgagtccgattctcaagtcagagactggtgtggactgcatgcgtgcgtgcgtttgtgtgagtgtgtgtgtgtgtgtgtgtgtgtgtgtgtgtgtgtgtgtgtgtgtgagagagagagagagagagagagagagagagagagagagttgtgacttgtcaggtttggttcttgtgttgagctcctgaatcattgtggtggctgtggtcatgatttggccaagcagctgcaggcaggcacgagatctgcttaacaaaacacaggcctctggttgagcgtcagtatcagacatctgcagtctaattttctctaatatcatttggccccttcttcatagtttcatatatactcttagtgatctgcaatgttctaatagatgataataactaattgaatctttatcctcaagatcctaatattctatatttgggcatcatgtaggaattcaaatgtttatcataactttttttttgtgtgcagcgaggaggaagccaagaagaaaatctactctgtctgcactacaacttatactgggtttggcgcattgatttcggaggagttatcatacaaggttaaaggtgaaacttttgtggctctgcttttctgtaaggttcacaccatgaatccatgttggaaatatttttttcatttactttgctgctcttaaaggattgcctggagttctttgggtattgcctgactcatatttggatgtgccgaacaaggattatggaggttagtaataatagaccttgttcctgctctgtttgcgattgtgtaggattataatattcttatttggttggatttcttgtagatatttatttgtttcactagttttttattaatcaagtggcaacaaaatgtcttattgtgttccagaatatataatatgaaaatcaatggcaatctaggaaatctattttatttaacttcagttcgatatatgaaacataactatatagctccacgacagcttgaaaataagcaaaacacaacacaaccaccacaaacttattattttttggaaaagaaaagagtaacaaagtgctctactaacaaagattagacataaagagaaaaatactacatatggtgggagagtggagaaacaaaacactacaaggcaattaaccttgacaccaaacagggcctcgaccagaccacccaaggtggaatcttccccatccatgcataatgggaggaatcctttctaatatctttttatttcattgaaaccaaaggtgcaactaaccagagtgagcattttgttaacaattacagcttgtgactataacggtactaacatgccctaaaaagtatgtggtatattcaagtgaatatcagtcaaattccagcaattaatactaaattggcaaaatggcaagcacaaagaggtggagcaatcgtctgaggcattttcacaacagagaaacagataaagtggatttagctctaaatttattgtattgtaactgattctagtgttaattttctgttgtgcgacttgttagtatctctgactccttgggaagcattgtgtgtcatacatttactcttccaaacccagctataagttgatatggtttatttttctcaaaaaaaatgatctggtttatatgttgcctaaggctgtgttcaggaggggttgggaacccctcctctctggcacacaaaacgaagcagcagtttaaaaatggattattatgattttttaaagcaactttcatatagaagaacgaggaggaaaagttgcaaagtgtttagtagtttggaaagcgcgtgcgtgaaaaacaaggaggaaaagttgggagctcgtgctaaagaacaaagcctaacaatgaagatgagctttcatatagaagaactcatgaaaattccaaatacaactccaggagtcctgactcctgagtccagaccaggtttaattctgttaagggaattcttaattgtaattcctgaagtggatgatggaaactaaatggcatggattttgtcgtcatgcattttttggcaaatgaaaaaaaaagtgtggagctgctaactttaaagtattatttagcaatatatatgttgccttagctgttttgtttgtcctcgttacccacttgaggcttagttattgcctcgatggcttgaactatggcagctgttctaaaacatccaccagaaagagctcccttctatcttgcgaaaagaatggactctctcaaaatgacttttatgttgaagaacttgtgcagaaattttgactcctacgttgatttctttgccactagacacatccacctaaagcatccgtttgtggacttttgagaaaatagttcttttaagattagcaatcatagttcgtagttcagccagcaatagaaaaaacacttgtgtaaaagcatagacaccaattactcttgccagcgttccttctttagaaagactgacaaccttatgacctgagagtgtattaatacatcttcagtgctcagtctctggagttggttatgcagataggtagcctagataaatgaatggagaatattccttcttacagccaagaatcctagatagatgaagttgcttctgatcacacacactgaaaggaacaatgttgaattgtgtaaattgaattttagtcccgtggagttactgaaagaatcaggaaatccttttggcaaggtttagtattgccaaagtatggttggcatattggattatcagaaaatccaatgtaaaaatattgacccattcacccatatggcatagaataatagtatgccatttctacttcctgatctaaattctgtgaagaagatcagcatcagtctcagttcatgggtccccatcatttcctcatccagattttgatgttgaattatatgtgtgctattctcttatatacgcctgtctttcctgttttcaacttttggattatggatgatgttttgacaaattacattatgtgcttgtaataatttcatggcaccacttgtaccaggagatctattcgtagatggacaggtcatacatagaccacaattccgatttactgaaaggcaacaggtaaggagccggcctcgtcctcgctatgacaggagacgagtgactatgcaaactgaacagaaagaagcaatgcagaaaggaccttcaaatctgcagcagtagcatgaaaccatgccatatacactaaactgttgccagaatagcctaattatcctggatatgtttaagttctggagtgtgtccatttctggaaatttatctattgtcttgtcagtttagcgccgtggagcctatccgtggacatctctgcagttaagaaacatcatattgaccttgttatatgagaaatcctgcacttttatctccatggtacgcctccgaataaaaaatatccagtccatgccctctggttttaaaagagctccgaataaaaaatatccagtccatgccctctgatgttaaaagagctccgtgccacaaggcagctcttttatgaataattgaatatgtgccagcaccctttttggaaagggataaaatcgtaaaactgccctgtccctattccttataattcacatcagaagtcacttgaaatttggcattccacctcataattcattttgttgcaaatattcaccttcctacttggttttgtggtaaaaaccacaatagtgcaaacatgtttaatcggatcattatgttttcataaattgtgagctgtaaatacgatctataccaaaattaaatactttgtattaacaccttttcgaagattccataaaatagaattgctaaagacaattactaatgagagcctaaatgttggtgcactgactttcgttatatgataagataattgaatggaacacgaagaataaatctaatgtagcgatatcatgctgattcggttagcacgtgcacactgcgattgtttttgcaacaaacgactaggtggtgagtatttgcaataaaatgatttatgggatggaatgtcaatctttgatggtttttgcaatttttcatataagctgtgaatt

SEQ ID NO: 64907 - DNA, 2026 bp, Oryza sativa
ctgttccacgtgcacgtttttcaaacagctaaacggtgtgttttttgcaaaaaaaaaagttttatacaaaagttgcttaaaaaaatcatattgaccccttttgaaaaaaaaaagctaatacttcctctgtttcatattataagaatttctagcattgtccaaatttatatagatattaatgaatctatacacatataacatctatataaatgtaggcaatgctagaaagtcttataatatgaaacggagggaatacttaattaattacatgctaatggaccgctccattttctatgcgtggaagatcggttcccatcaagcccaagcgaactcagctttagagcagatacaatagcaggctattagccagctataaacatattataataagataaaacgatgagagaaaagagcagcgggctatagatctgtagccagctacagcacggactccaagacgcaatgtgtgtatgacaggtggaaccatatattaatagtatagtaagcaactattgtataaattgattattagattgactatcttattaaacttgctctagggcaaatactataatgtttgtttgatgtgttgcccctaaaaatacgtgctcccctggacagcccctgccctccccgcatgagtttgaaggatgtaaaaaaaggacacaggggtatttttgtcatttcggatgtcaagacatcggtggaatattgttaaatttctccaaattttcttccggtcggtctcgaaccttcgtctccagctctcctccgcaccgcagtccgcaaaccccagtttctcaagcatcgaagaatggaaagaggagatggcgctatacccttccgcgccaccaacatcgccgccgccgccggcacgcccacctctgcttctactgcggtattcctcttttttcccctcttgatgaaatatttcctaatttccttggcagtttgccatcttggaataaaaattttgtggaatcagggtattctcctgcttgtattctctgtagatgcggttactcagtttatcaatcgtctcatccacttagttgtatggggaaagcggaggctgaacagtttgcttggaacgggcaaggagcactgctacttctttgattgagatgccattagtgaatgtttctgggttgagagttgagtaggttctttgagggaaatgcttagtcttatggtttttgagaccgaatttatgcatatatgattttaagctcatttgttatgagtagcagtatcactaattttattcatcagattgtgatgtggatatgtggtgtgctgatcaaaagctgattttgtttgcgatcagggccgcccccagcaaggggatagggaaaatgctgtcagtgctgagattgagagggttaacaaactgccagccaatagttcctatgccatacaccgcttgaaggttctaaacaagcttcgccatctattatctatcaaggttagatttttttttgtgtattttcggaccaagataatttgagtcatcctgctatgcaattgtcctgtcaattggtcatctgtgcagtgaatttaaaattttcaacttattgctttttagttagtacatctcaaaaggcaattttcaattcttaacaagagaaaagaattgctattattatactatattctattaaagcctaatttaaagatagcaacattgctattacatgttgctggaggaatatcttaccatgttgattacgctgttggtttggaagaataattttcaaaaccaaatgcaaatttgaaggtcgtgagttattaaccatggtgtaattgtactatgtgctctttcaaggcatcaaagcaaaactattgcgatgtaaatgtggccacatgaaaaaaaacataaataaacccaaggaattgaaatattagattattggattccttgtcagttaagtaacaaaaagttgtgatagtttggtactttggttgctaatgtgcctagattgtaaaacccgatgaaaccctttttggcttagtgaatatgcaactg

SEQ ID NO: 64908 - DNA, 1424 bp, Oryza sativa
catgggaaaattttggcattactgaaacattggtagagtagggatgtttggtttgataccaaatagtgttaaagtttggtgctgccaagattccttggatattaccaaattttggtcgcaaaccgagtactcctagaaatcaaattcctgtggcaataccaaagttgacaatggttagaaatggctgcaaatcaaacaggcccaaagtacacaactaaatattcatattctcttatgtatatatttcttttttgtttgaactggcaaattgtatccagaactatttcatatgtaaatttagattttcttatctgcttctagtttgagcacgttgttaaatcaagtctttactggttatgtacctatgtggcttctgacctgtgtctcacatgttgaggtccgttgcatctagacttcactggtggtaggatggacttatgtcctgcttaagtactgtggcaggtggcatcatgatcaaattgaccaaatgcgtagtgcccagaagaacaaaaaataactgttaaaaagttcaatttattttttaaatcattgtagtttttactaattaaacttttaatcatgggcactgtcattcatttatgctgttaatgaggtggtgctctataaaccatgattttaagaaatcacaccttatggagtgacatgaaaagatggagttcctcttaaaagttaaatatttaacacgttaactaagggattatatgaatcttagtcccagcaaaaaaccaggttttcttaaattttctatggttaatatttgagttgtttgaaaaaacaactccaacttgattccagggaaaacaaaatagattatcgaaagtaatttactatttttcaccaaacaagatattcactaggtactatcctgattacttggttccagtaatcttagcagttcacacttcagtctgtagcccaaacttatgttgccagtacctatgaggaaatacgtcgcactcatgggagaatgtgtgcacattaccaatatcattcaacctccttagagattcatgctcagcaccatatccatggaagcgcatcgtctgccgtcgtaactataacggcatggtcatgccgttggcaaatcctggacgttcctcttttttggacgattaggatttagaagggctccaattactaggcctaccaaggctcacgatgctttttttttcttaactcggtatcgatttcactttccccatcttcatccctcctctctctctccacgcatctctcaatcactgcaaagcaagagggccgattcagtggcttcaaccatgaatttttgctggcaatgaccgcaatatgctccctgatattatccaggtttgcttcccatcatttttgtcaattaatttggcccctgttgctagcagcaatcagtcctggaagcattggcaaca

SEQ ID NO: 64909 - DNA, 8996 bp, Oryza sativa
ttgattaagaaacccaaaaataagattcccacttgaattggtttttcaagagctgatacctaaaaaacttaaaacttgagcttcaattttttttatgcaaacctaacgtaatgatcaatgaacccaaaaacctatgtacatcaactaaaagttgttgaacatgaatgagaaaaacctgcccacgaacttggattttactgcctccgacctggccgccactggcccactgccattttggaatgctctgcagcatgatcgggtcaccattgaccattagtcctactcctcaggaagtccttgcttaagtgaggctttggctctagcagcggcaggcatgctgtatttctttgattggatgcattcaattgtgtacaatctcacgagcagtgctggaggttccaaatagcacacgaacctatatatgcgagcaccaaaagcttgttcgatgcttatatctaatttattgtcctaacaagaacagaaacttcttggtgaaatgaaataaaagtgccatggagttgaatagcttaaggacatgttttctctgcattatgatttattttatgaagcttatattcagttttgactttttgtaaacctagactgattttattttattttattgtgcaccacagagaacaacatctcaagatgaggagcttgaacttctttttgcaagcctttcaatttaaacactatcggactatcctgtatcctccatatgttacatatggtaggtaagctgcaaattaatactgaactttttcattttggcagctgtgtccgtaatcactgctggtattatccatccacttctctttttattcaaatggatcctatattttgacttttttttttacagcaacctatattttgacatttgatttgtatataccattttatttgcagctgggtggctccgtttggcatttctgctgtccgtcgaacatgtttccagtacggttttctgaagttattggaaatcacccttctattttgtagaactttatgagtggatggtgttgaaactatgatgtatggagtatatgatcttccgtacgcaaatgtcactcttaaccataacggaacttctatagttctattgtagatgcccaaaactttaaaaattgtatgacattattaggtgttgctatgttggcaatggagcaaacattctgaatttatgctacacttggaagtgtagcataaattcaaatctaaccaccgtaacgcgtttcgttcgagtaaaattcctccacttggaagtgctctttttttttttttttggcgttgcgttgcatatggcattacaaaaagctatctgtttctatttgtttaagctgcagcctgccatagaggaacatttagcacagtacacgcttcgttccaagttaatttcaactatatacttgaaagttatttcgtcccaagaaataattattatcacctaatagtttagattaccctaataaataaaatgcacatccgataaaattagagatccggatgatggaggatttaaataataatattttagttgaaaagatacgatagttaatgacatgtatagatgtacatcttatattataaaacaacttattatattatggaacagagggagtataattttttttaaaaaaatgtataggaaagttgctgtaaagaaaatattgattcatttttaatttttttaagattacttattacttgatgtaatacttatttaatcatgtgttaataagcaacccgtattcggtgtacagcctaaaggggaacctaaagggtgttgtgagtaggaataagttcatctgaggtcccttaactttacaccgaatacaattttcgtccctcgaccggaaaaccagacacaacgggtctctcaactattaaaaccggtgtagattaggtcccttggcggttttgagggcggttttggctgacgtggcgcctacgtggctaatttgactcggtctttatccgacgtggcattgacgtggcgcttacgtggcaattcgatctgtcgaacccacatgtcagtctcacatagaaaataataaaaaaaatcatgggacccacgtgggtcccatgtgtcagtccaactcacccctcttcttcctcctttctccccatctctctctctcttcatctccctatctttgctctctccaggcgccatggaagacaacagcgcgcggcggcgcgcggccggcggtaggagaggagggagcaacatgtaaagaccggcgaggcgagcagggagggaggacgcagggaggccggcgatggccgagcgccgtgggcgggtgcttgatgacgatggacggagggagagatgtgcagccgacggcggccagcgggagagggagcggcgatcgccctccgccacaacccgcctccaccaccgagctcgtcagcgaccgcccaccggagcaaggaggatgacagccggcgacgggtgaagaggacgaaggcggcggtttggagtagaggtcggaggagggcccccaaccaccaggatggcgctcgatccgtcgcgtttcaccaccaccgagcttgtcagcggcagcccaccggagcgaggagcttccgcttccccttccccccattgacgccgccgctgcagcagctgaggcgccgctccctatgccaccggttctgtggcgcacgccggatgcggacggggacgccatggccgtggccgcggacgacgtcgacgtcgacctcagcatcctcggcgactcccagggcccccgcgccgccgccactaccggggggagtagcgcacagcagacgtcctcctcctccggctgccaccgccacgcctccccgcatggctgcatctcctcctcctctgacggccatcgccggccaccgccccttctccccgccggccaccgcccttctcccggccgccactaccggatctcgattgctggcgttgctccggggggacctgccgccgcccgggtcgatctgttccgcccaccgccgtcgccgatccccttttatcgccctggcttcctcctccagctcgctgctctcgccggtgggcgccggtctcgccgccccctccagctcgccgctctcaccgaaagaggagaggagatgggagagagatgaagagagggagatggggagagaggaggaagaagaggaagggtgagtttgactgacatgtggggggtccacgatttttttattatttcctatgtgagactgacatgtgggtcccacgaattttattatttttccgggtcaaattgccacgtaagcgccacgtcaatgccacgttggacgaagaccgagtcaaattaaccacgtaggcgccacgttagccaaaaccaccctcaaaaccgtcgagggacctaatctgcaccggttttgatagttgagggacccgttgtgtctggttttccgatagagggacgaaaatcggattcggtgtaaagttaagggacctcagatgaacttattccgttgtgagtaagcccatccggcccaaatgcttcttacagctggtccagcccgcaaaaagtcggagacagggaccctaggcctagaaacaaaagcgaggaacagcattcacccacctgcctgcctggaaggaagaaccaatccaagaagaagcgatggcatctcgtctcgttgcggcggcggcggcgtcctcctcgtcttccccgctcgcccgcctcgtctcccgccgtggcctcgccggcgctgcaggtatgcgcgccgccctcctcctcctccaccttcccagatccgcgggagtcgtagccgccggctgtctggatcggactgtcgtttcggtccattcttggatccacccttggcagattcggggccacgatttggtagcgggggtagttgtttgggggtaggggcattggctcgattctgattagggtttgttcggagttgtttccgctagctagaaacggggtgcctgtttttattttgttttgttttgttctatttatgttgctcctgctgtcttacattcttgattggttcgtcttctgtcgtttccagatcaccatgggcctccgaaggtcaacatttggcaagaaccgatgaacccggctaactggaaggaagagcaagtgagtattcccctggacattcctcctgttttccgtggggcacatgtggctcttgatcttgatgtcattctattctactagggtctctactttgcctgcagcaagtgtcatgtgatcttgtaggcatgactgtcgattttattttccctcattttgttttatggcattattccagttaggtacagttatattcagtttaatatgtcttgttttacaagattatggcaacgggtatgtggaaatggggattgaaaggggattgttgcaacttctatattacaatgaaataaaattgacactattgttgcaataattttgtggtttgttcatacatctgtattatgcttaggaggaatggtccaaaatctgcttgatcgaactgcaataattggttagggttctaagttctatgattatataggctgttatgaattttaactagtaaatatggctatgccttctctgcaatggctggaaagaatgtttttctttcttggtactcatgattattgtcttaggacaaagcttatatgtagcgtgaaattaacactattctattgttccagtgtgctattctgtaatgaagtaaatgtttgttctgtatgaaccatctaataattctcaggaaagttatcagagaagttttcagttaatttactccacttaatagatgtgcttatttgttaagctgaaattctagcctctttcataattttaaagttattttactacgaaccttgtgcttgtggctcatgcccagatcatactcatcacaatcatctttcaaaaatcatcatttaaaattatcatgcttgccatagcgagctcaaggtgaggccaagggcagaagtgtgacaatgtactggcagagtagttcagggatggggactagaaagaagttcagaatgagcagatttgagtcttagggataaggatgcagagatggtggatatggttgttggtgagaatgggggaggttgtgcaggcaacgttgagaaccaagatgtcatccctggttcatcacttgctggccaccactggaagccaggaacttgtcactctcctccgtgtcgctctgccacaacccataccgcttctgtgtacagttggctagttttaagatagggttgtacacatgagatgggacagctgtttttactcccctctcttctccatcctcaaaattttttcctccatccctgtgcagcacctatgcgcctgcttgcgggcggttggcaagcagacaaaagcttggctagacgaggtgaacgtcaatagtatccactttgaggagcatttgtttcaactgtcaaggaaacaatttggcaacaccgtgaaataatagtgaagtagccaataagaattaattcttgttgagctaaccttgataccactaaacacacaccttttcagaaactataattctacagctattatcatgtactctgtacacccaatttggaatatttttaagatgtgttttcaagctctgcattggtcttctccttatgtcatcaacctcgttaattgtacatgcagtttcttctaaatgactctgttctacataccttaggactttgctggaatcatattgttttgttaagaaagttttcttagcttggaactattgatactaattgattgatagaccctatctataagttgatttttttctggtttaatttagatcctgttttttagttgttattctttactttgtgcagtttgtgctagccagcttagctatgtggggaggtattttttatggtgtcggcaggctttttagtgggaagaaggaagacaaaactactgaggtattcattttttacttatatttcttatcttgaataatgctcttgttctcagagttctgatggtgcatgaaatatttaactaatactccgtatcaattaatcatgaaagttagagttagaagcacaaggcacaagtacatgatacaatgtgttcctttcttttgaagggctacctctcgtatttgcagctatattattatgtcagtatagtatagtgtcaagatattgaactacctatttcagtgtcatcagcagatctttttttaccaattagttttgatggtagttttaatgcttgcaagtatctaattatatgagtcgtgcactgtgacaaagaacatgtaaatcaaagagtacttggatttgtctgtttggatagatggtcaagttaaatagatactcccttcgtcccaaaatataagggatttgggttggatgggacacatcctagtactatgaatttggacaggctcccagtccagatttgtagtactagaatgtgttacatccaaccaaaatctcttatattttgggatgtaaggagtattttacaagcactgtgacaaagaacatgtaaaatcaaacagtgcttggatcatttgtctccttggatagatggtcaagttaaatagatattttacaatcatgtgccaatttcatgatgtggaaaacatatgaatgcacatatgatctgaaaattaagcattttttccctcaaaggcatgcaaacgaagtattgctgcattctgaataaattttaattatatctgattgaaatcctccagtagagtttctatatctgtgctcaaattccccagtccccaaaaattatgcagctaatatgtttgcttcaagtaattacattgtatcttggaaaactcagtactttttgccaggtggttttttttttgggggttttcatgtttgatatggtatttatgtagttttatggcgttaaatacttctgctaccatccactactagtcagtgtacaagtgagaagtgataataggtggatttgtggaagtgagaaaaactgaaaaaaaataattgaaatttaaatagcatttgctccatggaaaatggtttttcccatggacatgtgactacatgcacagcttccactatcaaatgtgccgcaagattgatggtaatttttataattcaaatagactaattaatgttccatgcagtcaaatctcccagtcagaaagaaatattgaggcagagggttctatgtgtttaactatatgtgatacatgagtgtcatttaaccaaaaacaatgattcatgatccatgttcaatttacatacatgattgtatacttgcttgctattatgtttctgtcagcacaaaacttatctccattttattgtaatgttttacaggcggcgccagcacaggcataataggatttaccagagccttatttcatgctgcagacgtgcaactgtatgaaataaagaagaattttatggtctgttttaagtttgtatcgctaatggtaaattgtggcgactagatgggtgattttgtaagaggcgagattttgtggacctacacttgtcagccagcatgaataatctttaccgcagtggaactttggttgagaaactgcaacagcgtcttgatattttgttgtcatcacatcaattcatgttttgtaatcaatattggtgcgattgatcatgatcttgcgttatcatactcaggttgattacgttaccgtctggggagtcgaattacttccatgttctaactaaattgatttgtctattttgactgtttggattagtcttgcaaggtatgattgtggttgtttcacgtttttattcacattatttatttttcattattactctccatccaaatcgctcattgtgccttgtggcggtgatcgtgatcaggttcacagaaccgatagaatttcgtgaaaaccggttggttttttgaaactgctgggtctcggtttttgaaaatcggatggaatttcatgaaaaccggttggtttttgtgaaactgctgggtctcggtttttgaaaatcagtcggtattagctagttttcatacagtgttttgactgaaagacatcggttttcaatggtttcggtcggatttcagtaaagttaaaccctgatcgctatacatgctcacaccggcgataagattagtcatcttcaatttgtcagacgagacgtttaccctcctcaatgaccagccataacatgagcatgagtacgccggcttcttcaacactaacgacgacacctcagttgggcctggatggatgccctgcacggcaatacgataaccatgactcacctgagggatggatgactgtgcgtcttctttcctgtactctgtgcctctgtgcttcgatctctacacaggccgagtttatttcgaaactttttcttcaaacttttaacttttccatcacatcaaaacttttctatacacgtaaacttctaacttttccgtcacatcgttccaatttcaactaaacttttaattttggcgtgaactaaacacacctacaaataagatattcagtttgtaaaacacgtttactactttcttcatgttcacatttttctatgtctgatgattgtcttttttttttctttcgacaacttgtggtgattgtctgaataatgcgtgcttctgagttttgaacaatggagcgtgccgaacaaaaagtattgtgtccaatatagtatatcttagtaacacacataatgagggtggttgggggtaagattaagtgaatacttcctttgtcccatatttaagttcatttctagcttcgtcccataataagcacatttttagagtaaccattgtatcggagtttgtagaagtagagaatagtcgtattacgagcagataaagtgatgaatagttacattgagattagataaagtagggaattctatcttttggtatttttattgatatatgtgtgagatggtgaaaaatgaacttgttttgaaacagaggtagtattaaagatgagtcgtggttggatgcaaatgtggatcccatatttgttaacaggatgtaaacaaaccccgggat

SEQ ID NO: 64910 - DNA, 85182 bp, Oryza sativa
ttatgtgtaagattttacttgcgaacgagtaaattagaggttaattaagaagagatgatttatgcttacaagtcgtcgagaaccttggaggcgacgaggaggcaggcgaggaggaggcggtggacgttgcgggaggcgacggcggcggcggggcggcggtgctccccatgtctacgtactcgtacgccaccacgtagcactcgtgctccagcccggcgtaccggtgcacgcgctccatatactgcgccacgccgatgcgcggtgccggcgcgcccctagccgcctcgaacgccgccatccttgctcctagccccgccgccgcctcccctccgccgctcagcgcctccaccgcgtcgttccgcgccaccagccgctgcacggcgcgcgccaccatgtccagctccggcggcggcggagccgacgccgtcgccttctgccgcgacatctcgccgcccgctgccgcggcggcgtccatggccatgcacggcatcgacagcgtggagtggcgcgcgttagctcaagctgtagccctgtagctgattcggcttggcgcttttttttttcctctttttggttggcgggggattaaccgcgggaacggacggtggatgatgcggcggcggtggggccgtggccgtccgatgaagctgtctctcttcgattttaggaacggaattttctgtttcgcgattcagacaacaccagaatggactgttcaacccttatttccgattttgtcggcattccgtgccaaaatcgtgatccgaaatggttttttaggagtggtggacaggatgctcatcctctcccactcaccgctctttgctgtccataattttagcacagtttatcgttaaaaaatatacaacttttaaagcgataaactttaagaaaaaatatgtatatttagtttattgatgtcatattattctcatgtttttttttcatccgttcgtcatcgccacttactgaattctaccgtaatttttccccttaaaaattgcacacttggacacttggttcatttaagtccccctctcatgctctaattacgcgttcaccgctgactgaaatttgggttactagaaggattttgctcacaaacttttgactcttctatcagtcaagaaaaaggaaaacctttcactctacttgttaggcatgcggcatcaaagttttcttggtcagttttggacttgtggttggggctgcacggcctaatcaaagtgtgatccaaatgatggttttatgccatcatgggccagtggtgtcactataaattcaggcctgataagcactagtgttctgaatatcttcagagttcagaggtgaatacccaaaatattcagaaatcagtagtcatgagtttatacttttcagctggaacgaatttgctattgctcgagcaccgaatgtaggatcaactacttcacaatctccagaactccagaagaagtttatcactgaacacagttcatggacaaactacccggtaatccgaagaacaacacctgcaaaaaaaagatgtgaaagatcacatgtcaggttgtcttctccacaccgctttagctcacatggctggagaagcgagcatgtcaacttgggaagtgtgctaatgactccatgaaattaaaagatcggaacggtggggacgaagtaattaagcagatggggggctggtgctttctgacctccggaattcatgtctgaattctgaaaacacaccggacaaatgctccggtctgaaagatgacagccgttttttctctgttccttcctcctcgcttttattatggctttctgcaggatggtgcaggtgactgttggctcaattctggagaacgcttttcttggccattcactggcctgaaactctggatgatttgattggattgacatgatgcattgtatcatatgatggcctacatgctaccttgaactcctcaattgatcagagagaatcagttgcatttgcaaaattctgcaatcttctcatttcaggcttcagagatgctatgggctgcagttgcagtatcctggcatcaccaacctgacggtccttaatcgtagaattattgaaaatcttcactttatctgcataaaagaggtgacatgtagggacacggacaggcatagatcactcgctcgctaccttcctttggcataggttaagttaataatcattgtgattctctgcgatttattctctgcttgaagagttgggtgagtgagaataataaactttgatgttctggccgtgcagatctctctccctttctcacgtgccacggttgttcttggtcccatccaagaatgggctcccactgggaaggaaggaacaaaagttcagatctatgatctatcgatctgtgtttcctcacaacgacagtcacagtaagtcagtaaaaaaatactcaggtaattaattactgtcttaagctgtaaataatttttgtttacccggactgttctgttcctaatcatcatcgagaggaggagttggagatgatgttgtggatttcgaggcgagcagctttaccacgagatgaagcttcgtctagttatagccagcgatttgacagtatgcgaataatgtagagtgtgatgtgttgtaattgcttcaaaattaatttgctttttattgaaggtttcggttaacttttgtgcacactcgccagtgagagtttggagcgtagtaacatggtttggtgatcacttttttgtagggcagtactgagttaattataatatttagaaaaggattaccatgtggaaaagggattatggtacaaccaaactgtgatgagcagtaaggtgtgcaagcgtcggttcggtctactgatgttacaacagcaaacgaggaaaaatcatggccaatcgcttgactaaagttggagagaattaaaacaggagaggaaaacacaaagcttaagacaatagaggagagaacaatgctgtgttctttcgagagagttaccaactcatttttcacgtgcacgattttcaaattactaaacgatgtatttttttaaaaaaagtttctatacgtaagttgcttacattaattcatatttcaaaacaataacaaatacttaattaatcatgttattttaaaaataagttaatatgatttttaaagcaacttacacgctcactatacttcaaattaaaactaattaaagttaaatggtcatgtcttaacatgtccagattttaacatgttttactgccttacacgtccactgtacttcaaattattaaaaccaataaaagttaaacacgggtattgatctcacgagcatcatttacaaaacaatgcgaatctgaacctgtcaaattactacagctttgcaaaaaacaaaacaaaagaaaaaaaaaagataaaaaaggcttaaggcgaaaggaagtctcagacctaaaagagggccccacattttctttcaccttctcttccattccacctctccatctcgccggaatctcacctccgatccggcggcggcgccgccaccgacaccgagaaggggcgtcccctccctccgccaccgcgcgcgcggcacgaagagccaccggagcattcaggggaggggcgttgtaaaagcgcgggcggggggaaggcggggatggagtcgatcatagcgcgggcgctggagtacacgctcaagtactggctcaagtccttctcccgcgaccagttcaagctgcagggccgcaccgcgcagctctccaatctcggttgggatccgcttctccggttgaggatgccaatttggtcgcctccgggtgctaactttttttttgggcgtgatttgggtgatgcagatatcaatggcgacgcgttgcacgcgagcctggtgctgcctccgtcgctcgccgtcgagaccgcgcgagtcgggaagctccagatcacggtaatggcgggagccctgacccggtgcctttgtatatgtcagtgtgcttactcttcccggcttctccccctgaaggcttaaggggtgcatttagtgttagatttcttattgtttggtttccaaatttagatgattttcgggagagcattgttttgcactttacttgcgcctctgcgtggtagaaatctgtgatgaacttgtgatttcgctctcatgtgatagattatagctctgggtttgaaacgtttgtgtgggaggctaagtgaatgatgattaggaagcagctatttgtacctgtcttgacaatgccatgaaatttggactcccattaatttttatcatgtggccatacctgtgaaaaatctagagaaataaagctgcccttggtattccttgcgcatctggttattgcaagttttggttgggtggtgatctcaggtaaatttggaaaattaaaatctatactccattagcattgacctcaaagcttcaggcaattattgaatagccattgggtacttgcaacttttggtgataagcttatttcgtttccttgctacagcttccatcagtgtcaaatgtgcaagtagaaccaattgtggtgaacattgataagcttgacctcgttcttgttgagaaggacaattctgaagatctttcaagcactagcaggcaaattcattcttctggctctggtctcatatggttgaatgagcacagtcatttactgatttcagtcttctctgtcattttgttttggtttgcagtgctttatcgccatcaccagctaaaaacagcggatatggatatgctgataaggtttatttctttgaccttgatgttcaacgtaaacacattccaaacttttactctgtaaaaaattcaatatgctgtctaaaaataaaaattgtcacttccagttatccatgatggttgcatccaatgcacctattttgctatctgatttgataattcttctatattcttatgtgatcttgtctgatattctgaaaagcaattctctgctcttttattacaatatatacaattttgaaaaaaaatacgtgcagaaaattgaactatggatagggcttaatttgctataccgtggttagattgcagatggaatgacagtccaagtcggtattgtgaaccttctattagaaacacatggtggtccacgtcatcaaggaggcgcaacttggtattcatctttgtttgaatgatttttggccctttttcttatggcttagctccatatctcagttcttgttcatttctcttattaatatctgtttcatgatgtagcttttccctgcaatgtttttctgcaaacaggaacattcattccatctttccttttcaggtcaccaccgctagcggctatcacatttcgtgatcttgtactgtacactacaaatgaaaaatggcaggtactcttgcaaattagattagcattaaatatagtaaatgattgcacttcagtacctgattagaatgccttttatataggctgtaaatctgaaagaagcaagggatttttcgaacaataaaggattcatttatatttttaaggtttggtactctccttttctctccagaagattaatgtttatttatgttgctaactgttctattgacatttcttaaaaaaaaaactgttctattggaaacataatgaactgagaaatgctacacttgaaaggatttatgaccacacacatttcttctttcaaattcacagaaattggaatggcaatcactgtcagttgatctgttacctcatcctgacatgttcacggatgctcggtttaactcttctagcagtgaagatggaaaacgagatgatgatggtgcaaaacgaatgttttttggtggtgaaagatttttggaaggaatatctggggaggccaacgtgagtgcttttgaacttcaggacatatcatatggaactcgatgtttttcttttcagtttctcttgaacttccctctttgtgtgcttggcttacacattgctttgaacatcagatcacagtcaaacgaacagagcaaaacaatcctgttgggcttgaagttcagctgcatattactgaagctctctgtcctgccttaagtgaacctggtatttggttacttttcatgatgcttgatcccttccctttctgaatgctgtttgaagtggtatttgagcttgaatgctattttattcaggtttgcgggcttttcttcggttcatgaccggggtatctgtgtgcctaaacaggggtgatgtggatccaaaagctcaacaggtttgccttttccatcatgcattttaatcactgcattgcatgcagtacagaagtaggatgtttattggttttctttgtgtccttatttcttttctgcttttcttttttgaccagcttgcagaagctgcaggatcttccttggtatccattattgtagatcatatattcctctgcattaaggatgctggtatgtaccagctctggaaaacttcaaatatgctatgtttactattctattctgactttaaaccattttgtcaacagagtttcagcttgaatttctgatgcagtctttattcttctcacgggtaaatttctttaccttccaatttattgtactgatgtcatctgctgatgatatgattgatttaggttatgtaatttatcttattgtactgatgtcatgacaatcgtttttaaatttgttgaaggcaagtgttcccgatggggggatttcaagaaacttgtcttgcataaagattgccgggctctttctgaggtactatatgttactccctctgtaccctaatgtcgtgaccgagaaaaattaccttttcccaaacgctagtgtattaatccccgtctcaggaaaagccggggtacaccacacaaacatgatacaaaaggcacatctttattatatcaataatatttacattattacaaaggcactttaggcctgacaatcaaaaataaacagcagcggactagcgggcctacggctccatcttcacaggcgctcaactggggtataagccaggactccacctaggacatcttctccaaagcttctcttactgaaggggggaaagatagagcaaggatgagtacaactacagtactcaacaagccacaccgggagatgcacgattaatgcaagggggtacaaggggtaataatataggggttaagttttgcagtaaacagcatttaaaagacacttagttgctcaaagctattttgtaaagacgatcctagagatacacaatattattaatcaagaccgtgaacccacacgaacctgccttaacccaaggcgtacgatgattcagaccgaactggcaacccgacctgggtcccagctcgtcccaagccaatccgggccaaccattccacattttagttgttaagcaagttttaagaattaaaccactaacttgggtacattgctaggcttgcccataatcgagggcgcggctattcgaatagattatactctgatcagaggtgtacatctttacccacaagacacatctttactccgcattccatggccgtggaacccgtcataaagaatgtgacataacccctttacccatcctagccatgacaaaagcaccgacccaacctcgcctacggccagaatcccgggataggtaggctaggattgaacccctagcagcagaacaccggccctgtgccatgacatctcgactaccgagccgcagcccgtgtagccttcatttgccctagagatgtccatcgagccccgatttcgtccatctctatccgtgtcctcttgccaggactagactgagcaccgagttaagccttacccattagacatgtggttagtacagtagtgctttgcaatagaggcccgaagactggtccttacggtggccgaggtgctcctaggaaaaccatgcacctcgagcccaacctaaaaccattttgggaggtttgaatagaggggggaggtgtgtgttcggagacctccggaatgacagaagctacgcgaagcacacaagcaaagctacaaccctgtaaagaagcaataacaatacataaaaagaaagcacatggttctttaggttataacaaacattaagagacttgaacgggtcgattcggagttcgtatggccaaggcatggtcatccgaagtttaatgctgttatatggagatttgcggattattataattaagctttgcaactataaaacatgtgtaagctctagcctggaaaagacaagaaggctgcgctgctgacatgcggaccccacatgtcaacctaagggaccacggtggaccgggtacacagagacagtccacgggtcgacgaaagcggacctcgtgtgttaaccgaggcaagtggccgacaaacggactctactagacaccacgtgggctgcacacgtggaaaccacgcggctaccgagcgggcacactaacacggtcaccacacgcacacacgaacgactaccgacaccggtacacgggtactggggtcgacaaccacacaacgggcacggggcaacaccgaaaggacgaggacggagcaacgagaggagggagtgggccgggaaggagaggagggaggggcggcccgggagaaggaagggagggggagggagctggtccgaggggagaggaggcccgagagagaagggaaaagggagggaggagagaaagactttgggctgaactcggcccaaaggaggaaggaggattatttttagttttctttttaataaactttcttaattgttgttgttgcttaataaatatttccggtgctctgaaaattcaagtaaaaatttgagggctccttttagaccaaggagaatttaacaaaaattctccgggccacattcgaatttttcttgtacgtattttagtgtttgccaatttcttttcgaattttaattaattctattattccttttagagaatgatttttatttcgggatgaatttatcaggacgtgacacctaatataagggattttgacattttgcttgcactgtttgatcactcgtcttattcaaaaaattttggaattattatttattttatttgtgatttactttattatccaaagtactttaagcacaacttttcgttttttatatttgcacaaatttttttgaagaagacgagtggtcaaacgttatatgaaaatagtgaatattccttatattagggggcggaggtagtacgtgcatccttgagtcctttttactggagattatatgcacctggaagttcatcgtaattcacttgctcagttacaatacatactaaattcagtgcattttgttgatgcctataagtatcacatgcattaagcccaacagaatttagttgagtgcattgctaggttaccaaaagatgcatatggtgcaaaataggatacattcacagtttaacttttcgtaagtaagggaatttgtgttctacctgtgctagaatttttgtttgagctatcaaagcaattgaagaacctctgttcgatcctcatgtactgacatgttatttctccagggacacattttctcgtccaccatgcacattgatacagccctctatgcaatctgttccacaagaacctccacctgtgcctgactttggtaagactttatgatacctttgctgagataaatgaattggtcaagtctaacgcctcctattgaattgccaggtcaaaatttttgtcctcaaatccatccatttgagaatcagcaattggaattcacgtcaggaattcctttattttccctctattgtcttcagctcactccttccccattacctccaaagtttgcttcaaaaactgtcatcacatgtgaacctcttatggtgtgtctccttaacattgagagtgaagtaatgctcaccctttttttctgcttaactaaacaccgcccatactttctcattcctaggtaaccctccaggagcaatcctgcttaagaattgcctcattcttggctgatggagttgtggccaaccgcagtgccatattgcctgattcttcaatcaacagtatgtcattttatattaaagaatttgatctctctattccattagatgctgaggaaatcacgaggtacagtggaactaagaatgtttgcccgcaatcatcatttatgggggcaagacttcatgtggaaaatctatacttctgcgagtcaccatcagaaaagtgtctgttgctaaaccttgacaaagatccagcttgcttccttctctgggggtaccaacctgttgatgcaagtcagaggaagtgggctactcgagcttctcatctaagcctctcacttgaaacctctagcacttcgaatgaacagagaacagttaggggctcctctccaagtttgtggaaatgtgttgagctggatgacatccggtttgaggcagctatggttacagctgatggtagccctttgttgattgtgccacccccagagggtgttgtgaggattggtgttgcttttcaacagtttacaaccaatacttcagtagagcagttgttttttgtgttaggtctctacacttattttggccaggttggagaacggatttcaaaggttagcaaaggtaactgctctgcgacaaagacatcagctgacaaacgtgagagaaaactgcctagtgacacagcagtgagcttaactatgaatagtctccaactcaatttcttggaatctttatcatcaaatgacttacaattgcccctggttcagtttggtggtgaggatctgtacctgaaagtttctcatcgcactcttggtggtgcctttgcagttacaactaacttgacatggaaaactgtctcagttaattgtttggaaggagaaagtgctatatttggtgagaatggcactgcagttactggtgaacctaatattttgttgcatgaaaatgggcatcccaatatgagagctgtgttttgggttgaccaccggaataagaaccagtctaaagaagctcgatttattgacatagacatcactcacgtaatgccttatgacatgcgggacatggagtgccatagcttgagtgtatcagctaaggtatctggtgttcgtcttggtggtggaatgagttatactgaatctttgctgcatcgatttggtatccttgggcctgatggtggtccaggggaaggtctcttgaggactctgaaagatttatcctctggtccacttgcgaaactattctcgccatctcacctcaccgacaaggaaggtagtgaattttctgtctttgccatttaatttgttaattcatgctggaaattttgttggtaagcatgcatgttgattgcttctgctcagttgcgagatatttttgctgtttttccttgtattattcatggattcttccccgttccccttgaattgcagatggaatgcccaattccaaagacaatgactacaattcgaagtttgacctggaggtgccagatgatcttgatgtgtcaattgagctacgaaactggctcttcgcccttgaaggcacagaagaagtaggagattggttatcgcctcatggcagtgatcatatcagtagagaagagaaatgttggcataccacattcacgaatctacatgtgtcaggcagaagtagtgatcggcctggatctgcggagaaggtgattcacaaaagggcccttccaatagaacgttttacggtatgtagtggattattttcatacttttgcatttctatgtggcacttttattttttatccagttcaattctgagacactatgctgcacttgcaggctggaattgaaggtttacaggcaataaaaccttgcctgagagatcaactaattggaaatgcaacatcaaataatcttcaaacaggcagtgtttttgataacacaagtagcattggtgaccaaggtgtcgatgttgaagcgaccatggtcatttgcgaagatgagattgaaggtcccaagtggacaatggataatgtcaagttttctgtaaaagaaccggtatgaacatcttctgaatatttgtccaaacctctcggaaattaacaactgcttcctgaactagttctgtttgtttgactcggcagattgaggcagttgcaacaaaagaagaattagagcatctcaccatgctttgtagatctgaagctgatgcaatggggaggatcactgctggaattctccgtctccttaagcttgataagtctcttggccaggggactatagaacaactcaggaacctaggtatgtgttccctacatgtaccctgatttattttcttgtagatgccatgctaccctgtgttttggacttttccccttcttttgctcctttttggtttgctatgaatttttactagtaatacactgctatcagctactccttctgtttcgtattataagtcgtttgactttttctatagtcaaactttgttaagtttgaccaaatttatagaaaaaattagtttcaaatatcaaattagtttcattaaatctaacattgaatatattttgataatatgtttgttttgtgttgaaaatactattatatttttctataaacttggtcaaacttaaagaagtttgactatgaaaaaagttaaacgatttataatatgaaatagagtgttctttatctaactcctttgttgggtcattaaatgctgcaaagaggagatctagttacggttttttatgcccaagtcgaaaaaacaatcctagataagacaaaactgtctccaaatttttcatcgggggtttttgccttggtgtatactgtcaacaaatgccacctgggagttattttgatctgatgctttgtgcttcagcaaattatgcagcaatcactattatttggttatatgccattgcttttctttcttgtttatgttactgtatttttatattccctcgtacaatttatgctgttaaaactgattcttttttggaaaatgcttacctacttcattttctcaaaacaattttagattatcttatgaaattgtgatgtcccaggaagcggaggaatcgacaatactttttcacctaggaagttgagcaggcagaacagttttggcagcataggtactcctaggactcctaatctgcactcaactacagatgcaggaacgaaagagttactggaatcaacagttgcttcattacaaatcgaaatcttagaatccaaggccaaatgtacagccctcgtttcccaggcgagcggtgtggaggatcagaaatgcgccgaagacatcaggcaattgaatgacaagctagagagcatgcaatccttggtgacaaaattgagaactttgatctaagttgcacatagttttttgtgtataggttcgtgcagtccaaaacttggaagtggctaatgctgtacttcctcttcattattctttttgtgtacatctttatgttccttggggtgtatacaggtggattctggaataatgagctgacacgcagcaaatataaaattttgtagctggaatgtcacatgtagcactgtgttcaaaacttcaagtgcagtcattaggaataacatttttgtcatctgtatgtgactcatgtagtatcatatgcaaagttttgctgttgtcacatacaccatctttctactggtggactgggtgttttgcgaccaaaatatgtatacataaataattttcaaaaagaacatatgtactaccaatatactctctgttttatattgttttatattataagtcgttttgatttttatcttagttaaacttatttaagtttaaccaaatttgtaggaaaaaaatatagtagcattttcaacaccaaacatactatcaaaatatactaaatgctagatttaataaaactaatttagtcttttatatattactaaattttcttaaaaattaaatcaaacttaaaaagtttgtaaaaaagtcaaaacgacttatagtatgaaaaagaggagcaagtttttcctctgatatctcacttagtactaatatcagcagtgaacctttatttttgtcatgtttcaattttttgtatggatttatcccgtgcaaaaattttagtaatgagaacaagatatgaggggataaatttgtaacaaaaatatttgaagtacaataaacctattggacctagatatatgtttgtatataggtgtattttatcggcatactcaatatacacgaaggcaaatgggtcattttcatgcccctccatattggcaatgtgacatgtcctacatatgctaaattggcaatatgtaaagatttactcttcaatgacattttttgtaatttcatccaaaaagagtggcatctcaatagtctagttgtaaaaatcgaactgaaccaagggtttaaccaaataaaccaaaaccaatgcctagtccgaagatataactgacttgagaaaaatcatttaaacccagatggtttactacataaccgaaggaaaattggggtggcgtagggattgaaccccccacggtcaaggcccatgggttctttcacaaccttacataacccttaaatattttcataccaaaaatgtataaaaaatgaacgcatcgtattttagacctaaccctcaaattttctaatcaaaatagttgggctcgttgctacctctatttgcatacatgcgtgcgcacctgactatttaggttagttgctataatggttttagaaaacgaaacaaatatatattttatgttgattattaaaccaaaattctctcaataaaatatataattttattattttattattgaaccgatggttgaaccggtgaatcggtggattcattcaccggttcgaacaccggtcgggtttagagaggcaatccgccgccgccgcctgcgccgatccccatccgccccgcgagcgagcagaggcggcgctgccgctcgtcctgctgcttccgccgcatccacatccttcgccgccgccgccgccgcctgcgccgatccccccatccatcccgcgagcgagcatcctgctgcttccgccgcatcctggttagcacatcctctttcccatctctccctctctctttttttttatcgaatttgcgttaaccctagcttctgttgcagaaatttggcttaaccttgatgtttgtttgttcccaaaaagtttgggggtgttgaactgaaccccccatgccccatgttagatccgcccatgaatggatcatgattcactccaaaacactatggagcatcctgttcctggagaggagcatgaggaggataacagcatgaaagtggatgtggcatttgatggagtgcacagcccgttccggtacaggcacaagaaaaggtccaaggtttgggaggagtacaagcccatctttctgaatgggaaggttcagtttgcggagtgtctctactgccataatcgcctcagctgcaaagattccaacggcacaagccatctatggcggcatcagaaaatctgccctggcaaggaggaagcggcgcagaggcgacagaaggattcctacttcccatgcggtataccattcttgcctattctgggttcattcattactcaatagtgtagataagttaacattggtgtggtttaggatcttgagatgtagatattcctttataaaggcgatttacctcaggaatataaataacgtttccatattttatatgcacagttttggtgaatgagaacgatccagtttcaccccacgatccggtcaatgatgttattacagagacgcttagtgatataaactcggtaacacccagcggtaacagattcacgtcaaaggtgtggaaggagtttacacctgtctatattgaggggaaactccaggctgcagattgcattcactgccagaagcgcctcagtgcgaataagttcggggggagaagccatctgagtcgacatcttataacctgtgcaggacgacgtggacgtggagggggccaaattcatcagaagggtttattttatccttctagcgtgcctagtttgaagtccagggtgcaagatgagctctcacctgccttgacaaatgggaaggttcagatcgcagaatactctagcaagcttctgagggcaagtagctctggtgactcgacccctaagcccattcgagtggtaccagcagagcattccgtgccgactccagattatacaagcctgatgaaacagaggacctcatttgtgaccactccagctggtcaggaaacatctgatccagacctagtcgggatgatagctttgcatggttatcctttgtcaattgtggagcacgaagaaatgatgagatttgtaaagaaactcaaccctgtggtcaatttagtctctcgcaatgctatggaagaacattgcttgacactatttcagaaggaaaaggaaaatataaagggtaaaattgcacatttttcccgacgtgtctctctgtcagcaagcatctggactcctgatggacctgagacaacagtaaattacctctgtttgacagcacattatattgatgaagactggaaagttcataggataataataaaatttggaatgttttggtccgcgcctgctgatttggaaaggatgatacattgtatggaagcctgtgtcccagagtctgagagcggatcatataatgtcatattggatgccattagagattggaatcttgatcagaagcttttaagcttgacttctgttggtgaagttaggggtgacaccaatacttcattgctaaaggaaatgcttatagagaagaagtgccttcctattggagggacgctattcaatgttgcctgtgtggactatgtccttaacagtattgttttcaaagtgcaagcagatatacttcgtcttgttggtgacatagtaatggattttttagtgtcattgacccagcagcagcttctggaagttatttcacagacgggtctaaagtgtccacaagaagatgctaagtggtggcacaaactttattttagacttgaagtgcttttgcatttcaagaagtcatttccttctgaagaaagggtgtccccagaagatacaaaaactgctgagtccgtttgcaagattttgaggacaatttatcgtgtcattgaagttatttccagccctagctctccgacagcaaatatatattttaacgagatatggaaagtcaggacagttttgcaagaagaagcattaaatgatcacagagaaatagctacagtggctatggtgatgcaggaagcattcaatgagtattggcaaaattcatatttgtggttggccatacctgttgtgctagaccctagattcaaattcagtttcattgagtttcgtctgaaacgagcttttggaacagattcggcaagctacctatctgtaatacgtgaaacagtccgggaactcttcaatgaatactgccattctttgaatcaggcaagtgatgttgtttcaaacagtgaagctttgtgtgcagatgataatgattcgttggaagattgggatcagcatctccatgaacaagcaagtcgtcagctatcttcggagcttgatgattaccttgaagatggtttagttcctagaaaggatgattttgatattttaaactggtggatgactcatagtactaagtacccaacacttgcaactattgcacgggacatcttagccatgccagcatctgctgttcaatctgaagcagcattcagtagcagtggaccagtaattccaaagcaccagagtacattaaacatcagaacaatcgaggcacttgtttgtactcgagattggatgagataaaactggtaagattctataaattgctactcagctccatcctatctttgtgattttggtagtgtgaacacactgtgatttagtccatgttttcttattaccagaatcttgtttccttgttttcctgtattggaagtttggaaccatactatatgatcagatgaatgtcagaaaccaaagcctacaatgttagtaactttatatggaagtacatattagaatcttacatgttcatgtgcaatcttagcagctacatcactttaggatgttttagatcatgcttgtaatttgtaattgaaacattttgatcccattggcaatcatgaatatcttgttctgtgattgcatgctttggatcacttaataagtttgtgcgttatagtttgtgtccatataatcatgatgatatctcattaggaacttgattcctcacatctttttgctatatgctcttacatgacaaaagaaggtcgctgttgaaatttcacttattaaatcaatgcagttctggtatatcctcatccaatctattcatgtgcaattgcttgaaaaatggtatgctgcagtgaactgttgagatgggttgcatgcagctttcgccggtggaagatttcaggcagtgtatgatggtgcttctgaccaaggataaccgctctgatgatcgagccccaacatggtgtatcaagcatttgggagctgttaaacttcatttcagtcgagatgtgtatgcatataaatgttactcccatcaccccatgcatttgcctggtgtagtgcagatgtatgccgttgtttagccaaagttcaggtcagcccagagccttaggtcaagtaggaactaggagttgtacgacgagaatgttgcaaatatcctctgttatgagcaattaatctgtgttatgtgcagccttgtttacctgcttatctgaattgtttgagggtacgtaggcaatgcgtgttgctgtctggtcctaatggaccgaatttaggatgtggcccactattcagcactatcccgtaaaggtaaatgttgtttaaaggcccaacagctgaacagcataaccctcatagtttattagagaataaaaattaatttataggtaaaatttgtatatatgtgtttttataacaacttaaaaactaatactgaaaaaaaattatgttgaacatatttaaaaatcaacttcaaaattaaatttgaaaattcaaacttgacttttcatttagcttgcgatgggctctagcctctggctagcatagcatgccatgtctgggagggggctggcccattggtcagacacaactgagccttctttttacatgggccggaattgtaggcccatgtacacagcccacaaggctattttctgggcctctatcctcctccacgccggggagccttccgtcgatgaggctccccgacgcgctcctccgccgcatcgccgtcaggaatggatagttccaaaaacccatcgatttaccacatgttccattaatgtaaataattctacatgctaatgctaaaatttaatttctactcccttcgtatcatttgaagtgcagccataattttccacactcaactttaatcattcttcttatttaattttttttaaaaaaattaaaaacataagttatgaataaagtattattcatgttttattatctcataaaaaaataattatcatattttttttcaaataagacgaaatattaaaattgagcatgaaaactcataattgtacttaaaatgggacggaggagtagctaagtagctagctaaattaagctagaagaagtcgatgccgcatcgcttctgctggaactccggcagcagctggccgtcgggcccgaccacgacgtcgcaggtggcgtgcaccgggtgccagtgcgacccccagaacgccacgcgcacccgtatcctcgaccggaccttcaccgtgaacgccacgccgccgccgccgccgcccgccgcggcggcggcagcgtccctcgccatcatgtccgtggcggcgccggccggcacggcgacgccctcgaacccgaccgccgacgtgcccctcggcggctcgtacagcggcccgccggtgaggtccttcccgtcgacgaccacctcgccgtcgccgcggtactgcaccgacatgtacacccggccgaagaagaaggcgaggtcgtggttcgggttgtggatcgtcagctggccggagagcgccaccgggccgccgccggactggacgccggcggcggtgaacgcggcgacgtggaaccgcggccggtgggggcggacgacgaggtagacgacgaagaggagcacgccggcgacgaggaggagggagaggaaccacgagcagagaagcttggtgcagcgcgtcaggtgcggccgctccctcggcagcgggcgccggatgcggccgccggcgatgaagcccgcggtggccgtcggcggctgcgacgacatggcggcgtattatatatacgtgtgcggcggccggcgagcttcgacgacgatgggatggagctcgttggtgcagcaaagcatgggcggcaaagcatcgccggagaagatggaattcgggagaggttaaggaggtgtgtacgcgtgtacatacgtagaggttgcatggcaagttggtttttgggtttcttttgttgcgcgtacatgggcgattctttgaggagatagcaaggaacaaaaggggtagcagtggccggttttcttcgtgttttggttctctaatctcctacttattttatttgaaaactagcatggtggcccacgcatattgcgcggctagcatcattatattttctgtcatataatagcatatatgttttctcaatgtattattcaaatatattaaaatgactacataattttaaattttgtactacctttacaaaactactaatgtataatattcatattgtattttatatatgtgttagttattaattatttttaatatcaaattttagttatttgtaaattatattcctatatggactctaggctcttctttcaatattatttatttttaattctgaacttttattatttataattgtatttctatgtggactttaaactcatcttttaatattctttaatttttaatttcgaatttcaggtacttctaaattgtaatcttatattaactttagactcttcttcccatatttttttaatttcaaattttagttatttgtaaattgtatttttatacgaactctaaactctacttttaattttattatgtttattccgaattttagttagttttaaattcctatatggactctatactctacttctaatattccatattttttaattcctaatttctattattttcttaattgtatttttatatggactctatactctacttctaatattccttatttttaattccgaatttctattatttcctaattgtatttctatatagactctatactgtacttctaatatttcttatttttaattacgaaattatattatttctatatggactctatgctctacttctattccttttttaattctgaatttcagttatttcctaattgtatttctgtatggactctagtctcctcttctaatattccttatttttttaattccgaatttcaactatttctaaattatatttctatatggactctagtctccacttctaatattccttattttttaattccgaatttcaactatttctaaattatatttctatatggactctgccttttctttttcttcgattaatgtgagaatttctaggccatgagagcgaacgtggaggcttccttttctatttctttaataatataatagatttcatattagtaaaatatttgtgtttgattacatggaagctagtggcacggctaatcagggtttgcaattttgaaacaggggcttttgccggtggggctaaagaaccgaaatcaccgaaatttcggtatttttaggccgatttttttttgaaaatttgatgtactttggatgaatttgaataaacttttaccaaattcacaaaaaaaagagaaaaaaactgaaaatttcaggagatatatgtgcttgctggtgggggcgaaattaccgaaatttccaaaaattcgtcccgaaattgcaatcattgcagctaatagtgttttcaaagatcaactagtttacaaacatcgatggtaattcgtagtgcagatggccgcccaacctgcccgagagttgcctccatcatttgggatctaagtgcgctcgcctaacatacgtggagagaaatagagcccgacagtaaaatatatcactcaatttctattaaatactggaggtgtgcaataaggagtgttaagatttcgggcaactaaatttttcaaaaatttaaagcgggtttctcacccttggatgatatatatttcaatggctctcatcaatcctctattatttatttaaaaatgactcttctttcatagataaaagtttaaacaacattttttctaacataaacatgaaataaatttgcaattaatattacaaaattaccggaaaaaatgttcaaacttggataagcataaatcaaaaccatttacaaaaaaaaaatgtagttcaaatgaacttaaattacacgtagcactataattttaggcttagcaatgtacaattttgggtgaaaattttcagacagttcaaatctagcaaatacatgtttctatttcaattaaggccagtaaattaatactactatacaggtagatgtaaaagttctgttgttactgcagatgttgatagtatggcgcaaggctggaaagtgatgaagaagcgagacttaagtttgagaagttgaccgagtagatatgccaccgtatgtacacaccatgtggagctagcttaatgacttggtatgcttcttcccccctggctagggtcactccatgaatatccacttcacaaagtaaacttttctgaccaaatggccagcgagcatatttcggcctcaagtttcttctgcagccgacatgacttcttgcttgtcgatactgctataatgcagaatcataattagcccaattcgttttttgatttctccatttcaatcagtaacacttaacacccaaaatcatacagttgctggatagcggtacattacatcacagtacttatcaaacatgtaacaccgaaggcattacgcaacattttatttccttgaatgaagcaaatagtttactttgattgtacatcataatacaaacaaaggcataacaaaacatatttcacaataattctacatataccaaggaatatcaaacagctaacacttcagacaaatgcagttcagcggttgtatatatatttgcagcctaattcacaaaggcacagtgcttcctgatctccccctgggcgccggtgagcacctgcatgttccccatcttcaccatggacgccgcgaagtcggcgaagaactccgccgggtagccggcgacgcccgcctggcggaggatgtagcccctggtgaaagggtcgagcatgagcgtctcgtcggaggtgaagagcgccctgcccctggcgatgtgcctgtagtagctggtgtcgaacgtcctgaagctccccgggtccatctccaccagcgtcgtcttgtcgccgggctggcacttgctcttcagcctcggcacgtagtacttgtccagcgtcgggtcggccatcatcatgccgctgaagttgtacagccggctggcgaaggatgaacaatgggaggttccaagagtgtgcccacctgtgaacaatgtgtcacttctcaaattgcatatgcacatttgtgatgagttcttggtaattaaacaagtttggattgcaattttgccatggttttgaatctctggctatagctgtttgagaagagtcttagccactatagctccattaagttcgctatagctgtttgagaaggtcaatcgctaaatatcttaacccgctatttaaaaccatgaattttgcaagtgcacaaatgagtatggtgctgaacaggaaacgatgttttgaccactcgaataaagagctatgctgtgtttgaggataaagtggtcttggtctcctggcttggttctgtactgtgccatgtgattagaactaagaaccacatagttttgtacttcccattttgttgacttggtatgcgcatatgataccttcctttattaacaagttgtatagtaattaaataagtgatcacctttattggagaatgctactgggatatatcgggatcagcagagtgtttaaaaggagcacaggcaacagaaccgagagttgcaactttcagtaagtacagtataaatcatctagggagctagtctatgaagattaaacattgaagttagtgaagaatagtatatacctagcagaaccacctgatcctttgcgtcaaggccctttgggatgaagaattgatacaagttccgcgtggcatcgaagaaggggggagggaggttgttcacagcatcatccttcactgatcttgtcccatccctccgcccagttggaacttcccagtgaggccctttggtctgttgcacaagggaagaatagggacttttctcaactatagttctagttactgtaagcagcaagaaatccaatagccacgtagaatatggtgaaaatcaaactgtgtggttttccactattgtcggcctaaaacagccaattctcaccacttagccaaactatactaacttttctaactaaagaatgaactaagattaatgaacatggaagctagttcttaccaagaagacaacatctctggctaccagagcaaggatatcagcacaggacacaactccagggcaggcttgctccagcttagctttgacacggtctattgtgccaaaacctcgcagactgaggtttggtattgattccttctcagatggtgatcctggtgtgctatccagaagtatagagccatcgcaaccctgcaaaacacatagaggcacatagcttagtaggataaactcaattcaaaatcaaaacagctcagagcatggtaagcagtatgcatacattcacaaaacaatcatggaaatgcatgcgaagtagagggcctgcgagacttggaactcgggatatgatcttggtcatctcatcacgaacaatgacctctgcttttggacatgtgtattggtaaaagccaatgtttagccctggtggattggataatactaaggagaactgtaggacaagagaaaggacaaatccgaagaggagtctgtaaggcatgttgtgcatgactactgtggaaccactgcctatgatgaaagagttgccttctatgattgttgaggcaaattataacttgcagcctgctttatagctcagttgcttaggttgtactatagtaaacaagtgacataaaccatttcccacagcttcattttatttttcctaatgcaacaagcagatggtctaagacttggagatcgagattttacaagccctatgagttgtgtgcatgtacttcaattgaagaatacgcaagtcttggatcaggcatctagatagtattacctggtaatattgcataattagttggtggtggtcatccttcgtggcttgtgcacttgtgagtaatacaggctcttgtattgatgaataggtcacgacatgttgctaaaaggtaatactctctagctgttctaattttttattttaaatattatatgggttgaatttattctggtaaagaagttcagaaggattcaaagatatgagataatatatcagtttatccgttgtcgtttgttccagaggaaattgtgtatgttcatgcaaagtggaaaagaaagaaaaacaatccatttcctgttttgttagtatttaagggaaccagggaatataatatggttgcctcgctatgacattatcactgctagtttctcttgggattgcatctgaacactaaaggaactgcccataataatttcttaactggcaccagtcagttaaagtaaataatatcaaagcaacaacccattgtttgatgaaatcaatcttcttcctttgaaattaagttgagaaaaaaaaaggttgcatgacagttgtgctcgtgtcaatgaagcaaatcaagggagaaaagttagaagagaatcaacatgatcactgctagctaattattgaatgccaaacgggtgcagaagcatctcaggcaatgtgcagatacttcattttgaagcaaatttaggtttgatcaagcatataaacactctaagaaagatgagaacatgatgtgcaagttatggaaaaagattctctatgtttgaataaaaaatgcaagagtttgtgtaagtaaaccttcagtgaatccctatcatactgagaaaatcggtccattggtcagatattagttgcagcctttaagttaataaataactgctgggctcaagataaccttccgctgagctctccagagaataataataaaaaaaaggtgaaaacaagtcaggagtagtgaacagaaccaatggtggacaccatagtgcgtgggggtacagatgcacccctaaaacttgaaaaaacaccaaatatataggattacatgtacgtatacaatgtgcacttagataagaatcccaaagtgttaaaaattttgtatgtaatacatgtcaaactttatttttctttatttttttagattccattggtctttatagggcatattttaatttgaaaacaaaaattcaagattaaacattggccattgatttctcagaattatattcttaatagctataaagccaatattttgtgaacgcactttgaaatatgaatctatgggcacaaatttcacattaaatatatattaattatattaatttgattaattgctggtcaaaatatacataatttgacattttgaaatttaaagatgccctataaaaaatcaatgcaggttttttttttctgtctgttgtaatggaatcatggaattttctctatcaatattccatactatctactagtgcatcattacatcttcacccctattgtcaaaatcctgcaccacaggagataacaatggtttaagtgttcactaccacatggcttgggcaatgtattcaattactcttggagtaactgaaaagtgatgtcttttggttgttcaagaattcaagtctaagacattcacagcaggtaaagaaatttttagttgacctagctcaaaatgtgtgcttcactcaaacagcaagggagtgcaggacagttttgaccatgaagttgttcaacaatggtggacattgacaagttcgaccttttccataggaattaaacagtactccaatttttacctcatgacttgttcatgcacataagaaaaaaaatgccaacccctttagtcatgttcagcagcaactcacagtctagttaatacttaataaatgttttctacgatattcttataggacatcaaaattgcttttaaaagagaagggttaatatcccataattattctgtctaatcaacgttatgtgacttgcaaaaacacatctacagtcctaaacaattatgggactaattaagatttaaagcacagtaacaattcagaaaattatttatcaaggaaagtaacccacagaagtcagatgaacaaaaaacttacactgaacgaacatgatggcaggtgaatttgtgataggtcaataggtcatgagctattcactgtttaactgaacaggcagaaattggttaactctggagtctgaactctgaagtgtgttgcggcttgtcaaagtggcccagaatttgaggttcatctgatgcatctatcagtggctaaaaactgtgatacaaatttcttgcagtggaaaagtttctgtcatattcagatgacactgaaaccaacttcctttccatctgttgtttcatctattacttctctcgtcctctgtgcatcctcccatagactacattctgcatacatgtttgcaagaacagcatagtttacagaactcccaggatctatactaaaaaggttcttggctgcagtttctccaagaagcatgtttccatgcaatttacaggctccaagcattgcacccagcattgatgagttgggttttaagtttgtcttctggacaagtttccatgcatcttctaactggcctccacgagcaagaaggtcaatagcagagctgtaatgctcagctcttggatcaataccatacctgctcatcatggaagtaaagtactccatccctttgtttgtcaaaccacaatgaccacatgcagatagaagagaaaggaatgtcacatcgtttggcctaacaccatcttccaccatcctattaaaaagagtcacagcatcttctccagaaccgtttcttccacaggcagtaataagtgacgtccaagaaatcacattccgatagggcatttcatcaaaagcacgcttggcatctgaaaattctcctgcctttgcatacatatcaaccagagcattgtccaatgcaatatcacccataggctgcttcttgcacatatatgcatgaatttgtgtcccaaatcttgcagaagcaacgcttgcacaaaggcaaagcactgagcttaatagaacaccatcaatccataaacccttccgatgaattttacagaagagctccattgcatcttcactgtagtttctatccatggtgtacccactgatcagtgcggttgatgacacgagatctggttcagagatggaatcatatatcactcttgcgctgctcatactccgacattttgcgtaagagttgataagtgatccgatgacaaccttttcatcccagtaacccaatttgatgatgcaactgtgaattagctcaacattgacagcaacaccgactattccacatgcttttagagcacttccaagcgtgtaatggtcaggaatcatcgctgtcaattattttgatgtaaaaaaaagaaagcactttcaattttagtgccaataccatcagcaaaaactaccttgcaatttcatgctaggacataataggcagcatgattacaggaaaaatgctcaagattgttaaagcaaaaggagggacggcataccttctttcagcattgaagagaataatccaagcgcatcaccgtcatgcccgcgttccacaaaccccctgatcagggcattccaggacaccacatccttcttccccatctccgcgaacagctgccgcgcatcctccacggacccgcacctcatgtgcatgtccatgagggcgctctgcacgaacatgtcgcccgcaaacctccccttggcagcgcacgcgtgcacctgctccccgctcctggcgcacccggcccccgcgcacgcgctggccgcgctcccgtacgtgaactggttcggccgcgcgcccgacgcgcgcatgagcgcgaacagctccagcgcctcccgcgggcgcccgttcctggcgtagccggagaccatggccgtccaggacacgacgctcctgtgcggcattccatcgaacaccttgcgggcggcggcgacgtcgccgaaccgcgcgtagaagatgacgagcttggtgctcaggtgcaggtccggaggagaggcggacgcggcggcgaccctgccgtggacggacttgccttgccggaatgcgcaggagctgatgcagcactggagcagggaggagtataatggggcggtgggtttcgcccccattaggagcgccattcgcgcgcgcttttctccctcctcggagcaattttgatctcccgagactcaacaattcatgaattcatgaatttatggcagggtttggcaatccaataatatgagcacgaaacacaccaggagcaaaaatctgaatatatttagattcagttctactaaccggcagtagaaatgagcagctgcaaatatatttttcatgcaaaagggctagaaaactgaactatacaaagttggcttcaatccataaatccaataaaggccttctgaagaatcaaattcagtcataccaccatcagttatccatctagcacatgaaaatcaaagtgtgaaaaaaaaggtgattggataaattaaacgtaccgttatgattcaatagcatagaagaaagattaaatggagaagaagaaaaaatggagatgaagaaaaaattatgtgcttttgcagattggaaagcagacaaaagggaatgaccaaattttttaggctgaagagaagaagcagaaagagataggacagaggggacgacaccaaaaacagttgaactgcagccgcgcagggacgctggtcgctggagccggcgaaggagctccttggcggcggccatggcgccgacggacgtgggtggcagcggcggctggagtaggacgcgatggttgggattggggaatggccgaatgggccctcaaccatttttgggcccaaaccaattttttttcaattttgctatatctcactcgaaagattttttcttatctctcactcgattttctcacttaaatttacagtgcattttcttgtaagttacagtgtaatttatgaaacttacattgtaacttttgtaagttacactgtaatttttgaatcttcgcatgtaaattttaaattttgtattggatttggtctttttcttttttattggatttggtctttttctcgaggatatggtaatttagtgtccattatggtgtttcttaattactttttactttttattatatctatcggattttaattcaaagattaaaaatctgtgtgatacgatcatcaaaatctgtgtgatacgatcatcaaaatctttcgaaagatgtataggtactcccattttttttaggcaccaaaccgcaccagcccaattgtgaaatcaaccaacaccattagaattccaagcatcagaagccgtaaagactgaaatgcgcatgaaatcaacaaacataccaggatagataaccaaaccaacatcgacaccccaattccaagcatcagaaaccgtcaagcgcaaacagattgatcaacaggcacgcgcaacagtggccggttacgaccatgtgagcaatgcacaaacagaatctcatctcggatcaaacatctcagaaacattaacagaagtagaatgataatatcatcgattggtaccgatgcacagtgaagcaaattgtactagtatggataatagtatcaacacaacttagggactctaaaccagaacacaacacaaccatgacacgatgatatgacagacgagcggcataggtataatgaagtccaatgctgcaccacagcacacgctcagagaccaccacggaggcgcaggacaaggtgcagggtggactccttctggatgttatagtcggcaagggtgcggccatcctcgagctgcttgccggcgaagatgaggcgctgctggtctggagggatgccctccttatcctggatcttggccttcacgttgtcgatggtgtcagaggactcaacctccagagtgatcgtcttgccagtaagggtcttcacaaagatctgcataccgccccggaggcgcaggacaaggtgcagggtggattccttttggatgttgtagtctgcaagggtgcggccatcctcgagctgcttcccagcaaagatgagacgctgctggtctggtgggattccctccttgtcctggatcttggccttcacattatcgatcgtgtcggaggactcgacctccagggtaatggtcttgccggtgagggtcttcacgaatatttgcatgcctccacgaaggcggaggacaaggtgcaaggtggactccttctggatgttataatccgcgagagtacgcccatcctcaagctgcttgccagcgaagataaggcgttgctggtccggagggatgccctccttgtcctgaatcttagccttcacattgtcaatcgtatcggagaactcaacctccaaggtgatggtcttgccagtgagggtcttaacgaatatctgcatctggaagaggcaagaaaggattggaattaacataggtaaaaaaaagcagctggagaataagttggcaccagatcctacgatatcggtactgtcagctcaaaatagatgaacatatcaatcacatcatactacactacaattggacagcatcattaatcataagagcgctgctcacagctcacaccacatcaacaagcaacaaccaaaaatatcttcagataataacaaaactgacataagtaactacaggacaacagatctatgtaagaacacagaataaagccacctagttctagcatctgacagatttgatttgcacgagtaaagcaaataaaacgggtaaaaaaacacagtacaacatcagcactacagttcaactaggcaaagagccagatacaatacagattaaattgaccttagaacccaagctctacagttcaagtaggtgtacacgatacagatgtaattctctaacccagctccacacaattccaatccaaatccaggggaaaaaaactaagaacacaattccaatccaaatccagaggaaataaactatgtgtcgcctaactcaacctaaagattttaacctaacgagctattcatctattggaacaatatcagaacaatcccatccgaactaagcacaaataagtaaaactaaatctgatcacaaaactcaaactatgtggcaggatcaaaacataactgtgaactactcttattatccatcattagggtaatatatcgaaacaatccccatctgacacatcattagggtaatatatcgaaacaatccccatctgacacatcattagggtaatatatcgaaacaatccccatctgacagaacaatctcaaaaccaatccatctattagatcgatataaataacacagatccctacctcgattctcacgaaaccctaaatcaatgagagattaagaggattaccctaaaatcgcacgaaaccgtaactcgattaagaggtggatcaccctaaaatcgcacgaaaccctgagagattgagactaactcgcacgggatcctcctacgctttccaccacgagcatcaaaatcgcgagattagacgggcaccacgagagattcgaggattaggacgaggtgattgattagttaccttgacgaggcgattagagaacgcaaagcttcgctccccctccccttcggtcgattcgactcgctatgcgattaatggagagaaaacctctctatataaagcgtgggcaaggcggtgcgaggcagcatccggtgcggtcaccgccacgcgtacggcccaatggcagcaccacacgtgtccatgtagttggaggcgcgacacgtgtccggtcccggtacgaccatccagacggtgcccggaaccaactccgcgtcaggtcatgccgcctctctttgacgaagtcggcatgcctgatcaagaccgtacgtttccgatccaacgatcaggaaacatcgtacttgatctgctataagctgcgtgtgggccttaataatcctctggggaaatatttgtgggctgaaatgaacgggatattgggcctagacaaaccagggcccatgaattttacggcccaatagattgttgagacctaattggctaagcccaactcgcgcactctgaccaaccgatcggaagttcgcgtccacgccgccctgctcctccgtcgccgccggctcggcggctgacccccgcgccgccgcaccagctgcgcgcgcgcgcgcgcgcgcccccaccaccgcggcctctccctcccacgcgcagagggcacgggcagaggccgccgcggcgccgtactcgccggcgcttcgtcggcctcggcctcgggtcgaggccggtggcggggcctcgtcagatcgccccccttcctgtgcagtaagtatttcccacggacccaatatggattcgttgttctaatcgatagctgctatcagagatgggttcttctgcgtgatttacctgttcttcacatcctctgtcgatatggggttgggtggggttcgtttcttgcgctaatgcaagatttgaacttgcaggcgtgctctgctgtgtgtgcgtgtgtgtggcaatggcgttgatgcggcggagagtcgggggctacatttgctcggagctgtgtggctcggttatgaatcagaggctgtactcttcgagggtggactggaagcagcttcggcctatgatcctcaagaggataaagaaccgggcaaaggagtatccaatcaagcgcatgattccagtagcggaggaggtagtcaaggctagagagattgtcaccaaaggtgtctcgacgctgcttcaagttgttcccatacattcatgcaagtaagggcgagaaatgtggaatttttatgtatttgtctgtttgtcttaacacttggggaagatagtatggctaaacaagtgttttatttgtagtagatcaacttcaatttaggcatgcactaaaaatgttccagaacatccagaaatggggcaacattacaagattaccagtcttctatagattaccgttgttattgtgtaccttgattgcatatagccatgattgcttttcttgccatgccaagttaagagcagctctctctgatgtgcatgtttgatatcattttcttgattcctgtcctaaaatattattgaatctttctaacaccttgtgtttctattctcactgaaggttttgtcccgaagttcatattggagctgtagggcatgagatgcaatcctgtcatggtttcaagcgtatgatcaagaaccagccgcataaatggggtccaggatgcttgaatgacatccttatccctgttgaatccttccacctggaaaacacgttccaggatgagataaaacatgaccagaggtttgatttccctcgtgtcccagcggtactcgagctctgccatcaggcaggtgcagatatacctgatgaagtttggcataggagtggcacgtcatctgcaatagtcagagaaaatgatgaaaaacctgctgcttttttgccagaagagcttagattcataggtcagaggacaatagaagcatgggaaaggcttagattaggtgtgacaaaactcctattggtttacccatccaaagtgtgtgagcgttgctctgaagtgcatgttgggctgtcagggcacaaggccagaatgtgtggggtattcaagttcgagggctggcgtggtaaacacaagtggaagaaagccgatgtggatgacctagttcctccaaagattgtttggcaccagcgacctcatgatccaccggttctggtcgacgctgggagagactattatggtcatgcacctgcggtcattgagctttgtatgcaagtgggcgcaagagcacccccaaaataccattgcatgatgaaggcgcaaggcctagcaccgccaattaaatgaggccaggggatctaaggagttgattgccaaattagatcagcaccatgatgttatacaggaattgtacagatcagacatcaaaagaccaatgcagagaaactccaaggttgcaaatgttgtgattttgcccaagacattagttctttgaagactgcatgttatcagaattcaggaggtcagaactaacacaattatttatacccattgatctgagtgagagccctcagatgataacaagggaaaattgtttctgtggacaacttcgtgcatggtaatttatcgactatcagcattgttaagtattcagagcgattactttgctgccctttcatttgttcatcctccatcatttgccaagaatacgggtggaagggctttatgagcctgctgtttggtcttcttctcctctgcttgactactgtaacatcattggtttctgctgttttgtgtaaactttctcacattacctagacatccttataggcagttctgttataagttagccatgtagagacgccttgttgcaagctgcaacatatggtgtggaacatcacagaggaatgtaatatcacttgctgtattgtaagccctagtcaaaatccctccttgaagctgtaatctgtgtacagatttttacctggggctccttttgctgtgccaataattacagccacgttggctgattttttttttctggagataaatgaatggatggtgaagtttttgttctttgtatttgaagttgaacattacctcgagtacttgaccccatatgttgctgatgttttttcagttcaagtaatcttgtctctctatgaatgcatcattctggaaattaaagattacttggttggtatttgatgcgtctaacctgttattaaattttctctgcaaaacgtgtcactcaattgtacttcttccgtttcaagttataagggaactgttcactttgatgcaaaaaaaaccttaccaaaatttggatgccaaaattttggcaacttaccaaaattttggcaggattttttatatagttaccaaaatttagcagcaaactaaatgtagccatttttttttgtaactttaccaaaatttggtaaggttgaaaatgacatcaaattgaataggcccaagatgtttttgattttggtcaaagtcaaagtattttaagtttaaccaaatttatagaaaaaaatagtaatatttataacaacagcatagtaattgaataaattttcataatatatttttcttggattaaaaatattattatattttttctataaaattagtctaatttaaaatagtttgactcgtaacctgaaatgtatggagtaccatgtaaacactttttaccgtatgtggccgtaacctggaaggaaacattagcagaatttgcaaccgacatgatttccttggctaccaatcttccttctgcgcgtgcaattttggtacttccgtcagttccgtgtcgccgacgtacccggatagaaaccgtgagagccaagtttggcagcggcgtacgaggaggattctactcgcgacctgggtagtggggaccgtagatgcgccgtcggacggccgagatcacgccacgtctaacaacttatccgacgtggactccacgtacgacttggactcctcggcttgaacctttcgcgtcccctcataaatacacgcgaggaggcgccccctgattcgtgcaatgcaaaaaacgaacgcgaagaacacgaatcctccggcgatctcgagcgcaacgatccccagagccaagaaacccgccgctgccgccgtgtcgccgtcgtcgaagttggcgagcagcaacaaggtcaccaaggtgtcgccgccgccgccgcagttgtccgcgctgtgggccgccgcctcgtcgtccgacgaggaggaggaggccgtcgccgtcgccgtcgccgtcgtcccagcgccgccgccgccgcagccggcgagcaagaagggaaagtacgtcaagggccgcgcggcgtccaagaacaagtaccttgtcccccgccgcggcgaggaggatcaggcggcggagggcggcgggaacagcggcagcaagttgatgtccggggcgccggaggagttcggcctgccggcggggacgttcgacgcgttcgcggacgcggagggggaggacgccgccgcggccgcggcgccggcggcgactacgtgcacgtccgcgtgcagcagcgcaatgggcggaagacgctgaccaccgtgcaggggatcggcggcgagtacaactacgccaaggtgctccgcgacctcaagcgggagctctgctgcaacggcaacgtggtggaggacaaggagctcggcaagatcatccagctgcagggcgaccaccgcaacagcgtctccgacttcctcgccaaggccggcatggtccgcaaggacaacatcaaggtccacggattctaagtccagagagatcgtatatcacttgggttttagtataggttcttaattatcagttttgattagtataggttctggttcagtttagcagtgtgtcgtgtctgccgtaatggcttgcagtcgtcaggttgatcatgttaagcctcatacttcttttccgtattggtgtcaatggatgattttaagtatatcttgtttgcttactgttctctgaatacgtacttatccttgtgatgctctgcactttgcaacttgtgacacagatgatttttactggtgacaaaaaaaaattaaatactgaaaatatcgctctgaacaaatttgttggtgatacaaacaagtcaataatttcagagatcagcgtagtcgaagtcgtcgtcaaaatcttcgtcgtactctatctcacttacgtggctatgataatgtggtattgagctccacgggctgtcgtcgagcacgctccggaatcggctccgtaggaacgtgacggcctcccatgccgccatctgcttcgcctcctgcaccgacgacccgacctgcgtgaaacgcaagcaatcgcggttgagaacgttgacactcacggttacggcatggtagtcggcggcgccatcatcatcggcctccgtggtcgtcgtcgacgtcgtacgacggcggcggcggctagcgctgtaatagtaggttggctctttggttgctcccatgccgttgatgacctcccatagcagcagcgtggctccgaactccgtcaccggcggtggcaccatgctggcttcgacgcccaggtagcgctagctgcagcatgatgcactcccatggcgacgacggcttatggggtttttgctggtatctacggaagcagctggtccgcatgtcgtacgattgcaccgaccgcaatgcccaggaggagctgatcaccggaccatcaccggcggcgacggtgaccaccatgttcctctcgtcgtcgacgtaccaaatctgattctcggtgatcttgccgccggcgccggacgacgtgacatcgaacgcttggcaagaagcgtcgccgatgaagagcgcgtggccacgcagcctggggattctcgtcagccgcgtcttctttcgccaggatccccacgtctcgagtcgtgctcctcgaccacgtacaccttgaatctagatgtgtggtagcgcgccgcggcgcggccgccaccggtgtcggggacgcgggctctgccgaagtctctggaaactactagaaccttccccatcgtgtggcaggcaaccaggtagaactcggtgcggccaaacgccggcgcctgcttgtcgacatgcgtccaccgccactggtcgctgggcaagtgcgagtagtgctcgatgtccgcgtcgtcgaaggcgaagatctcctccgcttcggtgacggcgtacagcttcccttccaagaacacgatgtcttggatgtagaacaccctgctaatgtccgaccaagcattatcatcatcatcgggatgatgtttcttcttcttcctccccgggaggtggcagacgaagatcttgcctagccgcgccacgaacctcgatcgggtcggcgcgggcgatcgcagctaccgtgatgccgccgccgccgtcgccgtcggcggcggcgggggatgcggacatgacgaccttggtgatggtctctgggttggtccacatcggcagcttcacggtcgccatggtgaaagggttgaggaggaagggctggtagggaggaggcgacgacgtgggcaccatcgccagccagttgtcgaacgagccccggcagacgacgtcggtggcgccgccgtggaggctgcagacgcggtggatggcggcgtcgtggaggctgacgcagtggccaggggccacgagccacgggacggcggggcgcgggtagtgcgaacgctcggcggctcgccatgctcggcacacggcggcgaagcggaggcggtctcccagggcggggagcctctgcaggacgtcgcggagcaggtcgtcggggaggtcacaccacaactgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcagggcggcagggcagcgggaccgggcggcatccacgcgggcgcgcgcgagcaacggcccgcggggagcggcagcgagggatggggagacggagagcgagggggggcgctcggggcggcgcgcgagcagcgtgcgggcgaggctgagcggggggggggggagagcgcgccgggggagagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacagaccaacccccctaacaagaatctcgtccccgagattcagcacctaagggagcagctccggaaactcggcgcggagaagatcttctcgttcccaggttgcttcatcttcagaatgattgctccattggactttgtagaacttgattgtcttccttcgagtctgacgttctgcttcttcaagaaccttgatcggtctttccttgtaggtcagattcttttccagctcgatattacctaggggaacttgctcttctggaactcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcctcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaggggttgtagcagtccagctggcctttggtgttctgccttgactctttggcaaatgtcacacaaggctacgtattctgcgacatctcgcttcattccagcccaccaaaagtatgccttgatatcttggtacatcttcgtacttcctggatgaatggagtaagcggactcatgagcttcctttaggatgagatttcttaactccttcttggccggtacacagatgcgtggaccgcaccaaattgtgccttgatcgtctatggagaaattggtgtctttcttctcctgtattctttttattaattcttttatcccttcgtcgtctttctgagcctcccggatttgcgactctagggtaggctgtactgtcaagctggcagggacacctgactgcaccacggtcagccttaacttctccaattctctgcacaggtgatcttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcgcatctgttccctattaagtagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttttccttctttaacagctcggtcataggtctggctagcttagagaatccttcaatgaatcttcgataatatccagctaagccgaggaagctgcgaatctccgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcattcttagagtatatcaggatgtcatcgatgaataccactacaaactggtccaggtattccataaagattttgttcattaagttcatgaagaatgctggagcattggtgagtccgaaggacattactgtgaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaactcattagcggccattcggtagggtctttttgcaattggagctgtgcctggtgccagttctatggcgaactcaatctctcggtctggtggcattcttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagttaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcaaacaggactattgcgggtacggagttgacagagaacatacccatcacaacgtctggagcatcctgagcggtttcagcttgaatgtgattcacacgtcctcgaccaaagtggttggaagcacgagaaccttgtccacttgcttgagagctaggacgagactgagctgccgctggagtaggagttctggcagtgctgccattagcatgtcctgggctggtgttggtaggattctgaggacactgtctagcatagtgacccatctggttgcaccggaaacactgaactgctgacggtccctgtggtgacttgaaggaggtaacactgtttggcgcagtgttgccactaggggcacgctgctgtggcggaggtgccggacggttcatctgaggacgaggggcgtagcttgactggcggttagcctgagtgaccgactgatggtattgcatgggctgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttgagtctgttaaattcttctttcttcatgtcaatagtgctttcaggcacatgagctacacggaaagccgtagcgaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatccacatctttcaaccaatcgtcagcctcgacgggctcgatggtctgagagaactctggtggacgtgacctcagaaagtctgtcagcttggatctattgttgcccacgtgagggtggccatttccatgcgcattatgctgaaagctggctatggctgtggttagaccttgcaagatctgtgtctgaactgccattatgtgttgcatgttgttttccacatgaggtggggaagggaggcgttcttctccagaattgtgactggcagtgcggtgagagcggtgagactgctccaactctgcttcacgggaaactgtgcgatgcgagcggctgctgcggcgaggttgctcaacctctgcgttgcgggaaacagtacggtgcgaacggttgctgtggtgagaatgctcattagctggttcgtgatttgcttctgcttcaactctaccatcttcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggattttttcaaatcgtaaaaacacctgatacaacgggtgtggacaagtcacagagctacgccgagcttgactgtgcgcacacctcctaggagaaccagactaccaaacaacacccacatcaaacacacacacgcactacctcgccacgactccaaaagagttggcggcggaacaaaagggcctaacacacggacggctgctgaagactgcctcctctactcctcgtcggcctggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggcgcacgcgagctgggggagcgcgggccactgggagtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggagcggtaagcctcaaggagtaggtcgtgctgagtggcctgagcctccgaaagctcgaccatgcgagtcagcactggctgagactcgctgtacggacaagggtatctggcgtctgcgtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgggggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaaactggcgttcactgccatctacaattttgaaagaggaagaaaggatcagtaaccattttagaaacaaactattgaaaagaaagaagaagagagaaaccttagcttttcgcaagtagttttgaatctagtatccttagggtcgtcctaagcgtcgggtttcgccctagggccaagcctgtgctctgataccatctcttgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggggtactcagcaagccatgggaattaagtgtttaatgcaagcttcaaggaaaggctgtttgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctcaccgtgagcggggtgcacgcggcgtgctagggtttggggaggggaggcgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgagccacggcgatacaagcgacagcgagtacaccgggtggttgcacgggacgcggggaggcgagccaacggctcggattcaccggagggagcttgacggcggcgaatcgcggcggcgacaaccggcggcgggaggagagggaaacggcgacgaggtcacgaggggccgattcccggcggtgggagcatctacgcggccacgggaactcgatgctagcgtcggatttggagggaacacgccgagggaggctggcgacgtgcgggtgctacggaactcgggcggcgacggcggcgagcacatggcgagcaacggcatcggtcggggcggcgccggccaactacgggaggtctactcgagctaaaaccgaagtctaagggggggagacggagcgaggagggagaacgaagcgaaacatcaccgcggaaaggagaggcgctgtgacgagaggccgacggcgcgggagtgatctctccggcctcgggccggggaagaggaagaagaggcgcggccggagtcctcttcggcgtccttgctcgtgccggctcctccgacacgcgcggcgacgatcggcgacggcgaaaacagagacggcagtggaggaggcgaaaatggggagggaaggagaaggggaggccgggggtttaaggaggcggcaatgtcggtttggggaaccgacttgcgcggtcaagagcgcgagctggcgctcggctagcggccaaattggcgacagggaggatgacgccggcggagaggtaaaggggaaaaaggaggggagaaagggggcttgcccctttgccggttcgggaaaaaggaggaggggagcggggcgacgcggcagagggagggggcgctgcctccgtcccttggcggcttgcgcgcggagtggcggggccgggtgatgacgacggcgatgacggggggaacgtcttggagcggagcggcgacaccggcgacaggcgtgcgcagaggctgacggcggcggcgaccgggcggtcggccacgcgcgcgcggctcgcaacgggaaggcgcggcggatggtgcggcgcggctcggcacgcgcgctggctgcggggccgagcggctgcaggctgcaggcggcagggcagcgggaccgggcggcatccacgcgggcgcgcgcgagcaacggcccgcggggagcggcagcgagggatggggagacggagagcgaggggggggcgctcggggcggcgcgcgagcagcgtgcgggcgaagcagaacggggggggggggagagcgcgccgggggagagagagagagagagagagagagagagagagctctcgggagagtgggccggggagggagagggagatgggccgagcgagtttcggcccatcgaccttgggggaggtaaactagactttgcggagggattttgatttagaaggaattggattcggagatgaactcgacgatagatcggggattgagatcatgagatggcacgggcactagacaacaagcaaggaaacaaatttcgcaattagggtttttaagagataattttcccgctaggcgccacgacggaacgggcgctacaacaacgacaaggaggaggagcagtgctgcctcctccctcgtttcgctcgccgtggcattatcgcacgtcttcttttgtacattaccaccggccgcgacatatccatccacagctactatatgtaggagtacgtactaaagattagacgaagcaagatcactatctagctagcactaggtgccacgaataaatagaagtgcatgacgatcggagagcgctgggcgcctagcaacagctcccgcagcaactcgggataaaaaccgactcgatcgctcatcgcgttggaaaccgactcgatcgggcaccctgcaccctgttgtcgagtttcaaaacgggcctcgcgcatatccgccgcgggcgcagacgccgccaatggagggtcccgcgcagatgtggcgcttctttttgctttttttttttcccgctgctgattaccgcaccgtgtagggggactcaacatttaaaactttcaacttaagattttttgaaatttttaactaagattaaaaaatttcaagtcaagatttaaaaacttttcaactcggatttaaaaactttcaatttagaaaattttcaactcggatttgaaaactttcaattcagacttgaaaactttcaactgaagatttgaaactttcaactcaaaattttaaaaaatcaagtcaaaatttgaaaacttaacacatgtttgaaaacttttaactcagaattaaaaattttcacattcgacttaaatttgaaaacttccgtctcaaaattcaaaacatttaagttaaatttaagaaactttcaactgaaattcaaaactctcaactcatatttgaaggcgaaagattgaatttgttaaatatcgtaaaacaaatcatgcgtgtgtgtggagaataaaataggaagcgatttcaaaaaaaaaaaagaagcaatatcaggtgtaacacgtttcttagttccctcagctttacgctaagtttgaattgcatcattcaaccgcaatatcaggtgtaacacgtttcttaacttgcaaaaccggtgtacttgaggtctcagggcaatatatcgcatggttttgcctgacgtggttaatgggacctacatgagccccacatatgtcatcgaccaactcttcttcctcatctctctcacattcttccctcttttccccatccctctttagggcaggtgctgctctctcgccgcacaaaagcgtcgtcatcctattgcacacacggaggtgcggaaggacctccagccaatgtatacattaatcatcgaatctgcatctatcccactatatcagtatcggccaattggttcattggtacagttctttctgtcatctttgttatagtctctaatgacatgaattaatacatagaatttatattagacttgtaaaaaggtagagtctattaacaaatttatattaggcatgaattaatgcaatttcaaattcaacttgtaaaggttgtaaaaaaataacaaattttgttacaacccgcagaagtcaaatttgaacttgcattttgtgaaatgatatattaattgcacatgaatctatcttgtcaatttttttaaaaaaaaaatcataactatttagttgacattcatggtcactgctgtagtagtacaacatactccctctgtctaaaaaaaatctaggattggatgtgacatatcctagtacaatgaatcaggacggactaggatatatcacattcagtcttaggtttattttttgtgggacggagggagtatatagtaacctcttaccgctttatgtgattcctgctgaaatatttggaagtccggacaaaatacagccttcttttttgccgggtcggccgaccactttcattaagatttgagggagaaaaataataaattgttacaaacgacaatactacgatgtcgtgccagttcgggaaagatccccggtccagctaagaacgaaagagaaagaaaagaaaatagccggggcaaatcctcgagacctatccaccgtgatcactcgccaaattgggaaaagatcccagccactctccatacagtaattgcagtgacctgcatatagcctagtggttacagtgacttgagtagtaccccaaaatcctgagttcaaatctccatatgagcaaatttcagattgggttgtttatggagctagattccctatttcaatggcagtatatatacagttggttgtagaggtcgggtaaaaaaaaaacccttctctaaaaaaaatacagcaatttcctctcttatatcctccgctagttgctccggtaacttggacacatgctgaaatattcttgcattacgttccttccaaatcaaccagcaaattagcatgaatgcactgtcgaaatccgacatgtagctcgtccgaaaacaacgtcttgttgcaagccaccaatcggccagagtattgacatcatccgccgggattgcgaagttagcattgcaccatcttcagagaaggatgtgtggtgcaagaagctttcaatagaaacaactgaggaggggcatcaacatcatcaactaccctctagctatatcatccttgtcagaatgatacatctttgtcagggatatttcattctgcacataatcacaatatctggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacactgctgcaacaatgcagttcttggacagcatcagcaatcggccatgtcgatcctaatgtcttcttggcactcacatgctgatctgcttccactgttgggacagatttcgaccagcctcgagactcgtcgtccttcgccacgccgtcagagaacaccagcctgcagcagcaagaagcggcgccgcctcctgacataccacgcccgccggcggcgaggaagacgaggcggaagcggaggtccacgagcgactgcccggtgccttcttcttcttcttcggcgagacccagctgcgattccaccatggcgcctgcttccgacgccaatgcgtcgcaagatcaaaactgcaactctgcaacgtgaagtgcagcactgatcgaatttccgggtgtgctactgctacttgcgcagagagtgctgtacatcgttgtctgttcagtgctctctgctttgcgccaactgtacatgtaaatgggtttggagtttggagtgcagattaatcggcgatcgtacggagaaattggaatgtgatcgccgtttgtgtgtttgattgtgactaaccagagaagttaatttgatgttcaaggatagggatttcgatgagtaggccccaattgcctctgcactactctgtagtctgtcctgcctggccggattactgtcaggtgaccacatatttttctcttctagaaaaagagaagttttttttagtgaaaaaaaagttctcccaccaattttaagagttattgagaggtattacctctgcttttaaatttatgacattgttgatttttggatatttcatttgactatttgttttataaaaaaaagctactcatttcattctagaaaataaaccaaagatttaccttataaattgtttttttatgaagggtgtatgtaagtatcatttattttgtgttttaaactaaaattatcattattttattattaaagacactctaaatatgactaatatttttttatatttatattttttgaatgagatgaatgatcaaacgtcatattcaaaagtcaatagcgtcatacatttaaaaacacatggagtattatatcttctagcattatttttttttcgccgggcttctagcattaatttgcctgaaactaataaaagttacttgtgatgggatgaacaggggagtgactaaaaagaactaagacacttggaaaagcctgcaaaaacaatcatgttgccttctggataaactgatatcacaattgccagtgtggaatctcagcgccggctctccagcctccagccatgcgtattccctgacgctaaagaacaagttgagcaagccaaccagagactaagattcgttcaaacaatgcagtacaagattcctaccaatggtggacagtttttatatcagctccactgttttaatttatacacatggttaatatgcagttatgttccaagccccagcctagctatagtctctgcttgtctcttccggagccgatgaactgatgaacaccgagatgcttttggttggataagatgccgttcgtccctgaattctctgaatccgtcctacttctggtctgtttatagctggatcatcatttcggtttgttgccgagtgaaccaagaacagaaaggattttaggtgcacctttcgctctgacgctgatgaatgatgagtaggaggttgacattgtcacaggtctgccattgctgaattcttaagtttagtacgatccctgaaggtcaatatcaaatcggtgttaatgtgtgtagatggtactaagtttgttgcagtgatcattttcagaaattgtatagtacttgtgctgttccctaacccagctagccttgactgactgcaaaatattcttagctagagcagattcgtgtgccagatggttcctacctcgaaatatgtcttaaatagtacgttttgttcttcaatatctcagagtgatacctgattcagacttcgaaatatatcttaaatagtatattttgttcttaaatacctgattcagactctaggcaatttttactccatttcttgtacttgtactattccctaacgcagctagccttgactggctgcaaaatattcttagctagagaagattcttgtgccagataattccaacctccaaatgtatcctaaatagcagtatagtacattttgttcttcaatatctcaaagagtaatacctgattcatacttcgaaatatactacctccgttttttaagtacataacgctgttgactttttacatcatgtttgaccattcgttttattaaaaaaaattaactaaatattttttcttctgttgtggcttgatttatcacttaagtaccattaagcattacttataacttttaagatgtatacaaaattttcgaataagactaatggttaaatgttgtaacaaaagtcaacaacgtcgtatattaaaaaactgagggtatatcttaaaagtacattttttcttcaatatcaaaaagagtaatatatcttaatagcatttgatcggcctaatcctttggccaacccggcaacaaaagagtaatacctgattcatactgcaggcactttttactccatttctccactggtctttgtcacaaatgtcttgaaatggcaaggtaacctaaaagaactttttgataaatctttatactagtacttttacagctgccaagttgtcataaaaaagtttagtacattaaagtcagtactaaggattaaggaatatggataacagtcagacatgtcaagtggcattgtttaaagagcaaaacttatccacactatgaaaagagattttcctagcagagtcggagataggatcttcatggaaagaaaatagtctgcaagttactactaaatactaacataagtgtgaccttttctagacaactaatctgatgtataaagtataaacaactgggcctatacatatcatatatgattagtaaggcaacatgctatgctccatattctatcttcagagcaaggaatttcacatgaacttcgtgagaaccttttgccttaatcagttcatttccggtaggagacggaaaattttcagcgttctagaagagcccgaaaagaacatgttcaatatctccactcaatcttaatgaaatttggccggcctaatcgttcagccgacccgacaaaatagaacatggtcaatatgatgtttggaagtcttcaaaactaactatatacagtacaattggaaatgctcctgaaaattcaaaccagttaatgaattccattatttaaagaaacaaattcaaaccagttgaatgagaatcacatgcctacatcctatgtcctgtaaaatgctacagtttgtactacttagaagggatccatggatgtgcttagaattgtcaagaattcaaggtccactagatgctagctgcatccttgtgatggcacatgggaattttcttatgttgtgatataaataagctacctgctacccctgcaacatgtatatattctactgaactgaaattattcaagcagacaattggtacatgctgtttaggtattttgggaaggtcagagagatgccccttgtacttattctgactgaataagcagaggcaagtggcactttctggtcactaaaaaaagattagcttcttgtattaacaagtattacagcctgcttctacctagtgagcgatcacatcactgacgtttgcagaggtgcaagggcactcatttaactattgatagaatgtaaactgactgaactagttgattaatgattatacttagttattaaagtttgagaatttaacattgcacttaacactctgcaggtactaagttgctatcttctagtaatagatttacaggtcaatacctgtacttcagaagaatgaatgcagcgtgaaaatttactaagtattacgatgacataattaaggtatgcagtaacacatagataaatgactaccctgtcacatagataaatgaattgtactgaaagtttgcctaaacttggaaatttttaacaattgaatacttagaaagaactgaagctatgcgtacaaattaaatttcctcactggcgtatgcactagctagattatctcttcctacttgtttattgttctccaatagttgaatacttatttttctaagcgagtggtacgatcagacagctcaacagcatgataggaattaggtttctgatcatcagctgacacaagagagtgatatatgaacactatcgttgtatacgattaattaaactgaatactgacagtacacattaacagtacaatcaatcatccgaggtaatttatcaacatggagagagggaccaagcagagccctttcttcctcagctcattacattcatacaaggacttgtcgttgttgttatcaacactgactgtttcttgaagcacttcagccgccggctgtcgtgaactggcatcgacaaaatacttggcctgcaatgttaagtaaacttgtaaggaaacatacatggatacatataattgggttctgaacaaagaaagaaaatatagagaaactgtttcagaaacttaccagctgtgtgatgttgatatctttagcctccattgttgccattgacttcatatcaacattgttcaagttgctagttaactgtaaaacaacagatggtagctatgtaagaaatgcaggttatatatgtaatgttgttttgaacaacaagaagagatgaacagatgaacaggcatacaggcagaatcttttctaaccttaggggcagctgcagaagaacaggcagtgtcctgcaaggaatcatcgtcatcgtcgtcgtcacacatcatctccgacgtgatgaacgatgcgtcgtcataggaagtagcaaacgaagaagagaagccagaggagaagctgctgctgccagagatcactggttcctggcacatctcctggctgttgtacggtgatgccaagaagttcgcaatgtgcatcgcccagctgctctctccagctgacatggacgacgtctcagctgctgggctaatgcaagaagagtaatgagatgtgttgttctccatgtgtgattctttctagctcgacctgtctctctctctgaatttgtgcctagcaatatgcagcagtagcagtgtgtagctagagctggatgatggtgtgtttatatatagctgcaagaatgcagagaatggatatgatacacaagagaatgaactgtctgtcagagactgaggcaggccagcattggaaaaactaatgctagctctatgggaatcttctcgttgcaattgtttaattcttgcgatggagaattattctacagtagtatacaagtatgattattatggtgatgatggtttttatattgtgctggtgattaggccgaggcggttgggacatacaccatccaatgatccccagtgagagctccacttcacctactgctaattgcagcttctctcttaccaattcactgtactcttggccaattcttagccttaaatctgaactgaactgaatataatatataaaatgcaaattaaagctcctgcctttctttcagaagaaaatctatcggaactgaaaatgcagtacactaataatatattatctccatttgcatctaacttctacggatgaacagctagctacccctgttccagtactaagcttttgacgacttcgcgagtaataatggcgaaaagttgcatgtagtagtagtcttggcctcttcttagccttaaatcttaactgaactgaacataatactcccttaattccataattataaggcacgactaatttttaaagttgtttcataatataaggtatgcatgcatgcatgtcattaactagcacatcttttacactaaaatattattatttgaatcctccatcatcaaaatctctaattttattaggtgcatgcattctatttattaggttaatccaaactatgaggtgatgataattatttcttggtatttgtgttaagggtggttgtgtcttatattttggaatggaaggagtataacatacaaaaaagcattgctcttgccttatcttatgaaaagaaaatctgaactgaaaaatacaaatacagtgctaataatatatttccatttgcaatttctactgatgaacagctagctatcccagttgcagacttgcagtagtcctgagctttttttgacgaattccggagcaataatggcgaaaagttcccttgcaatggaggatgcagcagtagtactgaactactgaagagaagacgaatcaggattcagagggattaagatacgctgcattttctctagccgatccattctgatcatgccgggcgatcgggcgccaaagaccaaatcgggccgtggtccattgctcatatcaggcacgtaatcagagtcgtctctacctaatccgatcatgtggatgatcacaaatttcacacgaaatgacacgatcttaagcagagggacggccaatatgcatgcatgcatgcaaagaccgtatctcgcggaaaccatagtttaactagatttttatctctgaaacaactcaagcaagcttttctgaggtgtgatagatgatgatacggcggtgtgatgaactgataatatatacaatctgcatatgcttgcatggtttgcttaacaaaggattaatccatgcagctagtagcatgcaactgttataatgcagccaataacaataagcaagtggtcaaatcaaaaaattcaaaaaccaaaatcgaactgaaaattaaatcacatcgaccattacagacaagtgtgtacagctcatcactctgttctgtgtgaggtgtcatgtgggcaatgcagggggtggggcccacatgtcagtcaatgaggtaggcatcgctcctaggtgacgtcatctcgcgcgtatctatcggatcctgagttagttggtcgcgcgcggcgcgcaatccagacagatgaacggctggccgggtcaatgcgtgaatacgtagttgatgattcgtataattaactccatcgtctaagtacctagctacagtagcctagtgttcatagccagtagctaccaatttaacaatcttgcagcacacccggcgtagcctcaaccattgattagagatttagaaaaactcagcgcgtgtgctcgtttttctcacaagcatatacatacacaacatttagttatatttagtgcaactggtggtgtctatcaagaaattagctgtacgtcatatatacctatcgatagcgaggagtccatcactttatcaattttaagatataccgctccagaatgcatgcacttatagatttaggtgtacgtgcgttcatatgggtgggtgtgcgcgtgttgtgtttctaaaaagaaataatcttattttggttaatttttgatgcagcctattagcatcaagccatgtgttgatcgatgaagcgctggctgacgttctcgtggacgaatggagattctagatctcagcgacaacgacatgacttgctaacgaacgcgcgacaacaaagaggatcatcgtggatatgccgatatggctcaactgctcaatatagaatttgctaaggccctgtttagttctaaaaactttttctcaaaaacatcacatcgaatctttgaaaatatgcatggagtattaaatgtagataaatttaaaaactaattacacagttagggaaaaaatcgcgagacgaatcttttgaatctaattagttcataattagccataagtgctacagtagcccacatgtattaatgacggattaattaggctcaaaagattattctcgctgtttctaggcaagttatgaaattagttttttcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggggctgaaatggcgccgctgaagcccccgccgccgcggctcctcctcaacggcgtctcctgcatgcggaacgcgcaggcggtgctccgcgacatcaacgtcagcgtccacgacgggacggcgctggtgctcaccggcgccaacggctccggcaagagcaccttcctgcggatgctcgccggcttctcgcgcccctcggcgggggaggtcctctggaacggccacgacatcacctccccgggcgtgttccagcagtacaagcttcagctcaactggatgtcgctcaaggacgccgtcaaggagaagctcaccgtgctcgagaacgtgcagtggttcgagctcctcgaggggaagcacggcaagtcggccccggccatcgagctcatggggctcggcaggctcatgaacgagaaggcgaggatgctctccatgggccagaggaagaggctccagctcgccaggctgctcgccatcgatcgcccgatctggctcctggacgagccgtccgtcgcgctggatgccgagggtgtcaagctgctggagtacatcatagcggagcaccgcaagaagggtgggatcgtgttcgtcgccacgcatttgcccatcgagattgaggatgccatgtcgctccggctcccgcaacggttccctcggaggaaaactttggttgatcttgtgcgttgatgtggggtcaagaattcagctgtatgattctaattcatctccattcatatgaaatccgttggaacaacttcttgatggttcagttttgtgacactttctttcggaaattaacaatgcactcaccatttgaatatgtatgccggttcctttttgctaacataacatacattgaatttggtgcattcacatgtatatgctggtggtgggttattctgttccctaatcaatgtagaaattgaagagtatttgatcatgagttgtgtattcactcgagaagtttcaagtggggggagatcaggtggaggaaatgctgaccaattttgtctgaaggaaatattgactgaatcaggtaacctattgctggtttaagagtaatttcgctgtacacattcaaattgaaacattcctgaatctcatgtattgactaatgtagattatgtacatatagttatgtttgtctgaaatttgtgtacaatggtacatcttacatatatttttgtttacaagcacaatagtttcaaatggcttactgttagttcatttttagggtctgtgctggctagtgcaatatacaactcaaccatgtctgatctacattaactaattattctgcctggtatacattttccggctggtgtttctccttcctatttgaatttttggacaaaaggcatgatggccctgcttttactgaaaacataacagctgtctttcctatttgaatttacttatttgtgtgcaattctcatgaatttaagttaggatgcccctgtagaattgagcaagtatgttggtttatctagaaatttgccatctaatggaagtctcaaatgtttggtatgaatatgaaaagatcctatcgtggtcttctgaatctctaacttatggcttgttacgaatatggcatcacattttgcacgcatgggtgtaatgatgtgcaatagtgttgtgttgttttatactctcattcactcattcctgctgtaaaagattctaacctgttgtgttcataaatataggcctcagatgttcttggggaagtagcttgctttgttgattttatgaacacttctgacctctgtatgccatatgctgaaattaaattttctgtgctctgtactgttttaaaactatttcaggtggcaatcttttgcgttatgtgtagcacattccattcttctacatttttctggcaacagtatcgaagttttccttttgtccttgtataattcattaattctattatgcttgtatacttctaacttataaacctaaactgatgttcacattgatttcagatgcaaagtatgatcaagcactattttgaacttgaagagtagactggatctttcacactgattttctcttcgctgtaatgtgaaatagaagatcattgcactaaccagtcacattcgccttaagttgaatatggaaagtaatgtgcagtagcaatctcgtatgtccatctatgactactcaaattctagttcctactctgaactttcatgtattagtatttacctgctagcttcaaatttctgcaagctactagctttattatcatcagtaatctatcattctgggcaaaccatcatatttttttcttagatgtacaaataatttctgcattattttgtatacggaaatatgtaagatcagtataaccattgtaagtgtttccattctccaaccatgttgttccctctagactaataaaaggtagattttcaagagagatatgcatatctccctctcttgcaatgttatctctttgtacagggaaaaacatatattatttgggagcaatagctaaaatgaagttaaaattttatttccacctgatactctttgagtaacatcatcttgctgatagcaagtcgaatggtctgggatagtttacattcagtatactaggctggtctgtgactctgtgttaactctggtactacacaggtgcaggctgtaacaagggagcactgaatgctccactaataagtccccagggaccattggaggtgctatctgaccccatgctggaagtagctggcccactattcaagacaaggtataaagccacttcccagtccagcaccaagccaccaatactacataaatgcgcactgttcttttgctgtattttgtttggttgttaccttctcttcaggcccaatctagaggatgctagcgtggaatatgtgcgcaatggatcacggtcgaaaattatctttatattgcaaacgatcaggtctagcccagatctgagataacttgttatttttttctaaatgaaaattactgatccgtggtggaattcaattaggatcttggccatctggttcaatacagttgtgttgaaatgctcatgttgtcatctgacataagattgtgattgccctctatcgcgttggtgaactttgttttctcttcactttataaatcccatgtttttcaattgcagagagaagcctccggtttgcattctacaagaaccaagaagggtggtaacttgttgaggtcaaacagaatatttaggatggtttgacacattacgtagcattaattgtcaaaatgctattctattaactaaagggctattggatgtgggaagactgagagtatagataaattgcctgaaataggtagaataactttatgaaaaaagtattggatgtggagacttgagagactggtatatccgtccactcattttcaaagatgatcttttggtttatcagtcctcttattttcaaagataattgttccattagttatctcttcatatcttaggagatatatttggtttgttcctgcaattactactgttttccagcacataaaccttagttatgtttaaatgtttaataattgtgatggaaggagaaagacaactaattgcattgagaaggaggcctgaagatccaaatatagacaagctctaacaggtttgcagcttactcccaagttcagcttactacttgtagcttcacatgtgtgtataaactacttgcattaaattgtcatcatggaagactaccactattaaactggaaaggtatgatatgccattcagataaagctcccaattaattggcagcttagctctttcttttccgagagctgaaacagtatttggagttatggatgggctggtttttattaaacactggagtagaaggaatatgacaatgatacctagagtatatttatgacattaaaactaatgtttgctagaattcaagcatcatgctgatttagctttaaaggatggcctaaaaggggaacttcttctctgtttgcctggttgtgcttaagagaatatgcatgggccaagtgcccaacccttataaatattgccaggtgaaattgttcaccatgcctgcctcttgtttgcactctttccttaaagactgttgtagttggccacatcaaacatttaatcacagattcaaatcctatatcattccttaaaggaacaaatataacgcacacacacacacaaggccttattaatacccatactaatgtgaaaaggtgcagtgaagtgcttgatttccccaaaagtctaggactgagacatggggcataagccataatgtagcgctgccagtacgtcctctctctagggcatactataataactgcttgcactcagatgtcaataccactctgctttaaggcctgatgtttacataattagtacatcataaaactttggaatcggcacttatacttcaacaagcacaataatacaaggccgagtcccacatgtcaatgtcaatgggcattattagtataatttgtatgacttggaaacagtgcttgcattcattcatcaggttgcttaaatgacaagcacttttaatcaaagttcattttaaaaacatatggtgctaagcttacatgatgttagtttttttttttgggtccttttttccatgtttgctacaatccttttgtgtacagtttcattttggcacaagcaagctagaggattctgtctatatacaaagtaagagaaacttgtaagtaaatattaagattaatacggttcctatttgtggggtccacaacggccatgttaggcagggaaggtagccacatctgctgtagtccatcataacgaaagaaagatgttcaccaatgatatggagatacttgtcatgtgttatatccacggattctccgatggaaaggaagatgctatgaagaaaacaaacgctagtttcactttctcgattaataattgtgctacatcatagactacttcaattcttgaaagaaagaaacttatccagtggagcaagttggttgctcctgaagattggatatcaccatcattatggtgtaattctgcggttggttagagatttctctttctaaaagtttgtcatgcctagtgtatcacagacttaagcaaatgctcatctggaattttcccttgatgcttggaaaaataatgggaccaactactttaagtttgcctgtaataaaccggaaaaatagagaaaacaaagtaacattagtacatgccagccaatttaaggagatgaaattgtttaatttaggttgttttaaattaacatttctaagttttagacaattgaaggaggcaagattgtgtataaataggttgctttatatagtagacagttctggaccctaggagtacatagattgtgttctttggtattcataggtaggtttgagagaattgaattcatagaacacgttttcagccctcaatgtggatatccatcgaaaccctgagagtggtctgtctaaattattcaaattatttgaagtacactaccgctaattatttctcttttttctcttcgaaaatgtccttatcaatcatacatgtaccagagcaaaattttaactcgggaaaaggaaattgcttaacagagataattatgatattgaagtgtggttgacaaatatatgaaaaattgaaaagaagaaagcgatgcatataggtattttaaccattaaaactttccttaaaagggggcactcactttctttatcataaacagttgcttattttccttgcactgtaccatgtacgtgaatacgttctttctcatgtgcatgagttactctgattgttttttttatatatatcaaagagtacgctgattgttacatttgtcaaaagaaacactctgcctttttttcctttgtgtaccttttttatatattacatgtatgcatgctgagtctgctgtatgggctacaggtagctcagctggtcatgcaaactactagctgagtcgattgtatatctagccaatcctctggattattactgaatactgattgatgggtactgacgtcaattagctagtatttacattccttgctcgggttcttccaggctccagcagctcacccatcagtttgcacttccgattttctctgcagaatgcaattttctgatgcatagatgcatagtcaatgatgttgctcatgtccgttatattggcttgtgtttttcgacagggatgttggaaagagttctgcataaatcgaaggaaaggagtggcccttactgagcaggaataaaggaaagggtacagtgaaaaacttatagcaaaacaccggcaatcacttctcagctcatacctaaacaggtatgcaagtcaattggttaccttttttagatgccttggtaatagtatttctttgcttactatattttcttggatttcagcatcagtttctccttaaagttgtggtactgttgacagaaaacacgaggcctgggagatctgcttaactccagtgcaggtccaaagctcgccttcgaatgtatgagcgtgccagttgatttgatcctgtaatcaacaagaaatagaagcaaagaaaccgcatttaaatctataaatgatagccgatcggctaggtgccgatgacatatcatttatctttgagccgatgtcatatatacatcgatcggcagtcattaataaataagaagggactaaatctactcgatcggctgcagatattgacaatatataatctttgtatcgatatatacttaaatcaagtgattggaatagatcggtcgccatgccgagacaatataaatcacttaaatcgaaatatatattaataatgagactatatacattcatagcatagccgatcaaatagatctagcctgtatcggctaatactccgataccactctatattaagatattaaagcaagtagaatatactagacaaaagcctaatatacttaaatgcagcaagatcttaacataaagggcagatttaacatgtcaatcaagcatataggataaaaagtagttaaatcaggtaagatcggctgaaactccgacactaccctaatcggcaaccagagtacatgctagagattgatattctaagcacgacttaagagatcaaattcggctgatgcagcattaagtatgaaaagaagaacaatatctagacaatcaagccgctggaagtttcatagagtggtagatatcttatataatctaggtcaacgtcgctatttaaccaaatcggctgccttctgttaacagatgttagccgattgtaggttagatgacgatattgtcgaagattatgtaagatatataataacttgacgaattacatagacaagattagagtatcataaagatggaagcactaatctcgagaacataattcatcataacaagttttacctcttgttgaagatcgaaaccgatgcagctcaacccgaaagcaagaactcgttgaaataaaattaaagcaaaaaggtggcgatgcgccgagattgtattgagcgtgtgtgttaaaagttacatagggctcgggtctatttatacccgaaaattacaagatatgtccataacggacatgacaactatctctaacaaactctaagataccataagtctttacggcagacttttgctcaagcatatctctaaggaaattacataaaacactctaattaatagacacaattgccttctcaggactctatccatgtgcggcaatcaccttgaagcacctcaattcaacccgatgtcatacatcaagtcgcattgtcggaatcggttgcatcggcttgcctagcctgactcagacccagctgatcctaatcgtagccgatctggactccagctgattcctgctctgtttccgaactcgatctccgcctccgactttgcttcgatctaatcttctttcccgatgccgaaattaccaaatttggttgtgaacaggtacaccaaaagaattcagtatagaaggtttcctgattcttgtcaaaggtagtcctataaggttatagacagctcagccatatctgcgcatgtggcctccagctttcatatggcttgttgagttttatccaaaccgtcgtaatgagatttgatggctcctaagaccttattagttattgtatacttgaaagtcgtctcacctaaaatttcaattttttccccttttcatttcagaaaaggaggcgatagctctagcattaaaaaaaaaaggaaatacgcccatgttaggacctgaaccaaagttaggtaggtagggtgcagccattgtttttagagaaaaatccctgaattttctcttgtttttactgtgacaaactgactgtaacatccacatcctttcacttcagcttgacaatttgatggagtacatactactatcccaattatgatcacaagaatgtcaagaaccactcctactagacatatgctgtgtttagttcacgctaaaattggaagtttggttgaaattggaacgatgtgacggaaaagttgaaagtttatgtgtgtaggaaaattttgatatgatggaaaatttagaagtttgaagaaatattttggaactaaacacggcgataccaacccatcgtagttgggtagctagcagttgactcctcataaatgaatatctgaaatacacacaccaaagtcacactcatactatttttttttctcttcttcccattttgtttgttctgcagggaagattagaagaaagcctaaaacaaagacctccctcctcctccggttcgacgggcgtggcgtagctgtacccggccccgccaatgtaaatgtgcgcttgtctagttcttcagcttgggtcaggaggacctcatggccatgggggccattgcttgcaacgcatgccccgagactgatgcaatgttgtgacagggagcgtggcaggcagcgtccgtccacgagatgagatgatgggggatcgaagcagaagcagaggagcagcatgcagtagtttttctggctggctgatcttgcaacaaattggtaagcactttcggctgggctgaggttctagatggtgtggtgtactggttctagtaccaccactaccacacctgctcaaccgcaaagctctttggattgtatcgccaacaaaatttgccacccaaaaagcagcttttctgcagatggtactactagctcgttgctgacttggagtgtagggtgctgtgcatgtatgcagatgcatgtcgtgctccatggggaagaagacggggttggttcttggttcttgttgcacggcaggcagcggcagattgaggtgagctggtgaggtgaccatcgtcgtaagggtaaggcttcccaaatgctaagctaaaagttcatttgatacagtattcaagtactctgtaccacatgaatttgccttggtgtcaattgtggatgtgcaaatttgctaaacaacaaattgaagtgttcaatcttgtaataataccagtactcactttctagtttctacttcaattcaattccttgcatttatgatagtagtccagaaagtgaggcatcattcagccattgatcatgagagatggccgttttgacctcttctaaccagttactcgtattaatgaattacagttacaggtcttacgcactggaagtctcattgttcaacttcaacctccatttcagaagccagtcaatgccccaatctcctgaatccttaactgcatagctattactactacactttgagcgagtcaggaggaggacgaaatgcacacacatactccatatggggaatgaattactccacaacacctcgcaatcagatcgatcatattcaacagatgaaaaaccgaggaaattaaatgagagtgaataatggtcaatgcactggctgctagtgaatcgtgatcgatcaatcgatggactgaccgagtcatcagttcatcacgtatgcatgctccgtgcagattgacctgcatatctgttacgagattggcaggcaaattaaggcagcagcagcagcagcaaccatatatggatcagaacttgaccatgtcgccctatagccagctactatagtagtactctagtataggagcagtagacatgtacatgtaattctacgtgatcttcctatatatcgatctctatgttaatgaaccactgtcaggcttgctggtgcacggaaagagaatagtgctgtagccaagccaacggcgccggtgccgtggactcgtggagcctgggtgacgaagagcttttttttttgccggctaatttttaagggcattttttggtgattgacaatggtgacattggcggcgaagccttatcagggttgggagtagtatatgataaattacagggaaccaactcccagactacacggactgtcatagtccgggagctgtgtcgtagtccgggagctgttccgtcgggtgtacaatttatcgtatactactcccaatcctaaaattttagtccttattttcttcttaaatgctgctctccacaagtcgcaagcacctcttgtgccatgtttagttccaaatttattcttactttcaactttttcatcatatcaaaggctatgtttagttcacaccaaaattagaagtttggttgaaattagaacaatgtgacggaaaagttgaaaatttgtgtgtgtaggaaagttttgatgtgatggaaaagttggaagtttgaaaaattattttgaaactaaacacgacctttcctacacacacaaacttctaacttttctatcacatcgttccaatttcaaccaaactttcaattttgatgtgaactaaacacagccttgctcccaatcgccaagttggcacgcacctggagagttttcacacgggagtacgaaaagagcgattttgtttggaagtttcatatgtggtccaccttttttgagtttaaattagattctctcttataggtgaaaatattttcatcccttaaatcctattagagaaggggatttatttttaaccgtctatcggtaatgctcagatgatgtatttaggatcgacgaacgacatgatgggtcgttcgcttgtttgctttacaagaatatacgttgaggtgaaatgaagtggaacgacttggttttattcagtctattggtatcataattcagacaattgtaaccatggttttgtttgggctctttaaaaattatatatataatcagttaccaatagatgcgacgaaaaagagagttgatgggaagtacaggctgtttttgattaaagccaaaacatgacctactaatagcttgttatcttgaatacatagtagacaaggttgttttggtttaaagccaaatcattagtatcgccaatgttcaatttggtagtttctatattctaataaaaaattttggttttttataccaaatacaattttatcttaccaaaaatctatcgtaacagaacgtatttaagttttgacactaccgatagtttgagagttttgtaaacctaacaggccctactagtagaagacgacgacggatctcttagaacgaaaacagtggcatgaagggcgccgatcgatccatccatcgattcgatatatgagcatatattgccaggtcgtcgtcaccccctgacaggtgggccccacaggcgcgtgagacacatccgcggcgcgtggggtgggcctgcacggcggcggtgggtggcggcattgggccggcgatgcgagggaggcatgaacgtagtaaatgcggccccctcccttctctcttccatcttctctctcgtctctgctggagctggagtggtggtggtgtccacctcacgcggtgttgctcagagaccattcaatggagagagagagagggacgccatggaaagcgcggctgatgagctcgatctccagctcatctcatgtgtgacgcatgggcatggcaatggctggcatggatggagtcgacgtacgttacgtacgtactcccgtctccaaccatccatccaccgttccgtccataccatcgacgatcgatgaccgatccgttcacttctgtctactggaggagtactactacatgtactccctccattttcatccttcttttcgcatagattcgtctcattgttggttcattagtcttaactaaaatttatatttaaattgtaatcttatgtaaactttgtatatttttctatgttagtaatttattttctagcaattgctttttaagtcactaataatatacttcatccatcccaaatataaaaagttttaattggattggacacatcctaataatacgaatttggacaaagagcttgtacagatttgtagtactatgatgttaccaaaacttcttatattttaggacggaataagtggatataaaagatttatttataaattattggttgctagttcatgattttcatggtttatcagccgtagatcatacgattagagtatattggtagcgacaaaaagagaggaaaatcgaagcatctctctgctgacatgagatcagctccacgctcctccaacatttgtggtatatacgtgtgctgcgtgcatcactaacaaaggaacaacgcgccctttaaacaaaaacagtaattttcaggtgtccttttaacgaataaaatgtactgattctatgagaatcctgtaaaatctatatgttcaaaagtaaacctgggatcgatcaagtcatcactagccccgtcatcatctcgatacctggaaggatgcaacagagaaatattggaattattatggtacgcgtgcagtttaggccaacactaaattaacttaagactgtacacataaactattgaacttttaactagtactacagaacagagaacagagaacacgaataaccagtatgtatatgatggtcggactatatgttaaaagaaacaagcagccgaattaagcattcatccatgtctggttgtgtttagttcagcgcaaagtttgtattttggttgaaattggagatgatgtgactgaaaagttacgtgtgtatgacatattgatgtgatggaaaaggactgaagtttggatccaaacaaactttagatctaaacgcagcctctgtacaaaagttgaagtttttttttacgcacatgtttaattttggctactactcctacgtaagatggatcggaaaccgtatgcaaaaggagacaaacgagtccaggttggcaacacacctaaaagatcataagtgacaacacgctaaagggaaaaatattaatggtttcctgaccttggtaggtgtatattattatgtgtttgatcatgcattattattatggtttctgtttcataaatggtggcatgttcgattgactttgctggtgtgttaactttgacactctctaaagtccaaatatgttttctggccggggtgcctgttgcctatttatttcattaatatggggtcctgtatagtactgaaccactgatgatgagccagagacagccagtgctaagctagctcaagaaaagcaaccttgtttttttgggacagctagcacgtactgttgggttgcaaattgaaaaaaaaaatgtttctgccatataatttacaatgtgaaattaattttagacagtttgtaattacacagttataactatatattaatttgttataagaagctttattttttggagacccctgttataattactttgaccctgctatatgaacaagatgtgtatactcccatgtaccacttaatatggaaccatctcatgtagtcacgctatatatatccaggaaacaattgatggtaattaattaatcctatcttaaatttgtagaagtcgtatctcgtcaacatcaaataatccgaaaggcagggacagctaatttgggatcaatatgtgctatcttatacgctaccatgtgttaacatctatctgtggactaaattaattacatgaacaaatactggatcctaaattaagaggttagtttctttttctcgtaataaatatatatggtcacccactggaacagtgatgttcctaatttgagtcagaaaatatatagaacagcttcatgttgacctagttaaatcatatatatcttgaattaaattataatcacacaatgaataacttataaaaaaacaacatatttattctttaaggaaacatacttagcatgacctagttaaatcatatatatatatatatatatatatatatagaattaaattataatcacacaatgaataacttagaaaaaacaacatattttttcttaattgcccatagaggctaaccagtaatctaattaagcacaccagttctttaattttacactatggccactactctatggcactctgattttatagtcttgttggcttgttgcccgcaaaaaaaaaaaaggatttcgaatgttagttttaagttaactttgagatttttcctatcttaacgttcagccttgcctattaaaacgtcaacaatacaaatatataagtttacaggaatcctaattcgcgcgtatgcgcgacttctccaagtcgcgagcgtgccacgtggcgggtcctcctacgaccgagtctgcgcgcttcttttttcttttttattttctttttttcggtaggcacaactgccgtgtttctttcttgtttttttcttcttctttttttgccgttaactaccacacacgtctaagagtaggagtcaatatttgaaaaaattcaattcaagatttagaaacttttaactcagatttggaaacttttaagtaaaaatttaaaaactttcaactcagatttgaaaactttcaattcaaacttgaaaactttcaactcggatttaaaaactttcaactcgatttgaaaacgttcaagtcggatttgaaaactttcaactcggacttgaaaactttcaactaaagatttgaaactttcaattcaaatttaaaaaaatcaagtcaagatttgaaaacttaactcaggtttgaaaacttttagctcaaatttaaaagctttcacctcaaaattcaaaatatttgataaaatttgaaaactttcatctcaaaattcaaaacattcaacttaaattttagaaacttttcaactcaaattcaaaactctcaactgatattgaaggtgaaggtgaatgtcacgccccgaaatagtcccgaccggaactagcccgtgacgctccaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagcccggacttggaccaatcatcacaggcgcgacttgggaactaggccgaaaccctaaaactcatcgtagccggcttgctcctggaagaactcctcatcagcaggatccgcttcatcttcgtcagcaactggggggggattatttatatagagcaagggtgagtacgtgggtactcagcaagccaggggaaataagtgtttaatgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagtgggaaaccgtacacccggtacgttccccggtacgcggttttggaaattcatttagttcgcaagcaccgacccaggtgtcgggttttccaagtcttttgtaaaactccagttttacccaaattgttactcagattttaagtttgaaggcgaccgtcgatactcgcactgagtgcacgaatatcgaggcgcaactgggtggttacaaggggacatggtatggcaattaacaatggaaggatcaaatgcaacaagtcaggtaggtccaccaatctgccttgcagatggggcaaaagattaagtgcggtcctatcaatgcataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacagcgaaaataaagccctattaatgacctctaagcgtgccattagatagatctcgagatttgatgaattttggaagttgaacggagtcaaacggagttacggttgggaagatattgaatttctaagattattggatttttggtctaaaggaaaaaggatttaattaaatcctttttggaaaagaaaaagaaaaagaaaagaagggagggagggaatatagacttttctcgggcggctagggtgcggcccaagagatttggggcggctcggccgagcttaacgggccggccggcccaagacggcccaagcgcgcgcgcgcggggggaggagagagagtccggtggaccgggctcaccacgcgtggccccgggtgggacccgcttgtcagcggctcggctcaccgtgcggagggagcacgcggcgcacgcgcgcgggcagggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcgggccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggcttggatttgccgggggttgctcgacggcggcggattgcggcggcggcaaccggcggcgggagaagagggaaacggcaacgaggccacgagaggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaaactctccggcctcgggccagggaagaggaaggagagggtgcggccggagtcctcttccgcgtccttgctcgtgccagctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaaaaggggaaaaagagggggagaaaggggcttgcccctttgccgattcgggaaaaagagggggggagcgggagcatcgcggcagagggaggaggggcgcggctccgtcccttggcggcttgcgcgcggagtggccggggccgggcgatgacga

SEQ ID NO: 64911 - DNA, 3498 bp, Oryza sativa
aacgtgaagaatgtgaatatattttgcgccgatggactcacatggttttgagctacaacatataaaatgagaaattattctgagctaaaacatggtgtaccataaagtggggcccacatgtcagcatcctgaagaaggctgtgggccaggggagccagccagggttcggccgaccccccagttggcccaatccaacccatcttcggccaggcggttactaccggcatcctatgacggttggagctaattctatctgaagaaatcgtcatggacacatagcaagaggagatgaaatatgctatttggatgcttgagtatgccacttgtcatgaggagagcaaagatgctcataggatgcttggagcatctccacactcccagagcacctctccacctataaatacccctcctctcattcattccctcacacacctcaagaaaaagatctagagctctctcaagtttagtttagtagttctagtgctagtggagtagaaaatagaatagtcttcatagtcctcgagtcttcaggagattgctggtatggctccagtagctttcctctcttcttttgtaagacatattgaattaatagaatattcttctttatacattttcggtattttattccattcatattacttgagtgccgactttacttcatacttgaatcaatatagccatgcaactagctttccagataggtgtattggtgtgggtttagtgtctgagtattcggttgctctatgtcggttgcaaggatgtagagtagtatttagtaatataagcacggtgcttagtttattagataccattaattggggtaatatacagtggttcagaggctggccgctgatggtgacggctcagtatgggtgtcctctgcatgtgtatattattctaagtgcaatttcctggggagggtactcctccgtatttagccccggttggatggccaggacaggttgtcgtaaggaactcagcaaccaggggtagtctcttgaaacaccaggaggacactaggtacggggtattggttgcatgactgtataatagcaagtatagactaaagatgtatgtatactagaagtacaggaatgatacttttcttattctttctccatttattttagactatattttagtgagagtatcttagttttttcttctgtgtgtcaccctaccctttgaactgaattaacctctgcataaactttcatgtatataagtaatatatgaattgttagtaaagttctctcttatcatatctttcattgggatcaaataaatacgacaccttggaatactcccgggtgaaatgctacaatggtatatccgtgcacttgcggatcacatatgtaaccataatataccaggattatttctagtgctattgctgggaattatatttctagtagtgtcgctaagaaataccaacaatactctccatggctccaaatcaggtattgtgttcttgtagtctaatttgaaatttgggatttagaaatttagtgatgagctttgctttaagaaattatgtcaatagcaacttataatttgtttaattgttcatcattcattaggaccctaaaaatggcacctagaaaaagaggtactaaagcaacagcagctgctgaaactagcatggttgcctcatcactagctccaactgaaggggtagaaaggtcatcaactgtgggcagtggcaaccaacactattgttgttgttcatgtggataacaatggtgcagatggggattgagaccatgaaactaatgatgaacatatagcaaaaaaagcaaagaagagatcctcgccagcttgggaacactacaatattgtttataaggtggttaagataaatggctagatggttaaaaagagtgggccaagttcaaatattgtgcctatttagctaggcgcaatagcaggaaatggtacttatgtgttcttgaaccacacaaaaacccacaatgtggttccaggatagcagtaactcaaaatggataagggttccggtacaacatcggttgaaacatacaggtatgatcaagagatctctttacaaaaattttatttggcaattatcatgcatgagtatcctttcaatattgttgagaatgagtattttgttgacttcataaaatctctttggcctacttttcctttgaagagtcgtatcacagttaggaaggatatacttggtatattttcagaagaatggaaaaggttgtatgagctttttaaaaatgttaatgctcactttagtgcaataatagacatatggacctctaaccaaaacaaggggtacatgtgtatcactgttcattgggtttatgacaattggtgtgttcaaaaaaggattatcaggttcatgcatgtaaagggaggcatattgggctaaatttagctgatgtattttctccatgcttgcataagtggttcatcgataaaaaaatgttttctcttactttggacaattaagcagcaaatgatgtttgtgttaaggatgttattaaggtgctgaatagaaaaagtcccctcatgtgtgatgaggcattctttcatatgagatatatgtcatatacttaatcttgttgctagagatggtttggcacatattggacaagctgtttttagtattcgatcattcgtgattcttgtgaagtgttctcctatacagaaggaggaatttataaaatgtgcatctgagagtggattggatatagcgaggggagtctcaaatgatgttttgacatggtggaattcaacgtactatatgttgtcagttgtcagatgccatatattatagaaagtctttcgagaggctttatgaaactaaaagagaaatttatgagggtcttgttccaaaagctgaagattggtataaggcaactaaacactttgcatgtgcttgaagaggtttgatgatatcactaagatttttttttcaggtacttcttatccaactgcaaatttattttaccacactttcgtgaaatcaaggctttaattactccatggatgacaagtgatgatgttgccatcaaaacaatggccacctcaatgaataagaaggttgagaagtactggaagaggtcaaatcttactcttgttgtggcatactttcttgaacctaggtttaagacaaaggcagtagagtataacatgctgaggtgtatggtaagcaatcatatcatgcacctatgcaaaagtttactagtgttgttaagcaattttatcaagaatatgcttctttttataagactactattgcaccaacaactagtgtcaatgttgaatcaaaagaaagccatactatagaagaagcagattatgattttatgaattatgtctatgcctcacatgtggatagtggaagtgatgcaagtgacttggataaataaatggcttagccatcactgttggttcctaatggagataaatctgatgtcttatcatggtggaaagctcaccaaagatgtatatcctgttcac

SEQ ID NO: 64912 - DNA, 825 bp, Oryza sativa
tcatggatcggaggtcacctgaaaaatggatatgtaccacatgttcatatttgctgatgtccaatttgatatcccaataactcatgagaaaattaaatgctcatgagtcattaagaaaaaaaagagatatcaaaatttgtagagtaattagtttggtaattatcaaagatctcagctatagttttattgctgaaagtttatatgtgcaaaggcgtgaaattctttaccgtaagtttgaatgaccaagaactacattatgtgtgactgctatgtatgtgtaaacatctatgaaaactttatatatggataaaaaatagacatcataaaagattttaacagttataaaaaaaacagaagcccacgcaatcagcctcggtgctccccaccgcctcctccatgttcccatgacaacaacaagccgacggcctcctaaacagatcatcgatccggcattggcgcatcgcctccaacagcaataggtgatacttgttgacggtcgctatcgaccagtttcgaccgtcattattacccaatatatgaagactagctatgtttgcaatgcataattcccaaataaaatatctacttccactatgtgctatgctactaacatgtatgcaggagaagcacgcatgaatggaggagaatcgatggaaaacaaacgaacaatcaatcggaagccgtcgagaggtgattaaccaccaaagttgggagagaatgaacgtgaagaatgtgaatatattttgcgccgatggactcacatggttttgagctacaacatataaaatgagaaattattctgagctaaaacatggtgtaccataa

SEQ ID NO: 64913 - DNA, 4183 bp, Oryza sativa
ctagaaaaaaatatttacgagtgcaagtgaaataaaactaacataatcaacatatgatttccatggtgtcaaagagttaagtccgattaagttcacacgatcaatcgagaagcaacgttacgagatgcactattgggtttatgtgaatataggatgtgcgcgacaataggtggtgggtgagccccctctgcaaaaggaataagttcaccttagatccctcaattcgtcgcccactctgattttagtccttcagccgaaaaaccagatatagccgatccgccaactcacaaaaccaatgcaaacgagatctcttggcagcgtcgtcttcggttttggctgacgtggcgtctagtggcttatttgactaggtctttgtacgtagtactagcaaatagtatctgctggtcagcgaggatgtactacttaagcagtccagatacctttttactatcaagaggatccacggatgcaccagggtcattgtagaaggcaacaggttcatgagggagtggagttggacgtgggtgctacatgaatacaaatatatatggtcagttcatgacaagttgaaaagaggtacgcagaccaaacaatttgaaatgtatagaaacaatttcggaatcacaatactacagtcacataattgctttgcaactgacaataactatatcagtttcttgttgcaggtttcgatgttcatggaaacttaagtgaccaaaagattgtccaacagaagaaaaacaagaagctgggaaattaaactcaggagggatcgagatatcaggccaaattaatctagttagtatagagagataaaaaactcataaaaaaacacaactgaattcgaagcaattctgaacaaaattatattcgagcaagtttatagagctacaggagaagaagcgtaccgagaaggggttgacctgatctatctcgacctcctcgaacgggttgtcgctgtgcccccacctccctccggccgccatcgatcgcaactgtttagaatgccaactctcagaacgtctcgcttggcaattaagctgctaatataggtacgtagtacttgtatgcctagctacgggatggaaatttcgtcgcagatgctgtaaaaagccagtgtcgtcgtcctagtagctacgttgtcatatggcacacactcgatcggacgcacgccttgtacggcacgacggctctgctagcgaaatactagtattgtttcttttgttgtgttatgcacttatgctccctcgagctagtcgtggtcgatggatacgttcctgggccagagtagctagtaattggtgagtatggtgagccggccggccggcggggacggcaaaaacggtggcgttggaatttggttggcgcacaagtggcttcagcagcgtaagcccaagcaggagtagccaattgacagctttttccatgcatatgttagagtatatatatatgcaacggtacgtggagaacaaggcgttggcaaaacaaaattccctaataaatcatgtacacagtatttggtaaattattccgggcttttccattcatgtatgtatactttaggttataaaaaaaaaaactctcgattcgctctcagctcacatgctcaatctctctgaaaattgtcggacgatgaatagttcactgaaaaccaacaagaacagagaaacagagaagtgttttggcgcaccttttcgtttttcttctatttattctcctcagcccgtgaggttgttacatgcatatcagactccgactttactagatctaacaactgaacgcgtcatcccacgctgtagacccaactcagccactacaaccgaaaaagtctctaattgaccgacctctgaatattttagtccggccatgcaatgcacaaaggaatttgaagctaaatgctgttacaacatgcaaaagactaattcaaacaactaaacatgatagggcgtaaagattatttgctactctgtcataggttgtttaggaatttttttgactggggttgttgaagaatttaaaaacagatatacaacattctacagataaagctatagatcttataaattgttgcgaaaacgctagctgccaagcgtccaactcgagcaaaatcattggatgccatccacctcatgccattgccacctccctcatgtttgttttgcttggtgtcaacaaattttctaagggaaggccacaacgttgagcttccccgacctcacgctcgtgacgacctcctcctgctggttgtttctgcagccgcctggaccaaccatagttggtggaacctctgtcttgacgtggcttcgtgagcttgttgtcaatgagcacttgatcccgcgtcaaccgcctccacatcaaatttgcaccaaaaactcagatccaaccaaaggagtagaggaaaaaggtggatctagccattgaagtagatgaaaaaggaggatccgacaacaagagtagagagcaatgacagttccaactactggagtagagaacgatggcggatccatccattagtagaggaagaaggcggatacggtcaccagagcacaggaagaagacaacggtaggatgttgcattatgttgtttatctttactttgttatgttcgagtgtttcatcctctttttgttggatgctaggtacaatgcggaatgtattttcttcaatgttgcacaatagggccttgatgtttcaatcaattttttttcgatgattgcatctgtttgattttttttgccaagcgttgacacatttttcatcgagcgatgaaacatctaaaacaaattttgttgaaacatttttcacagatgatgaaacattaattagatacatttctctattcgtggtgaaataccatttgataatttgtaaatatcaaacgtcctggcctagttgtgtccaaattgctgaccttggttcatgcactggcgagtttgtcctccatcttttgtagattcgataaactttagcaatggcagcaacagccttcaaccaattagattttgggggttactgtgggggtagggaggggagaagaggggggagtttctttttttagaggtgggtcagggtggagaaaggcccaatggtgggtggcagcaatggggaggaggcgacaaagtgatagtactgttgaagctacttggtggggaggaggtggtgggtagtagaggcgatggggtatcgagaagatagtggctaggtggcattgggttatgatggtggatctgatggccggagtcaccgtaaacggaggaggctttgcttctctcccatggaggagggagtccttgccatgttcgttgggacaatattttgtcgtaataaagtatatgtgcaccgtaaagcacttatacgagcatattttaattatgtcagttgtaggaggctgcataccaaatatagtgcacctatggtcggtcacctgaaatccgcataatgcaaagggtggcagaaaaatcgtgtccggctctttaggaaaataaatattgctagaaaagattcctcttatagcaagagatcctatagttttgctacgcttcttctttcacctatttcatatggtagtacaggtcgaactgaaaaaagttattttccttgcacataagatctttcttgggttgaacatagacttttttttaatttactcactcatccattttctcatagcttataaaagagaggaatttcactgtttaagcatacatgagtacagttatacaaaaagtcccaaaatatataaaagagaggaatttcattgtttaagcatttagctagtaataagataccacaagtacatgaagcaaacaacaagaatagtttatggggatctaaaagaggaaaaatggatattaggactgaaaatggaaatgggattctgggataaaaaaaggaatgagatatttgggttgtaaataaaggagtgaaagagaccctccaaacttgatagttgaccatggtttctctagaaaacatcattttagaagaagcccacccttaacatgctggaaaggcatgcaaatggcaatgagcccctccttacttgggagggaatgaaataccctggttggccaatgaggatcctgcgccaatgttgaaaggttgcaccatgtcaccactgggtccagcagtgttgcttctgccgctacctctgaacaaactatagcccaatgagccaatgccc

SEQ ID NO: 64914 - DNA, 1745 bp, Oryza sativa
cccgccaaatgacactcgttccaggggtcggataaagagaattaaagggcacaatgacaaggagaaaaagcaaaacaagaagataaagaaaaaagagagagtaccacaaaggtgcaagaagtgcaaacaagtcgtgctgcacgattcgcgcaactgtcctaacaaagaaccacaacagtgatgcaaggttctatacatcatgcttccttaactatcagtcatcttataatagttgtcatacaatttcctggaagaagttagcgtttctctgtaaaagattgtgtgttgtcatccaaaattcaactaacggtgtatcgtaaagtctatagtgtgccaagaacattctggttctaatggacatactgtagatttccttggaacaaagtagcaattcatgtaaaagataataggtggccatataatatttaactaacagtaggtagtgaacacatgttgaaatataattagttgggaccattgtgaggtaataacatttttagtattgtcgtcgtgagtctaattaataatataaatcgcaaatgtacaattgtcctgttagctgatgtggtcccttgcatttttgcatgggttcttatttatagctctttaagtttttgactgtatgatttgggacctagtgttatcaacttggaacaaagtataaaaaaatatgggaaggattcgaggtgggcaagtgggcatgtaatatacagcgggatgtgtaggaagcacaatcattttggattgcattttcagtttggaatggttaagaattacatatggaaaatatttaaatatattgcgacaagttcggctcatatacaaatgtatattgcgacaaggacattttggacagctaatattcagcttgaaatggttaagagtacatatgggaagacaggaaaaaaatattagaacaaccattgtgttccaggaacattttgttatcttagtttggtccgtagtgtgaataaaactttgtatgtatctatgctcaccagtatatatgtccttaacaattttttatctatgctcacaagtatatatgtccttcttaacaatttttttcactatgcagtttgctgggtgcaggtttttttttgctgagagcagctggcgagaattcttttgctgagagtagttttttgttcaaagtagagccactgccatcatccagtgcacacgtgtgtgatctattaatagattttagccatttaatagcaaggttgcattttgattagacaacaccttgaaggggataactaatatttgtgcacaagtgttgtaacttatgaatgttattacctgccaaaactctgtgggatctaaattgtgtcagcagaagacatctgaatatcagaccatgtcggtatacattgatggactaggttgactctgccaattgtttgtggccacaatctggacctatgattttctaggaaaatcctaaatatacttgaactggataaattttctgtgtgctgtatttttctacttgaactagtaattttctgcacctgtgttcccacaaaccggtgtgctgcatttgcacaccatggtcatgaaagtttttcgtgtctctataacaatatattcatgttgagtttcttcagaattaagttccctgaatgttcagatgtcaattttttttcatgaaggtatatatctgttcaccctcgtccatatatgtggtctgtgtatgtggtgagggagatgccattttccaccctaggcacgatttcctg

SEQ ID NO: 64915 - DNA, 161936 bp, Oryza sativa
atctccccctccctccccggcgccctctctctctctctccctccgctccaccccgcccgcgcgccgcgcgcgctgcgtgcgcgagcgcgcaagccgcgcagaacgcccctcctccgctcccaccgctctgtccgcgcgtgcgtgagccgcccgcgccgagccgagccctcctttccgcccctcctttccgctccccgcgcgtcgttcgcgcgcgcgcgcccgcgtggtcctcgcccgcatcgcgtctgcgccgcccggccccgctaccctgccgcgccagcagccgctcggccccgcagccagcgtgcgtgctcgagccgcgcctctccatccgccgcgccctcccgctgcaagccgcgcgcgcgtgccgagtggccgaccgtctggtcgccgccgccgtcaccctctgccgcgccagcccgcgcctgtcgcccgtgtcgtcgcgccgctccaaaccgccccgccgtcatcgccgccgtcatcgcctcggccccgccactccgcgcgcaagccgccaagggacggaggccgagccctcctccctctgccgcgacgcctccgcctccctcctcctttttcctaaatcggcaagggggcaagccccctttctccccctcctttttccctttttcctcccgccggcgtcatcctccctccctcctgtcgccgttttggccgctagccggagcgccagcccgcgccttgaccgccaaagtcggtttccaaaccgacattgccgccccctataaacccaggcgcccgcccttcctcttttccccctcccaatcttctctgtttctcgcccgcgccattgtcgtccctctcgccgaccgcagccgtcacgtgtgtgccggaggagccggtgcgcactaggacgcggaaggggactttggccgcgccctctccttcctcttccccggcccgaggccggagagattactcccgcgccgtcggcctctcgtctcagcgcccctcctcttcatggtagtgcctccctccgttcttcctcctcgctccatctcccccccttagttttcggtggtagcacgagtagcctccccgtagctagccggcgccgccccgaccgttgccgtcgctcaccgtgtgcccgccgccgtcgccgcccgagctccgtagcacccgctcgtcgccagcctcgctcggcgtagctccgcccaatccgacgctagcatcggattcccgtagccgcatagatgctctcgccgccgggaattggcccctcgtgacctcgtcgccgtttcccctcttccctccccgccggttgccgccgccgcgattcgccgccgtcaagcttcctccggcgaatccgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtcccttcccgtgcgcgcgctccaccacgagccgtgaggctacgcgtgggcccgccgcacccgcgtccttccccccaccctagcgccgcgtcgcgtgctccctccgcacggtgagccaagccgctgacaagcgggtcccacccgggaccgcgcgtggtgagcccggtccaccggctctctctctcctccctcccgcgcgcgcgcgtcttgggccgttctgagccgccttcttgggccggccggcccgttaagctcggccgagccgccccttttctctcgggccgcgccctagccgcccgagggaagtctaatttccatccctcttttcttttcttttcttttcttttccaataaggatttaattaaatccttttcctttagacgaaaaatccaagaatcttagaaattcaatatcctcccaaccgtagatccgtttgactccgttcaacttccaaaattcctcaaatctcgagatctatctaatagcacgcttagaggtcattaatagggctttattttcgccgtttgttgagttgtcccgtttcgcgtgtagtttcggagcccgaagacccgcagtgcgaggatttcgaggatcaagcttcagctctcgagcaaggcaagccacctttgaccatcttgagcctatatttgaaatttaattatattgcttgcaaaatattatgcactgataggatcgcacttgatctgcttgtcccgtctgcaaggcagattggcggacctacctaattttgttgcatttgatcctccctttgttaattgcgataccatgtccccttgtaaccatctagttgcgtctcgatattcgtgcaccctgcgcgagtatcgacggacgccttcaaacttaaaatctgagtaacaacttgggtaaaaacttgggttttgcaaaagacttggaaaacccgacacctgggtcggtgcttgcgaactaaatgaatttccaaaaccgcggaccggggaacataccgggtgtacggtttcccgttcttgcacttaaggaccgtttccttggaatttcatccaaacataagacaagtacgaccatatgggtggaatgggacacccctggctgagtaactagcttatcaggggtgccttgatgccgagagacatgtggattcgccggggtggtgtcggggaggacccctgggcttcctggcacagtatggtctgggacctaacctgttgttggtctgggacccctctcgtcggcatatggtaaacctgtgtcagctttggaaataccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcatagcgtagttttgtttgactactgcttgtgaaattgctgttgtgaaaaggggttcgacgtttgaaaatctgtagctgatgggatcagctaggcccgggtggccgtttgaaaagttgtaggcccgggtggccgttgaaaagctgttggccgggtgccaaccttgttttcatttctaaagattgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgctctatataaataattcccccccagttgctgaagaagatgaagcggatcctgctgatgaggagttctttcaggagcaagccggctacgatgagttttagggtttcggcctagttcccaagtcgcgcctgtattgtttggtccaagtcctgcttccgttttccttttgtaatgcagttgtgagctcggggtctgtccgcagcccaacatgactgtactactactctataataaagagacctctgttgctgtgatattctgtcttcctgtgataccagcactgtttcctgggactggtatcgattaacaggttaatttggagcgtcacgggctagttccagtcgggactagttcggggtgtgacaagagatggtatcagagcacaggcttggccctagggcgaaacccgatgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccatggttttggtgagggtcaccacgtcgctcagcttcgtgacctcgcccgtttccttggcttctcgtgtcccgagtacacggggtactccgtgggccgtgttccccctcactgtgagctctctgtgtacctctacccccgtggaggtatacacggagctggccttgcccacaccacttcactttggccaggcccactctccagatcgcgtaccaggacctctcctggactgcgcttcgtcgcctggcccacgactacagccaccgtctcgggggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcttgggactcaggccgcccctgtcacgccagccacctgtcctcccacagctcccgcggctctgcccgcactcccagtggcccgcgctcccccagctcgcgtgcgccgtactcaccagtgtactccccctacccacacccagttagcccttcctacacccccggacacaccccagttgcttcctcccgccgtggcccacgctttatccgcaccgcgcggaagcgtgttgttggttcttccaccgtgttccatttccactacccagctcccctaccgccagcggcccgtgctgctgccggccctcgacaggttccgccggtcccttcgcgtcagccgatcgacgtttcttcgactgaggagccgactacaggaggcagccaggccgacgaggagtagaggaggcagtcttcagcagccgtccgtgtgctaggcccttttgttccgccgccaactcttttggagtcgtggcgaggtagtgcgtgcgtgtgtttgttgtgggtgttgtttggtagtctggttctcctaggtggtgtgcgcacagtcaagctcggtgtagctctgtgacttgtccacacccgttgtatcaggtgtttttatgatttgaaaaatccagtttatgcctagtgtgtgctatctgagttgctatttactttgctccttgccctcctaagtgcttatctgattcttaccccgccctcttctgggagtttagatggctagccgcccccgccgtgcagctcgtgcgccagcccgctttggttttgaagatggtagagccgagccagaagtaaatcatgagcagtctccccacagcaaccgttcgcaccgtactgcttcccgcaacgcagaagttgagcaaccccgccgcagcaaccgctcgcatcgcacggcttcctgtgatgcagagatggaacagtctcaccgctctcaccacactgccagtcacaattctggagaagaacgcctcccttccccacctcatgtggaaaacaacatgcagcacttaatggcagttcagacacaaatcttgcaaggattagccgcagccgtagccggttttcagcataatgcgcatggaaatggccaccctcacatgagcaacaatagatccaagctgacagattttctgaggtctcgtccgccagagttctctcagaccgtcgagcccgtcgaggctgacgattggctgaaagatgttgatagaaaattcaacttagtgcagtgtacccctgttgagaagacgctctacgcctctcaccagctaagaggacctgctgcagattggtgggagaattactgcaatgcacaccctgaacccactaacattgcttgggatgagtttgctacagctttccgtgcagctcatgtacctgaaagcaccattgacatgaagaaagaggaattcaacagacttaagcaaggcaacagcaatgtcaatgagtacctaagtcagttcaacaagttggctcggtatgcccctgaggaagtggacacagacaagaagaagatcaggaagttcttgaagggaatcgcagttggaatgagactccagttgcttgctcatgacttccctacttttcaacatatgatcaacaaggcacttctacttgaggatgccagaaaagaggctaccgaagaatacaagaaacgcaagtctaaccatcagggaaattcttcccgaggcgcacctcgccctcgctacggtcaacccatgcaataccatcagtcggtcactcaagctaaccgccagccaggctacgcccctcgtcctcagatgaaccgtccggcaccccagccacagcagcgtgcccctagtggcaatactgcgccaaacagtgttacctctttcaagtcaccgcagggaccgtcagcagttcagtgtttccggtgcaaccagatgggtcactatgctagacagtgccctcagaatcctaccaacaccagctcagggcatgctaatggcagcactgctagaactcctactccagcggcagctcagtctcgtcctagctcccaggcaagtggacaaggttctcatgcgtccaacaactttggtcgaggccgagtgaaccacattcaagccgagactgctcaggatgctccagacgttgtgatgggtatgttctctgtcaactccatacccgcaatagttctgtttgattcaggagcttcccactccttcatatcacaagcttttgtgaaaagaaatggttggaaaacccaaaatttacgtgtaccgatgatagtacattcccctgggagggatataagggcaactcaaatatgcccggaagttaaccttagaattgaggaagttgacttcctagccaaaccgatagtcctagactcgcaaagcttggacatcatcctagggatggattggttggcaaagcacaaaggacagatagattgtgccgaaaagtccatcactttgcaaggacctggaggaaagcaagtccgctttacctctaacagtcctaccgcaagtcggtctatcttaacctgtttacaagtcacctccttggagtcggtgcccatagtctgtgaatatcccgacgtatttccagaagaattaacgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgcttctggttaagaaaaaggatggctctgaaagaatggtaatcgactatagagccctgaatgaagtaactataaagaacaagtacccgttgccacggattgacgatttgctcgatcaacttaaaggagcaagagttttctctaaaattgacttgagatcaggttaccaccaattgaaaatcagatctgaagatatcccgaagaccgctttctcaacgcgttatggtctatacgagttcacagtgatgtccttcggactcaccaatgctccagtgttcttcatgaacttaatgaacaaaatctttatggaatacctggactagtttgtcgtggtgttcatcgatgacatcctaatatactccaagaatgaggaagaacatgctgaacacctgaggctaataatggaaaagctcagggatcatcaactattcgctaaatttttgaaatgcgaattctggttagaccgagtagcattccttggacacgtgatctcctccaacggtgtcgaagtagatcccagcaaggttgaagctgtacttgcttggaacccgcccaagaatgtgtcagagattcgcagcttccttggcttagccggatattatcgaagattcatcgaaggattctctaagttagccagacccatgaccgagctgttaaagaaggaaaagaaatttcaatggtctgcagcctgtgaagacagctttcaagaaatgaagaaaaggttgaccactgccccagttctcaccttgccagatatccgaaaagatttcgagatcttctgtgatgcatcaagacaaggcttagaatgtgtcctaatgcaagaacgaaaggttgtggcctatgcatccaggcagctcagacctcatgaagtcaattatcccacccatgatctcgaattggcagccgtggttcatgctcttaagatctggaggcactatttaatcgggaacagatgtgaagtatacaccgatcacaaaagccttaagtacatcttcacacagacggagttaaatatgaggcagagaagatggttggaactaatcaaggattacgatcttggaattcattaccacccctgtaaagccaacgtggtcgctgatgcgctaagtcgcaaggcctattgcaatgtagctcgaatacggcctgaccaagatcgcctgtgcagagaattggagaagttgaggctgaccgtggtgcagtcaggtgtccctgccagcttgacagtacagcctaccctagagtcgcaaatccgggaagctcagaaaaacgacgaagggataaaagagttaataaaaagaatacaggagaagaaagacaccaatttctccatagacgaccaaggcacagtttggtgcggtccacgcatctgtgtaccggccaagaaggaattaagagatctcatcctaaaagaagctcatgagtccgcctactccattcatccaggaagtacgaagatgtaccaagatatcaaggcatatttctggtgggctggaatgaagcgagacgtcgcagaatacgtagccttgtgtgacatttgccaaagagtcaaggcagagcatcagaggcccgctggtctgctacagcccctaccaattcccgagtggaaatgggaagaaatcggaatggatttcatcaccggtttgccaagaacccctagcgggtacgactccatttgggtaatcgtggaccagctcacgaaaccggctcatttcgtgccagtgaaaaccacctatgatggaaagaaactagcagaactctacatgacccatgtcgtatgtagatttggctgtcccaagaaaattgtgtcagaccgaggcactcagttcacctcaaggttctggaagcagttgcatgaagccctcggaaccgatctaaactttagtacagcttaccatccgcagaccgatggtcagacagaaagagtaaaccaaatcctagaagacatgctacgtgcgtgtgccctggatttcgaaggcacttgggatcgttgtttgccgtatgctgagttcttatacaacaacagttaccaggccagtatttagatgtcgccgaatgaggcaatgttcggaagaaagtgccgcacccccttgtgctggaatgaggtgggcgaagcgctggtattcggtcctgacatactcaaggcagcagaagaacaagttaagctaatccgagaacatttaaagacagcgcagaaccgtcagaagaattacgctgacaatcggaggcgtgaccttaagttcgaaaaaggagatcatgtgtacctgcgggtatcacccctccgtggtatgaggaggtttgggatgtccggcaagttagcaccccgctacatcggcccctacctcataactgccagacgaggcgaagtggcttatcagcttgagttacctgaaggtctcgcagatgtgcacaacgtgttccacgtatctcagttaaagaaatgtcttcgagttccagaagagcaagtccccctgggtaatatcgagctggaaaagaatctgacctacaagggaagaccaatcaaggttcttgaagaggcagaacgtcaaactcgaaggaagaccatcaagttctacaaagtccaatggagcaaccattctgaagatgaggcgacctgggagcgagaagatcttctccacgccgagttcccggagctgctcccttaggtgctgaatctcggggtcgagattcttgttagggggttggtctgtatcgcccgttccgtcgtggcgcctagcgggaaaattatctcttaaaaaccctaattgtgaaatttgtttcttcgcttgtcgtctagtgtccgtgccatctcaagatctcaatccccgatctatcatcgagttcaattccgaatccaaatccctccaaatcaaattcctccacaaaagtcaagtttgcctcccccgggttcgatgggccgaatccctctcgggccatctccccctccctccccggcgccctctctctctctccctccgttccgccccgcccgcgcgccgcgcgcgctgcgtgcgcgagcgcgcaagccgcgcagaacgcccctcctgcgctcccaccgttctgtccgcgcgtgcgtgagccgcccgcgccgagccgagccctcctttccggccctccttttcgctccccgcgcgtaggtcgcgcgcgcgcgcccgcgtggtcctcgcccgcatcgcgtatgcgccgcccggccccgataccctgccgcgccagcagccgttcggccccgcagccagcgcgcgtgctcgagccgcgcctatccatccgccgcgccctcccgctgcaagccgcgcgcgcgtgccgagtggccgaccgtctggtcgccgccgccgtcaccctctgccgcgccagcccgcgcctgtcgcccgtgtcgtcgcgccgctccaaaccgccccgccgtcatcgccgccgtcatcgcctcggccccgccactccgcgcgcaagccgccaagggacggaggccgagccctcctccctctgccgcgacgcctccgcctccctcctcctttttcctaaatcggcaagggggcaagccccctttctccccctcctttttccctttttcctcccgccggcgtcatcctccctccctcctgtcgccgttttggccgctagccggagcgccagcccgcgccttgaccgccaaagtcggtttccaaaccgacattgccgccccctataaacccaggcgcccgcccttcccctttttcccctcccaatcttctctgtttctcgcccgcgccattgtcgtccctctcgccgaccgcagccgtcacgtgtgtgccggaggagccggtgcgcactaggacgcggaaggggactttggccgcgccctctccttcctcttccccggcccgaggccggagagattactcccgcgccgtcggcctctcgtctcagcgcccctcctcttcatggtagtgcctccctccgttcttcctcctcgctccatctcccccccttagttttcggtggtagcacgagtagcctccccgtagctagccggcgccgccccgaccgttgccgtcgctcaccgtgtgcccgccgccgtcgccgcccgagctccgtagcacccgctcgtcgccagcctcgctcggcgtagctccgcccaatccgacgctagcatcggattcccgtagccgcatagatgctctcgccgccgggaattggcccctcgtgacctcgtcgccgtttcccctcttccctccccgccggttgccgccgccgcgattcgccgccgtcaagcttcctccggcgaatctgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtcccttcccgtgcgcgcgctccaccacgagccgtgaggctacgcgtgggcccgccgcacccgcgtccttccccccaccctagcgccgcgtcgcgtgctccctccgcacggtgagccaagccgctgacaagcgggtcccacccgggaccgcgcgtggtgagcccggtccaccggctctctctctcctccctcccgcgcgcgcgcgtcttgggccgttctgagccgccttcttgggccggccggcccgttaagctcggccgagccgccccttttctctcgggccgcgccctagccgcccgagggaagtctaatttccatccctcttttcttttcttttcttttcttttccaataaggatttaattaaatccttttcctttagacgaaaaatccaagaatcttagaaattcaatatcctcccaaccgtagatccgtttgactccgttcaacttccaaaattcctcaaatctcgagatctatctaatagcacgcttagaggtcattaatagggctttattttcgccgtttgttgagttgtcccgtttcgcgtgtagtttcggagccctaagacccgcagtgcgaggatttcgaggatcaagcttcagctctcgagcaaggcaagccacctttgaacatcttgagcctatatttgaaatttaattatattgcttgcaaaatattatgcattgataggatcgcacttgatctgcttgtcccgtctgcaaggcagattggcagacctacctaattttgttgcatttgatcctccctttgttaattgcgataccatgtccccttgtaaccatctagttgcgtctcgatattcgtgcaccctgcgcgagtatcaacggatgccttcaaacttaaaatctgagtaacaacttgggtaaaacttgggttttgcaaaagacttggaaaacccgacacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatgggagacatgtggattcaccggggtggtgtctgggaggacccctgggcttcctggcacagtatggtctgggacctaacctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgacgtttgaaaatctgtagctgatgggatcagctaggcccgggtggccgtttgaaaagttgttggcccgggtgaccgttgaaaagctgttggccgggtgccaaccttgttttcatttctaaagactgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgccctatataaataattcccccctagttgctgaagaagatgaagcggatcctgctgatgaggagttcttccaggagcaagccggctacgatgagttttagggtttcggcctagttcccaagtcgtgcctgtattgtttggtccaagtcctgcttccgttttccttttgtaatgcagttgtgagctcggggtctgtccgcagcccaacataactgtactactactctataataaagagacctctgttgctgtgatattctgtcttcctgtgataccagcactgttttctgggactggtatcgattaacaggttaatttggagcgtcacgggctagttccagtcgggactagttcggggcgtgacagggcgccggcgtggctgtacatcacgtcgtcgccaccgcctcagctcgccgccgccgctgccctccaccacaacgagcgggcgccggcggggctgtgcttgacgccgccgccgccccctcagctcgccgtcgccgccgcccccttagctagccgccgccgcacacacaagtgagagagaggtacgcacgagtgagagagagagagtcagaatagggtttggctttggagggtatttttgccattaggaactctggaaacattttcttttttaaaaaaaaattgaaccctaacggagtcagcgaaagagggtcagacggaaccttcgtactcgaaaaggagggtcaaataagcaaagttcaaaaggtagggtcaaatcggcaaaacagggtcaaataagcaattgccaaaaaaaaaaaggaaaaagtccccttagactcccttaatagttcattgaatctaatttgtgacccttaactagaaaaccgggtaggatgactccctgaattattaaaaccagtacaatttgactcctccagcggttttagagtgtggtttggcttatgtggcgctgacgtggcggtgctaacccggttttcattccacgtggcgcttatgtggcattaaaattaaaaaattatttgtgggacccatctgtcattcatacacaagaatatattatgggacccaccgacatgtgggacccacgtatcatcctttctcctccccttcttcctcctccctctctctccctcctctctcttttctctcccccttttctctgatctgatctccttcccttattcggtctccgccggatctcctccgccctctgcgccgaggtccacggccggcgtcgtcgggccccctccgccgcgttgctcccacggcgtcctcggctccgagcgcatcgcctcgtctcaacgccgccatcgacccctccgctccctgctccgccatggcctgaccaggcgaccagctcccgtgacgtccatggccggatgacgacgtgctgcgctgctgccatatatacgatcgaggaaggttggagaggggaataacaacgcgtttgtcagattgctgtacgcgtaatatcggccgtgtgcccgtgtctatgtcgtcgagctgcaaatggcgtggaatctccccggtgatacaatgttgctttctagtttgactcgatccggccatcttgtgaaaagatggtgctgattgatctgagagaaagacgccattcgccggagaccagggggatgagcgcccgtcgccgaccggcgcccgccctggagggcctcgccgccagagccgggtgtttgcgcccgttgccgaccggccgccggccatcctccgcgagccaggacggttcgggctccgccccgcttccaccaccaccagagatccacgccgcgtcgccgccgactccatctgcgccgcccggcctgctctcatggatgccgccgcccgtcggtcaccacgcacgccggtctcgccgagttgctgtcgagggaggccgaagaggcgcccccgggagcctgctctcatggatgccgccgcccgtcggtcaccacgctcgccgatctcgccgagttgctgtcgagtgaggccgaagaggcgcccccgggagatcagatcagagaagggggagagaaaagagagagaagggagacagagggaggaggaagaagggaaggagaaaggatgacatgtgggccccacatgtcggtgggtcccataatattcttgtgtgtgacaaatgggtcccacaaacaattttttaattctaatgacacgaaagcgccacgtagaatgaaaatcgggttagcaccgccacgtcagcaaaaccgtcctgtaaaaccgttggaggagtcaaattgcactagtttcaataattcggggagtcatcctatccggtgtttcagttaatggtcaccaattagatttggtaaacaattaagggagtctaagtggactttttccaaaaaaaaaaaaaagaagggaactccgggtcgtgttcaggcccaaccccgtgcgcttcttgggcccggaaggggagcagcctacaaaactcgcgcgagaggagattcatctgctagcacaagattcatctgctagcacacgcacacgtttgagatgatgggagcaccgatgccgcgcggcggcggcggcggcggagaggctcgtgtcacccccgccgtcgccggcgagcagcggcgcgcggcgttggagatgaggaaggagaggctggtgaggaaggcgagctcgctcgcgacgcggtgcgacgtccccgtcgccgtgatctgcccgggcgtcggcgccgggggcgagccgacgtggtggccgtcgaaggaggaggtctgggcgatcgccactcggtacaaatcgctgccggagaaggatcggcggaagcactccgtggacaacgcctcctactgcgagaaccaagccgccgcaaagcaaggacccggcggcggcggcggcgagttggccatggcggcggcgcaggtggacggcatcgccgccatgcccgacgtggagctactggagcttctccgatccatcgacgtctccctggccgccgcgagcgacacgatccagaaggccgccgacgaggctgaacaaagtgtctcgctcgagcgcgcgcacgcgcacgctcacgcgggcgcgctcatggtggactcccaggaggatgccgcgccgccgccggcggcgagcgggaacggcgtcgcgtacgacggcgagcacatcaacttgggcgggtacatgatcgagcacaaccgattcgaagcaatctggcgcgaacacgcgatccctcctccacaaagcctcctgccggacgacgacggcggcgaaccgctgcggctgtggtcgttcgacgacggcgaaacggtagtcttgccggacgacgacggcggcgaaccgctgcggctgtggtcgttcgacgacggcgaaacggtagtcatttgaaccgtgagtgtttttttgactaaagattttgtttttgagaatgttttgtgtatatagtagtttgatttatgcagagatggaaaaagccgctgcgaggaggggacgatcagagctcgctggacttctgtgttgatgaaatcctggataaactgatggattttcgatcgatactttgattagatagcaaacctggagagactgattagatagcaatcctggagagactggagggttatactttgattagatagcagtgtaaggattatcttttttgtgaaattgatgttcatgaattggattatcttatttgtgaaattgatgttcaacgaactagaacgagaaccagcaatcccagtactctttttttttttaccgagtttcctcttttttatcgagttttcacggaaaattatcttagattgaaaacgagataataattaggagaagatatcgtcaaacaacaagcgatgacttatggatgataattggcgctcatggataataattgggagaaggatatcgtcaaacaacgtttgacaagcgatgactcatgggaacttcttttctctttgtgcaacggaaacctgatagatcttcttttctctttgtagcaacggaaacctgcttatcgaaaccaattatttgaatgagcacgtatttggacatgacgcataagcataactttgtaagtgacgcataaacatgactttgtaaatctattatggttgagatccattttacatgcttattgattcaggctctatttgttttaacttaattgtaatctagattattgatctagattactataagctgtattataacaagctgatatagaataaactgtttgcagggtttaatttattggattgaccgactgtatcggaggtcaccgatagaccaaattttctgaaattttagtccgaaattttgaacaaatattactgaaattcatgaaaagttaaaaaaaataaaattttggccgaaataatatcgtatcaaaggaggtccgaaatgactggaatttccaaacctgattgtttgtttctctttctcttgattattaactgtttgttagctgttagtcactcaataatctaagaaaaacacatttagagtggatttatagattgtaataatctatcataataagctatatgtttgtttcatcttacttctattataatatagattaatagaagtaagatgaaacaaacagatagcttattttgatagattattataatctataagctagattactataatctagttatccactctaaaggtgtttttttagattactgggtggctaacacctaacaactagctaataattccgagaaacaaacagctatactgggtggctaacacctaacaactagctaataattcagagaaacaaacagctaacaacttattctatgtagagctaatgattcagagaaacaaacagctaacagcttattctatgtaggctttttataatccaacttataataatctgactcaataatctagattacaataattttaaactaaaacaaacagggccttagtacccttgggtatgcgaatttaacagtctttattcaatttcataaaagaataattcaatttcaataaaaataggaataagtttactgtaactctcttaacatctagtagctaaatctaatcggtatcaatgaaccataatactggatatagtggagtagcttggcggcgttgcgaccgggccgagtcacgggtcggcggtggagagcacccagcccgccagcgaatttttttcggttttagattttttttaaaatatttacagaaataatctatcggccaaaaaaattacaaaaatagaccataccgcccacctctagggcggcaagttgacgtggcaaacgggggaggaacgggcggtgacggagggagggtttttttgcaggaaaacccttgccgccctctggtggggcggcaaggggcccgaatgcaaaaaagccagtcggggccggccattttgcaggcggccccttgccgccctctagccgggcggcaggcctcgctgcctataaaaggcctgccgcctagcccccagccctcattcttccctcctcaattccagtgaaaaaaaaaagaagagaggggaggagaagagaagaaggggcgaagccctgccagattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcattgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatagttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtgaagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagcacaaagaaaatgaggttattcagggagcgatttatagtagagaagaagatatgaaggaagcagtaaaacattttgcagtgtcacttcatagagagttttgggttgccaagtcgaaccggtcgcaatatgaagttcggtgtgttaagaaaaaagatggttgtccctggagagtgcacgcatataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgagagctcttacgaagtgaagaaattcccctcaattgaacatcctggcaagagtgtgctgcaaagggcgttcttagctctacatgcatgcaagatagcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgagcatgatacatgataggcacgttggcattctgcgagcgatagaagagttgcagtttgggagtatggaacgaggataccccggtgtttgggaagatgtatagagtaggtggggcatgcgtcatatgggggctgatttcttcaagcaattcaagaacaaggagctcatgaacatgttcaagaggctgtgcaatcataaccaggagaaaaaattcaatgagctttggaagagattagatgagttgacagccaaatgcagtgatcagcgtgcagcagctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaataacagcattttgtttggagctttcatgcagaaaaagctagaggagttgcataaaaaggccatgaaacatcgagctctagtgcaaggtacccaacagcacaggtttgagatactatgtcaagataaggcaggcatgagtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcaatatatgtgtcatagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcaacagcagatggagctcgccctacgggtgaaggcactacctccactcgaccacgtcctaggcgtcgtcgtgccacgtctggctccgtggtgtagttcttatgttctatgtttcgtcgtgtaatgtcagacttcggcatgtcatgtcttttggtctcgtgatgtaacgtcggactaaggcgcctaacgtctttaggtatgctgatgtatgtcggacttcgacacgtaatgttatgttatattatcgagctctacatatatgttaaattgcacgtcatcggagtgtaccattagtaacgtttgctatatttaaatagcctgtactcttgttgtacataattattctcatgattttattactatttcataattttgcaaattatcttttgttttacattactactttctgaattgttctaacacgaaacactatatttttcagagatggcacgtcagtatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgtattactataagttagttgcgctgtaatattttttataatgacatattaatttgttattgcaggctgcgtgaggccggcctcctaccgatgtgtcggctggtggaggctgccgccggcgacgcggacccggccagacaatagactgtggacaggtccctcctagcagctttggtcgaccgatggaggccagagtcacacacttttcacttgccgtgcggtgaggtagcccctaccctgcaggacgtatcgtacttgttggggctaccgctcgcgggagacgctgttgggccagtgaccacggctgtggactggtaggacgatctgacggcacgtttcgcactagtaacgttggcgacttttgttgaggactggttcctcgcaaccgaggaggtcgtggaccacgagggagagccacacactgaggaggcgtaccaggcctacctacgctggtaccagccacgcacccgtactagggtcaccttcgctcccttggagcagcagccccacgttgcgagcactagagacctctacgccaggcaccacgaccaggacttcgctcgtgctgtgagtaccctgcatcgcaccattcctttatgttttcatgtctttctcttcatcaaattttacgaatatttacgaacaaattaaccatgcaggtcgacgacatcaaccgggtcgtcgttgatggttcaacgacgatccaacatttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtactgactggtccccgtccagctgcgcacgttcctaggccgactccccctccgcacggaggtaagtatttttattactatttctgtacatgcctcgcacatataagtgagccgtttcacctgccgattgcttcagggtttcgtgcaccgttcagcaccccgccttcctcggctaggccttctgttgtgccccccacaggtacttaaaaaaacaacattacttcgacaatcaatttacatgcattatgtcttagcttacaagggtcccgttgtcgatgtgtaggtttcgcccagttcgctatgacgcaggccgcccacttctcccaggctgcaaggtcagcgtctcaggcagctgcgtcgacctcgcacttagcgcagttctggcagtacaccgggacttcatcacaggcagccggcacgtcgagtcagggtccaccactggaccatgctgggacctcgtcggaccgcttgctgccttccaccttgctcttcgacatcactgactttgacttcgacttcgcttcaggctcgacagaggatgtcatcggcccctcacagctgggaggcgcaccgccggtgcagacgcaggaccaggcgcaggccactcctccgcgggacactcgtgctacccgtgctgtgccaccggatcgtttcacctactcccaggactacgtgcgagcacaggcccggaggaccaagcgtggtcgcggcgcggggcagggccagtagagcaatcttctctttgtttatttgcttcacttttcagtactgtatgcttgtgtaatgactacgttgttgttatatgtgcacgatacctttcggcgcatgcacgatacctttcggcgcatgcatgactactttctgccgcaccgatgcagcctcctttattcgcgtgcgatacgatatttgcccgccatttggcgcatacgaccaatgtaactttcggcgccgatcatgcatgtaactttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccaaccggctttcgtcaatggctagacgccggggtgttgaggatccaaactggcgtagcgatccttgtgtatacctactaccaccttggtgccagcgtcctctctgcctatgcggtgatcgatgccaattaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgtgcatacatcgagtgggtcgatacagaaaatcccgttctcgacctaaccacttgtttacaagaaggttgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttctttgttccataaatcctacaacattgggtcgaaggttctttgtttgtccaaatattcttgacgacgatttcatggtaagaatattttgattacatgaatccttattttctcacaacatttactaactttgcttgctttacatttaatctttcctcccaggaaccaccaaggagatgtcaatacagagaatggatagataccagaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttccttgtcccattactatatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctatgacccagactgcgataggcctatataaattatctgagtactaatacatcgaataaggtacaaaataatacctcacttaacatatgaaattgcgcaacaaccaacttcaatacatttttataacaatattaacaagttttaccaataaatacttctttatttattattaacataacatagaaatatcttttggccgtacttttttcatttgggtcccttgtcgctctctattggggcggcaagggacccagatgaaaaaattacggccgcaagctctttatgggcggccaaaattgcaattagccccttgccgccctagggtctaatcgcaattttggccgacggcggcagacggcgtggtcgacccaccgtctgccacgtcagcttgccgcccaccattggggcggcaggggctatttctgcaatttttttggtcgatagattatttctgtaaatattaaaaaaaaaattcgcccgccagccgagtgctctggagcgagacgatactcgacggagacgacgacggcccagtagtgattcttcatattgggctttatactgggcccagtagcttttagccttcttcccaccgcattggcgccgaaaacccccccaaccagcgaaagaggcggacacacggcgatggcggcggcggcggcgggggaggaggcggagagctctgccgccggcgagcagcggcgcatgcccttcgctcgtggcgggcccgtgttcgtccccttcatggtcggacccgtctccacggtccccgagttcatgtcctccgcgctccacgagctgcaggttcgaatccccttgagcacaccgccaaaccctagctcttcaatccgtgcccttgctttggtgtaatcgcgttctgtgttactttgcgagcagtcgctgaaagatgaattgggcgatcctggtgatgaattcgacgaagagctctggtaagccccccaaattccgccgtatcaggtggagaaatcccccagtgtctgtcatgttgttcatatgcttattcgtgttctggtttgtacattttgtggattctgcagcgtagatgagttgagggtcctctcagaggaggagctggtggagcgcgctctccgggaggctatggaggtgaccgttcctatcgagcttatgctaatgtgcttaattgtagttctagttttgtgaacaatattttgatgtgatgtctctgttatttggtgtttttaggagggctgggattccactgctttgtcacagctggaggatcagaggattgatggagggtaagctatttttgcttgattggtgcttcttttatgcgagttggaattagatgcaacacggacggttaattgttggatagcgtcattccatgccaactcataaagaaagttctattgtgaattggtagcatggaacagcggtttgcactttatgcaccaaatcatctcttttcaatttttatggcttgtagctgaattcctggcatctaaattttcttttcatattattatatttaatattcatgtcttatgtggctcacaaaatgatagggtctgatgttctttcgaactatcacatgcagaatgtcagctagttccacctttggaaatggtgctatcacatcaagctcatcaggtgagagagagacttccagatcacctactgaggatacggcaagcataccacatgtgcatggaaacaacggtaaaacaagaggggtaaaaggggaaactagaggcaggaagcgaaaaaatgtcactccgaccttaaattcgtcagttgaaacggagatacctggaccatctgttgacacggcagttgtaccatacgtaccacaacaaggcatcgaagggaaaacaggtggcatgaaggggaaatccagaggaagaatgaaaaaaggtggaaataccacttcaaattcattaggcgagaatctggaagttgtttcacatgagtctgtaccacctgtcgaggatctggaagttgtttcacatgatgctgcaggcgcagatggagatacaaaatgcggaaagggcaaaaagagaggcaggcattttgatagagaagttcgagcacatattttacaagtatgccttaccctaatgttgcatctctgcttaattgcatgcattttctgatgaatttatcttgtatagtagttttctctaaaaaaatatatatacatatttccctcttcttcttgcatctattgttaatctctggaaaatctgaccatggttttgcgtcatcatatgttgtggcatggctataactaggggagctatcttactaaagcagtgaagatggcagaaattaaggccaaacaagaggaagacaaacatgcagccagcttgcactcattcaggtaaaacagttaactttgtgggcatgtatttatttgaccttgatttgtgggtatgtattgttagtaattccattttctgattgtgccataagctcatagatatatattatttaattttctaccgaatgggatggtgttatcacagctttgctgaagagctgtggaatttctgttgataagtaatttgaacttttactgatgggctgtggcaaataacagtgtaaaagtaatgtaaatcgttctttgtggttcagatgatagcaggatgcagcccagtttggctagattcatgtttcagtaaaaaattggtacttctgtgctggctgaactaactaggtatagaaatttacctccccttaatactggattttgattagcccatacatttactcatgtatcctatttattagcccatttatgtaaatcatatatggtatgcccggtaggaatagtttgcttcctttttataactgagccactagagaataagataagtataaaatacagctgtccaggctatgcacttatggccataactagatgatttgattttatctgttatattgttttcattacagccttctataaacatatttttttgaacgcagtggtgattctgtgttggccaaagtttctaagccatcagctgagaaagttgatgttgcaaaatctcttaggtacatcagcacaacttggaaggtttgcattaaaaactatagcctatttcatttgctcttttacacaagtggctcatttgtctcaaatttcacactaaccatttttgttatcccagaacaaaactttcaaacctggggagcacagacctgtagtctatccagaagtacttctgtgtgtggaagtttatgagaagagatatggctctgtgaaagtaatgacttatatacatatattttttggtatacttatttgtagggtgaaatatgtggggaataaattttttggtgatctcctttccttgcagagccaggaatttctagtgttgggaagccagctccttacagatcttagagacaatatttactgtttcaaagacaagctgatgaatgtggcaaagcaacacgttcattctggttattttcttattgaggtatgcatctgtgaacagaaatttgctgtgtgttcttaaagaattgcaactgtattaatcaacgctctctattgtcaggacacattctataatgacacaaggcgttctactgttgattatagtaaacctatacttgactggattaaaaattccagaaatgaggcggaagagaagtgggatgccattacttctggtgtgctgaagaaacgacaaaaggatttactgatgggtttgaatgtttcaaatgttcctgattttaaatctgcaaaaatggaaaagactcgcttttctgatctgaacttccgtctcggtgctgggtacctctactgtcatcaggttcttatctattctccttatgcctttattgttgtgatgtttctgcatcactttttttgtggaaatcaaatcgtcatttagtcacaatcaaaccttgtgttgtttgttatctatgttttgtgatgaaatctaaaatcgattaacttgaagctgtagtaatgtatgatggttgaggtagagatctacaaccctttcccccatgtttctgacaataccctgcacatacgttttcagggaaactgcaaacacatgattgtgatcagggacatgaggttgatccacccggaggacacacagaaccaagcggaataccctctcatgacattccagatgcagaggcggctacagaagtgttcggtgtgccagatcttccatgccacgaagatgacggtggacgacaagtggactctgaacaatccctgttatttctgcgacaaatgctactacctcctccactacaaagaggacaactcactactttatcaccatactgtatatgattacctccaggagtaaagtactcttcgatgcaagtatattttatctgttgcatgtagcccggatcacaggtgcatctttcgatttgttgtccgtaaactgggcagttttggagcaacagaggtattcttcgtgtctatgggcctgtttggggagcttaagattctgagaatgagctgctgagaagctagctagtgagaatctggagaagctgggtcccagcttctagcttctagttcatttttcagattctacaactacagattctcaaaatctagattaaaagatgaactgtttgggggagcttctggcaactgaagattctaggagaagctgcagctgctaaaagctcccccaaacaggacctatacttcatccacaaaatcatctcccatttgcagtcccatctgctttctctgtttcatattacatgtacctttgactttttaagtttgatcaaatttataaataaattcagcaatatctaatacattaaattagttttatcaaatctaatattcaatatgttacaataatacgtttgttttgtgttgaaaatactatgatattttttatatacttaatcaaagtaactcgtaaaatgaatatgaaacagagagggcagaatacaagaattacataagtgacgcatgattttctagaacagtttctataagaaaacattgtgttcttcaacaaaacacgaagctagaggcacgtgaaagctcaggaaagtcatgcccatcctgggatacatcttcctcgttgggcctagaagaaggcagtccactagaaaatactagacctatagtagttggcacgggccaattttgttttcccttaaaaaaattgaggaaaaatagaagagaaatgagaaatggaatggactagcagttgttgggccagggctaatggagcggaggccacatgtggcaacgagaggccgtggagcgccgcgccttatcctcccgccttttcacgtcccgccacgccgaccgcgccatgggccaccaatggccaccgccaccgccaccgccgccgctctcttctcctcccgcaccctttccccctcctcctccccccggcgacggcgacggcgaggcatccccgccgccgtcaccggcttcctctcccgccgccatgctcccgcgctccaacgccgcctcgcccccctgcacggtgaagatctcatctcaccaatgcgatctcgccgtgcggtccagctcgcacgtacgtgatctaattaactcccggctctgtgcgtgattgcagttgtggatgattccaaggaggtagagacggctgccggagatggtgcggaggagaggtcgcagacggacaagctggtggacgggatggacttcggggagctctgcaacgacttcgagtgcataagcagcccctacgtggaggccaccgcgaggcagctcgcccgcgacatcctcgacctccgcgacgacaaccgcgccttcacctgctacgccgtctccgtcaaatacaaggtgtgcgcatcacccttgtaccaccaattaccactttactgctactccgtactatgtgttatcagtaattcagacattaatttggtaccaatctcgcaccaatgctttgcatctcctttcaagttaatctagcaaacatgtaagctacgagtctgatatgatcatgggattccatgaactgtggcaaacactatctgtagttttttttttaacagtactatctgttttttttttcttggaagggaaaaatagagctatgccatttcaatcagcgagtaacgcttttgcgtattcgctccgaaggtttagcaacaccaacaagaatagtttcaggcacagagtagaccccgagaagctcttgcaaaagctctatgaaccaacacaaaatactgctgttagctgatgaatgttttttttccccgaggaaatctgatgaatgtttaagtaggtaacatgcctccattttcagaagttttagccaggctgatgctgattttatattaagaagaatagcaacgaaagtaccactcaaacaacagcaagaaacaaactactgaactagtgacagattaggatgtccagatgcagatacaataactgatgagctacttgacatcaccttgtggtttcgtgcctttctttttttttcaggacccggtcagaacatttgttggacgggagaagtacaagaggccattgtggatcaccaaggcactcgaaaaccctacagtggtaaggattgctgcaattctataccatatccatgaagttagaactctgttgtaagatatctaacccaaacaagttgcataacatactgtccaaaagaaaaaggactttgtcagttcaaattcaaacaaagaatgcctctctccttatttcacattggcatgctcatgagtttggattgattccagtctgactatctaatcagcattcgtgttattgcgtcagacagtccaggaaatgtcaatgcaatcgacaagcaacctgaccatcaaatggacattcagaggcaaacctaagaatccaatcttcgcaaccatcggaggagacctgatcgtctctgttacctcacagttcgtattgaaccagattagcggccaagtgctcgaacaggtcgactcatgggacctctctgcctcgtctcctcctgcccaggcctacttttggttgtccaggagggccttctccactgttgaagccggaaaggacacaatcgaagctgcaaagggtacagcatctcggctatcatcaaagaaagatgagaacttggaggtttatccagatccctcaggggatcctactaaggtacatgaatcatacattgcaaaaattgatgtcactttatataaacccacccacttatctgtagctatccagtgatagtgttttcaactttttgagcttttgtgttcaatattgcagttcttccaaaggccggatgatggattgaaccaagatgtgtaccagattgcgcttttcctggccgttctctacttcattgtacagtttttgagaacgactctgtgattgtactagctcccacagtcccaactcaacctgatactctggcctgattctccaggtcaagcttttgtgtatcagtgtatgcatatatgtgtgtgtatctatttctaacgaaatcctatcagcggcatgatcgacagttgattcagcatctggctggccggggttttcagatgttccaactgttaagtggttcgtgtttgcatgcatgtatgccagattgcgcttccttttttttttggaaacaaaagaggaataacgtttggtcaaaaaaaaaaaagaggaataacggagctggctatctttgtattaagaataaggggtacaagaaacaccatgagatgacgggcctattcactttgataaaaaaaaaaccttaccaaattttggcattgcgaaaattttggtaacttgccaaaattttggcaggattttttatatagttaccaaaatttagctacaaactaaatgtagccatttttttggcaactttattaaaacttggtaaggttgaaaatgacattaaagtgaacaggcccgacaagtctgatttaggattcaaaaccaggacccaggttgactgggcgaacaccctcgcaccatgtcacctgagctatactttgaactattcacggttcccttgcatgaagaatatgtttttttttacaccacccattttcaagttctgaaagaaaatttaattataatttacattcggaaaatcatttgcatgttgtcataactcaaaatccaaaaacatctctgcagcttaaacaaccaccttatccagttaaactgatcgtcttatacatatatgttgaaaattgtacgaacaaatgtgttcctttttttcccccttattacaacttgcaagaaccaccacacaccacccaaacccattttcaagttctgaaagcaaatctataatttaaagggagaaactggtgctgcgcacaaacacacgagctccaaaccgcaaagatgcaaatgttgtcagctcagttcggtttgaagaattctatgaaagccatgtatatctccaaatggttcccggtgatcaccgccgagaccatggccatgactgccctgacgatccgcctgaacgtatcgaggaacccggccgatttcctccggtacttatccacctcgagcacggggaagctgttgcattccacaatggcagtcgaactactagttgaagaagcagcgcttgctccagcagcaggcggcggcggcagcagcatcttcggcttttgcacgccgtaaagcctcgactcgaactgcgaaacgagagctttccggacgcaggcgacgtgcagctggatcatcttctcgctggaggcgtaggcccatgggttgctgaagctcccctgattccgctcgtggcacatgccgcatttcttggtgatcttcctctccagtttcagctgcaccgtctcggtggttatcacgcgggggagatctgcgcagcaagggtgcaggctgaccttcttgtccgggcagtagtacacgtaacctcgcacctgcgagcttcctaaagcatggtgtaaattaacggcgggaaagggttttctactgggaaactattttcatcgagaggatatcctctcgttatttatatattacccaaatagctataaaaaattgaaaaaatttgagaagatgtattaacatgtgatatatatatcactctacaaatatgtaagttcaaattcaacttctacacctcgcaacgaaaaaaacaaattaaaccatgtaagttcaaattcaacttctatattgaatttgaacttgcatgtttgtggagtgatatatcacatattaatatatcttctcaacttttttattctcaatgtatatggctagcaccttttaatctttattcttctaaaagattaaattgaaggagtagttttgaggaaaaaaaatctactaatactattttcgtgaatacatatatatttcatggaaagtcatttttctccttaaggcatcgtttcttcgatgccatcttaaataaaaaaatatatctaataatatagatcaaaggtggtatgttatttcagaaacattaaagttaaattcaacctatatacaaattaagttggaatagaaataataaatatgactgtgaatatgtgaacaatacactagcttgctagttagtttcattatctttttttcaacttgtatgagtcaaatttaaacttacatgtttacataatgatatatatatatatattacatattgattaatgttgtcaaaaataatttatattgtttggatgatatgtaagaaacgagggacatccaaagaaaagaaacaactccatatgttttggaggtattatcgccggcttttacaatggatcggatgacgtctctttttttaatatgcatttaccttattcaaaatatgtacaaatatgtaaaaatacaagtcatacttaagtaactgtaatcataaaccaaaccataataaagaaatcataattatataaaattttaataagtcaaatgatgaaatctatgtaaaaaatcaaaacgacgttctttactaaaaagtcatagagagtattaatttgcagtcaaggtcaaccttgccggaaggaagtattaagaatggagagagcgaggacctcagtagcgcatgcctcgccatccaaggaaagaaacatcaacatatgtttcgggggagtggattctgataactcgaggagatgtctcatcgttgtttgtatgtcacttaaataattatgaaaaaaatttaaaaaaaaagagaagatatattaacatgtgatatatcactccacgaacatgcaagttcaaattcaatttctatatctagcaaagaaaaaaaataaaattgactgtgaatatatgttaactagctataatttaatttttttgcgagatgcataagttgaatttaaacttacatgtttgtagagtggtatatcacatgttaatatatcttctcaatttttttcataactatttaagtaacataagtaacatataaacaatgagggaacatccctcaagggataaaaatagtttctcatgtttcggaggtattatcaccggcttaattttatgatggatgactcctttgattttttttaaatatgcatttatcttattcaaaattactttggtttttaaatatgtatttatgttattcgaaatacgtgcaaatataaatatatacaagccagacttaagtatatctaatcataaaccttgccaggaggaattagtaattaagaataagagagcggagacctcagcagcgcatgcctcgcaacgggcaccagctgtactgaccgacttgaagaagaagaagtcgtgcttgtagaagggagctggcacgcgagtgttgagaggctgcagtgtacaggacctgtggtactgatggttgcagcccgcagtgtggcaagcgtaccggagctcgaagccgagctctttgcagccagagcaaatgaaaggttcgtccttgcgaaccaagcacaccttgtgctcgtgatggttggtgtccaaaatttcggtgtacccggccatgctgagtatacgtacgtacgtaaacgtacctcaccacctcacgctcgccaagctagatcgatcttttgagtagctaggtaggtttcagtagctcatagcataccgtggcttggatcgatctcgcggtcacttatatatatagaaacgtacgagagattaattaattagctagctagtgggagaaacatataggtacacagtatatgtagtatctaataacgtcgcgtaccacgcggggtttagaatgtaagaaccggcaagtgaacttccaaacttccaagtaaacgagtacatcgataggcatcgatagggataaggtgttgattattcttacgagaatgctccttgtcagtcgcccatgcacatgcactactagctacttgcatatgcgtgagagaagtgctgctaattgaccttgcatagttggcaacttttaaaagggaaaggggaataagaagagaggggggggggagtgaaaagattcatacttcatactcaagtataacatgccttaaagcatgttataaggatatcatatataaagatgacaaacacacgtgacatgtcttatagcgaggcacgctactttgtaaactattctaacctaaaaaataaatattaccaaactacatgaaagataaagatttaatttttttttagaagtactcaagctcagatacaaattaataaatcaaaactatatataagaataatattatagttaaaaataagtaaaattgtatattgcataccgatgcagttttaggcttatgaatgtgtaatttttaggtgacctaattttcgcaaatttttatgctcttggaatctagcaatacacattttttaaaatgaaattcatcccaacatatgctacaaagaagctataaccaattattacgtaggttgtggctggatcgaatggctacgaattaaaaataccaaccttaagataaagataataggtattgctaaactttaatctatgtttggcgagaatctacatagccattcgttgtttctgctcaatggcttataagttgcatgaagtctttatcttctatgaaatcagtggttgattattgtgctaatcgaattttgtgttgtatgaagtccttatcttctgtgaaatcagcggctgattattgtgctaatcgaattttgctcacatctgacatcgaacctaaatagaactggagtaacatcggagaatatcagtcgttgacctagatattaccacctccaaagtcatcaaagccgactaggcaaggatactgccacaaagtacacaccacatcctgccgcggttcccgtccgctaaccacgctcacgaaggtcgccgccaaacgcacgacctcgatctaagcatatcaacactgctccatgtgccatccaccaaaaaaaaaatcagaattgttgattaggcttgcttgtttcaaagacaattaataatgttgagttttaaagcgtactcttaggatttattgggaatttttcatcgttttatcacttagctatatcttttggtccactaactaaaggtaagggtataaaagtcttgctgtaaattaactgcgtttttccattagtggtcacatttttttttcacttacgacccataaccctgaaatgcctgaatgcccaacgttttgaatgcgtacgttgtgccccatacacactccggttagttgctacatatgtctgtgtcaatcagactatcaaagtacctagtttacttgcgtttacttgactggttcaatgcatatactacttttttagactatttttattattattatttttagactagttcaatgcatatacttgcggtcatgtcacttgcaagttgcaacatgtgtcctgatccacataaatggcgtagtgcctaaaacgacagctattaatctgatccatgtgcttgtgcatattatcttgcggcagctacacctacaaactagatcgatcgaccacgaattaacaacgcgttaactgaataaagtcgaatataaatttgacatgagataaaactacactactagaaaaatgatctttgctggatcggctgttttccacaataataccggttccaataagaaccggtagtcccggttataaaaattttgatctttagtcccggttagtaacacaaacccctgtcagaggcatgtcaggaggctgaggtatcaatcggcactaaagtagtcccggttgatactaccaaccggaagtaaatatttctctccatatctgatcggttaagtcccagatgatatttcctcctcaccaaaatatttagataagatcatatcctccttctatccctcgtatttccttcctcccctcccctctcctccccccttcctcctcttcccctctcctcctcacatctggcgggcagcgtcggcgagcaagcggctagcgggtggtggggcagcacgcggcggcggccagcggggccgcgcacggggcgacagcgtgccggccgtggtgagcggcagcaggcgggaggcaacgcgccggttctcctctccgtttttttaataatttgtgattaagagatgtataatttcttttattacaatttgtgatttattgcatggatctgatatgtataatcgatctatgatgcatttgatttgtgtgtaattttttttaagatttgtgatgtagttgatttgtgtgtaagtaacttaggatttgtatttgtgatgtgaatgatttgggatgttacgttgatttggggtttgatttaggtatatgcatagcacacgatttggggatctggtgtttgatttaggtatatacatctcactcaatttggaagggaaaaaaaaaaagaaaaatggaccaaccgggactgccgctccctatcttacggcagtcctgggactctctagtcccggattcgtacgttatatataaacaggtgctagtacgtacactaaggaaattagatgagttttcttgtgtggcgctatccatataattcttctatacattgtcctcgcaaactcgcaaggtagaaattcagtaactcatttgttagcagaaacttaaaagtttccctgttatattttatttaaactagttgaattccatgtaattgagaaatcacacttaaaattaaatattattacatgacgtattttattctagaagtattacttatgtcatatgagccaacgcatattcttatatatttattatttaaactctaatggatgaagtgatgtacatacttaaacttaactcaacacctatgatacttcttctcaccatatacgttgaccgaatagtatcaatattttttttttcgattgtgcatccatatggttagtgctatatggagaaaggtgtgatttttctcacacaagctgagaaaatagcccaacttgtcttgaagctaagtcatattcacacatacttaaactctactggatcaaatgatgcactcaaatttcaagaccacactacacaccaatattaattataactcgtctcacgatagacacatcacccagaaatttaattccattgatttttcgattgcgcgtatgtagttgatgccacacggagaagagcttgatttttctcgcataagctgtgaaaatagcttaaagtctcgagtcaaggtcattttcatggacatccaaacttatactctagtggatacccattacaaatgaggattatattatcacccatttgcgatgatgatatctttagtagggacacaaatagtactttctcacgatagatatatatccctaagaaatttatattattttttgattacgcgtacttagttaataccacgcgtagagaggtgtgatttttctcacataactcaaggtagtggtccaacttgtcttaaggcaacatcacacaatccccttcgttccatattactccctctatttcacaatattagtcattctagcatttcccacattcatatcttctattatattattaagacagctcgaaaagaaggcaccacgttcactgtgggggctagaaattctcacattaatcggagaaaaagagaaaattatacaccgttggattataatagatttagattacaacggtttagatttgctatagaaaaaataaagaattatagagctttgatatagattaaaaagtcctgtccgtttagaaaaatccaattggattactatacggtatcaaaaattcaagcgggatacaatacggtacagaatttgttatgattccaaaacgcaagtatatatgcattgttaccgcacatataaaacgcagatatatgaagtagatatacttgggctgctgcggcagaacaagtgacaagcaaagttgattaccatcgcccccaataggtaaagcaaacaaagcaaagctgcaaccagcattccagaccagcaatgcatgcaacccacccagaagcgtccggccacattggcaactgacaacaaattataatcataatcgtgtaaatttattttaaacgtattcagctcggagctgtattcacctcggagcataatttagtgttaattaatgtagttaagcctaaaatataaggcttataggttataagttttacacagaccatctaaaattcaaaatgagattaattatatttataataaaatatgaaataaatttcaaattggattttcaatacggaaaaaatatcattgaaacgagtccatgctcacgaggcatcgaagcttacaaggtgtcggttgttaagaaaagaccatctaaaacacatgacgagataaattaattaacaggcctataaaggagtagagtggtggcggttggtacgacatataaaaattgttaataaaacaccaaattgaatcctaataatgattaaaagaagggatatcaggcagaccgtgaagtaaacaagtaaggcggttgccgggacttctagaaagtaaaaaaaacccattgataatcatatttgatttttaaaatctcaatgacaataaaaaggagaagcagcgggcggggtgcataagagtatagttgcagagctgtcgacggttgacgggacttctagaaaataaaaaatgaattccaacgatagttatattcgatttttagaatcacaatgacaataaagagtaggtggcggacggactgtacaggagcatagtggcatcgtttgatgggacttctaaaaattataaaaaataaaactacaagttcaattttttaaggttcagaacttctaaaaagtaaaaaaaaaacaattattatcatgttcgattttaaaatctcaatgacaataaagaaggaaggcaacgggcaagccgtagaggagtacaatagcaaagccgctgacggtttggcgggactactagaaagtaaaaaatgaacccaaacgataattatgttcaatttttaaaatctcaatgacaataaagagaagagacagtggacatgtcacacaggagtataatggtaacgtttgacggaacatctagaaattataaaaatgaaacccaatgtgacaataaactctaaaaactataaaatccaatttttaaaggttccaagaagaatgaatagaaatattggtagatcgagcaagcaaataaagaagtagatgacataaggggtagcaactggtgtgacttttaaaaactatataattagaaacacgaggatgataaggtttgatctttcaaaatcttaagacaatgagatagctatttaataaattttaagtaaaatcatactaaaaaaatatatgattttgtttgggtactagccgcgcaattgcgcgggccacccagctagttgatgttaatgaatctagacatatatatttatctagattcattaccactaatataaatgtggaaaatgttagacttacattgtgaaatggaggaagtataagatattttgagtttattctgagttaaacttctttaagtacataaggtttataaaaaaaaatcgaaatctacaacataaaattagtttcatcaccaccattgaattttttacagcctatttgttttttttaagaaatgtcgttgctacattcattctataaattaagttgatcaactttaaaaagtgcgacttaaaacaaaccaaaaggccaggtcttatatagtatataaagaggggatcacggagtagcatgatagcagcatgctctacgttcttgctctccaagtataacgcttgcttttagagttcccaatccgattatattgttgcatatatgtgatgcatatgcacctgcacgtagatatcatagctagccggccgcttcacttgatttcattgtttttgcgagatgacggggcacagtaagcttcgagctcccgagcaccacgaccatgagctcacactgacggccgggaaggagtcattccggtgcgatggctgcaaggagcacgggtaccacatgagatacgtgtgcaagctgggagggtgtcgcgcggggttccatctccacgaggcgtgcgcgcagcacaggttcggggattcttaccaggatcccttcaagcgttacagcctcgtgttccataaatctcttcccaggtacagtgcaggacgacgttcgctgcgatggatgcggaggcaacgtaagtcacctctttctagattatatctcgtgcgatatcccctcgttaattgcatgtcactcaaataattatgaaaaaataatctgaaaagatatattaacatgtggtacatcactccacaaatatgcaagttcaaattcaatttctatatctcgcaacgaaaaaaacaaatttaactgtgaatatacgttaactagttatagtttaatttggttttccgttgcgagatgtagaagttgaatttaaacttgcatgtttgtggagtgatagaccacgtgttaatacatattctcagattttttttttcacatttttcataaacatttgagtgacatgcacaaaacgagaggatatccccttaagaaattaaaatagtttcccattatatctctccttctcttgatcatgtttcttgtcatcgatcgatgttttcttatttttcatctactaccttaattagcttcgtccaaataaaaacttttgaaacacggatgttgtcgatcgtgtcttagttggttttaggtgtttcttttttctcaatacctacatgcaattctcgaaatatacgatacttggcatgtttttttttttgagaggggcatgttgttttatatatgtatgattcggaagatcttccgtccccaaatataaaagattttggctacatcgcagaaaactctaagctagtatacgtacgtgtaatcagttgtgcacgcttgcaggtgaatggttatgcgtacgtgcgggacatcggaaggttgcgcaccctgctcaaacgcggcagggtcctgcacccctgctgcgcggcgctgccgaaggtgatcgaagccgagggcagcgtgacgaagctgcggctcacgcggaagctcaggtcgccgtgctgcaagtgcaggcacgtcaagctcggcgacaggaggcacacctgggggtacgtctccgacggcggcggcggcgccggtgtcgtccagatccatgtcgcctgcgccaacgacctcttccgcgaggagtacgagggcgcgcgcctgcagcagcagcagcgcacaagggtggaaaggctcaaggcgcgtctggtgaatatgctgagaggagcggcgaccggcggcggcggcggcgtcatgatcctccctcagctgccgaccggcgtgccggaggagtcgtcgccgtcgccgtggacgatggacagcccggtcgtgaaagcgttgctgtggaccatctgcaccgttggtgctgtcatcaccggtaaccccgtcggtatttctaatttctttttaaccttgtaggaacaaggacgcatgtgttgtacaagaattcgatcaccactgatctagcaattggttaagtcgttaagatcaaaatacggcgacctcaaaacatgtacgtacttatgtgttctggtttgtaaaaagagaaaattgttgactatacatttgcccaatttcaatttcagtttcatatatgtgtattttttgtacagaaactttgttagccatatatgcccaatttcagttccacattaccatatatatatccagcatgtgagtttttttttttagaaaaaggtccaaggacccggcttctattgaaaaccatcacgggccacgagtctgctggggatgccagcttgacagaggttcagcacaaaagcagaaaaaaaaaaaacattaatgggccacaccccggcttgatagggattgcaagtatcaatgaaccaaacagaaacaactccaggctaactccaaccaaaaactctcatgaaactagctctaaacatcacctaacgaggacagctaaatagaaaatcaggttcagaaggacacagtgttaaccaatcccagttcttgagcgtaggcctgatctcgtctccctaaggtgggtcatcagcatctccagactttgtttctgatcagggtgaagcagaggtttcaactgcagcataagggaaatgatttgaaaaggaatgtttagaggatagtaaacgattttttctctaaaaatcattgcatttcttgtcaaccaaagtgacccggcagttgcagcaattaaacacatcttaacagatttgctcttagcaattgagttcatctctaccagtaaaaaaatgtcatcaaaactcctggcagtctgcccccaactcatggcatctctccaggcacaccaaacaaaaaaaaaaacaatggggcaatcaaagataatatggttaattgattcaatttccccacacagttgacaaaacaggtgaggttttccagtaaaggagatgctttttttctcctatgaggtagttctatgaaactaactggtttcatgcatggtaggagatagatccatctcacagcatgccacatagaattactagggtttactaaacatttgaaatcatgaatgggttaagaaatttacgaaaaaaaacacgttatttcttaaggtttttttcggttaatctcaaggtgatcgatcttcgagggtgattcattccacaccttgattccgagggagatttgttctacatccactaaggtgcatggaattaatcccatcaatccccttcaatccatcctcctgtattaatcgaataaggcattaatgggagggaaagtattttaacagccacatgtaacgcccctcataatttaaagtacatgcaaacttagccaaattatgtgcatctacatttagatcccaactttcatgacaaaattctgctttaacaaattgacgtcttcttatattggtgtcattaaggactgccaagtatctgcattttgatcttgtagcaatactcgaaataactttcatgacaatctgaatctatacagaccttcaggacgttgcagtccatggcgatggcaggtccttcattgcaagcaagagcttctaatgtagttggatcggatgtaggtcactctccggctcacatgtcagtgagcgatatgcagtaacctaaaggatctcaattgagttggattagatatcccggtatcccctcccaaaccatagcgctagctgctataaatataccggatgtgtcatgacaaaataagcttcaacaggtccttagttgcctgatcgagtaacaggggcattcgctttgccagatgcgtgctctaagccgcctctgcacatgggccgtctcttccaccgtatatgttgggccttgcctagcagctacatttggggctatgtttgggccggatgcatgtttttgggcctcatcttcgccttcttggcatgttgtcattttgtgtcggtttgggaatttgactagtaggttatttagaatctttattattattattattattattattattattattattattattattattattattattattattattattttgagatgaggttattcagaaacttgatactaccattcacgagcctgtgaaatttgttctcaaactcaaactctcgaagcaagatagttagtgcaaaaagaaaatgaacctgattgcattggttcactaaaccttctacctgtgcatttccgacaatgagcaaagagaaaatatccatgtaatacatgatactactcattgtgacatctggcatttacctacaatatctcaggaatattcctctgttttttttccaagccagaaacgagcagtccacaattattgttcaatatctggcggctggagtttgactaacgagattgtgtcgagtagggtagaattcgcaaaacgtggcgatgatgctgatgtgtttgtgcagctggattggcttttcgctagagacgctggtgattttttttttcttttcacgtggtactgattctttgatggtacagtgcatttggaacacttgtttgttcactgctcaaagggaagacatacaaatagtagaaaacgatgctgaattgctgatgtgtttgtcatagactggaaataacccaaaaaaaacgagataaatatctgttatagcatctactcgagctgttaaattgtatcaagcatgtgctggagctgtaaaattgtataagaaacatatcccgttttcaacaaccagaaaaggagtaatactatggtttcactgttaacataattcggctagttaaaagtctacactgtcaacataattcaattactatggtttccaagtaatactggcccagcatcatgttggtaagttcacaacgctatagcgcctaactccaattcaaccactatacaacacaaccttttgtgtgcagtttctaatctttacttcattagggtctctagcaatctaacatagcatatgtgtaaatgtaaaaggatctatgacatctatgatactgattccatgttaccgtcaatcgtgaggccatcagttccagacacaaagagccatctacaaatgttagacaagctctctcctccatgaaacctcagagatgcgcaggcaccacacaacccgatctttcagataccggaaatgccccatcccacagaaagctataggtggagtgccaccacaaaagtgcaggaattacctggggcagccatgtcatttccccgccaagaaactatctccactagaaaggctatgaataccgccaagcaatgcaagatatcctttcaagctcaccactcatctgccgctgccgctgctgaagaaaaacgcacatccttccttcctagcaccaactcgccacccaattaggccattaccttccaaaattctcccatccaatggcgctacgcctctccgtctcctcctcgcacgggccggcttcctcgccggccatctccacatgccgccccgccgcctgcgggcgcttccccgccttgctcggcggcggtgtggcttctcagaggaggagcctgacggtggtgtctggccctgagacaagggcggtgatccccgtgaggtcgagcggctcggacaccgccactgttggggccgaggcggaggcggtggccgtgaccgggcaggtgacggaggtgaacaaggataccttctggccaattgtcaagtcggcagggcccaaggtcgtcgtcctcgacatgtacacccaatggtacttcacaaaagccacaaaactccactgatctcttcgcgtcaatctccattgatgaactgttgcctcgcatgaattcttcagtcttatcacgagctggatttattttgaaatgagcggcgtgaataagaaagggaacagatctcatcccactgctcagtgtaataactgtaaaactgactggttgatttgcaggtgcggcccttgcaaggtgatggcaccgaaattccaggagatgtccgagaaggaccaggacgttgtgttcctcaaactcgactgcaatcaagacaacaaggtcagttagaactgattttctttctcttgtctacgctccacccaccattattcgattggaatgtatctgctgttttcctgaataaatcgtgctaagcctccttggtgcgtgcgattcgcagtctcttgcaaaggagctgggcataaaggttgtgccaacattcaagattctcaaggacgggaaggtcgtcaaggaggtcacaggtgccaaactagatgaattaatccaagcgatcgagacggtgaagtcaagctgaggaatgccctgaaaatttgcatcagttagcttgttgtcactagtgtacgttatgggtgaaccaccagttattgaagtgggtattcgacatggagacaaacagttaatctagttcttctgcctatgatgatttatcaagcatccagaacaatatacggccatttatatggaatgcaccatgtaaataactatttccaacgtcatgatgatctgttttctaatcttactgatttgcaagtgaacattgtattcatggttagcaaaatttcaaaatatatcaacaaatttccagctgaaccatcatagtttaaacattcggatgccggtttttttttatgacacatcttaaattcttgataacacagatacctacctaagatgacgagcttaaattgcaagtgtcatgaaactatactcaattcttctagagataaacaagcatatttttttaaaaaaaaacatggctcaatgaacacataaaaggatcaaagtaatttatcatggcaaatttcagacatgacatgaaccatgaagaattgaagttaccttaacgacaaactgatccatagatcatccgcccctgataattagcttgtttaaaaccagcttagcttgcagcatctcagaaaagttaacaatcttgcagcaacgagaattgtctatcaattccttgtagtcagactactatgctcccgctgtcaagagtgaaatcaggctgatcaataatacccagaataattgcaccaattagcatcctttcgtgaaagtggataatgaacatggagaaaaaactattgttctagttcttctgcacatgatttaccaaacattcagaacaaaatacaatcatgcatgatggtgatgcaaataatcgttccatacttcatgtcttcgtgaggagactgttactttctgaaattattgatttggaagcgatcgacatgctcttgcctgagcattttctgcatactagattacagaaaattttctttctaaactcttgcagttacaagcattaagatatggattgcaaattgccttatttgcttaccccacaccatttattaaaatatcttgccaaacaattatctaagatatagaggttaaaatacaagtgttggtattatgctgtaccgcatcaattcattgagatgccaaacttactaaagcaataaagttatctgaatacttccacaaaataatttgcattgggatctttcagatataacatgaactgtaaagaagtgaaagtaccttaatggcatcagtagctcctgcatttctggcagttcaataagatctgtttggcatcatctgaaaatttacatttgaaacaaagagagatatgtgttcgggttttcagctcctcaaaggaaacctgccacgctccctctgtcgatcctccacccaactagagcctggctgtttgaagggcagtcttgttctcataactgatctaattctttctgcctcctcccattgttctttctcagcatatatatttgacaacattatatagttcccagtgttgtgaggttccaactcaaaaagtttgtttgcaacaatttcagcaatctcaacattgccatgcgtcttgcaggcactaagcaatgcaccaagagcccctgggtgggggcccattggcatcgtttgcaccatttcaaaagcctcctcaagcctccccgctcggccaagcatgtcaactacacaagcatagtgatcagctcgacgctccatcccatagtacttcaccattgcctcccagtaatccaaacctttatcgacaagtcctgcatggctgcatgcggtaagcacaccgacgaaagtgattggatcaggccaaactgactgagcttgcatcctttcaaacacttgaagcgctaattttgcatgaccatgagctgccagcccactaataagtgcagtataagggtatgcatctggctgtgcaatctccctaaaagcactgagagcctcgtcaacattcccacacttagcatgcatatctacaagtgctgtaagaactttatcgttcctttcaatcctcttcttgtcaacataacttccaacccacccagccaactccgtgctgccaatctgcgaggcagcagatataacgccgaccatagttgctgcatcaggctcaatcccagcagcctccatttctctaaacagcgcaagtgattcctttggcaccccactctgcgcatacccattgatcatcgctgtccatgccacaagattctttgccggcattctatcgaacacctctcgtgcactccgcattgaaccacacttgcagtacccaacaatcagcaccgaccacgaggtggagtccctggtaggcatttgatcgaacacgcggcgagcagaagagacgtcccctgcattgacgtagacgaccaccatggcgttccacgatacctgggttctggatggcatggcaacaaagagggactcggcgtcgggcacggaggcgaggcgggcgtgcgcgcagaggagcgagttgaacgagacggcgtcgggggccgcgatgtcggcgagcgcggtgtgtgcggcggggagatcgtcgcacttggcgtagagatcaacgagcgcgttggcgacggggaggcggcaggggaggagcgcgaggcggagggcgagcgcgtgcagggaggcgccgagcgggagcaaccggagcgacgcggcggcgttgagcgcgaaggggagggagaagtggtcgggggagacggggaggcgcggcatgaggaggagcaggcggagcgcggcgcgcgggtgcggcttggagaggcggcgaatggcgcggttgaggagggaccggatgacggggggcggcgtgccggcgtgcgcgcggacgagatgcgcgtggaccgcggcggccgccggcggcgggtggtcggaggcgagggcacgcgagaggcggtcgaggcgcgggtcgccgccgtgctgggacgccatgggaggtggcccagctgtggtcggtggaggcgattgagtcaggagcaagaaataagggaggcaaagtagacttccactgtgccggagacgtgtagttggggttgcggtttttttttgtatcttgggccttttgaaccagactgggcttttcctgagtttgacggcccaattaatttacctgtccctccttgtttttaattagggccgttttggtttgataccaaaacatgcctttccactttgttggcaaactgaataatatgtgtgttagtttggactaacaccaaatatttggtagtgcctaccttatttggtcatattctagaagtttctcctctatactataagagtttggttttatattggtagcaatccaaatattagctaaataactttaccctacaatattttgatagtgccggagtttacctagaatttggcactaccaatgaattcaggcgttaatatgcagtttactggtgtgatgagatcatgagaagagtgacacacacaggcacacgggtgacaaatgcctaatggttcatgtctccctatatttcacatttttactgcaaaaaagttcttttggacacacctctgtgtgcaaattgtacggcactctggctctttccctgaatggaattggaatcaatatcagaaagttgtatctgatgtcaaatagatcgtataccattaaggcattttaccatacgaacatctgctccaaaaataaatacgtaaagttcaagctatgatcagtgtcatccaaccagctagccatccggcactacaattgacctggcgattggttgtctaacgacggatagaaatgcatgaatgcgaagacacgcaaacagcacgttccaagtttttgccaagtagggatcatacgcattcacatttgcatagcaaatgtttagtgatgtgacctcttaacttaccaaagcaatttaccaataaaaacccccacttgctgactggaccaagattcatatatcatgccaagcctaaccatgatgatccacaagagatgatcagatcagatcagatagaacatcagaccccattcttcactccggttaatctacaaaaacatgattgactgacgccaccccatcagcatgtgacatgtcacccgtccaacaatgacacagtttcaacaggtggacacccaaacacctcatcacccattgcatattatcccattgcatcgcatggcttcctcctcgtgcctatccagatcacctaatactctatccaaagttccaaacgcaccaaaagtgaacccaagaagcagcaacggacagtgaaaaaagaggagggcaacaagtcgacgacgatggcaagcagcaactgagcaaaatgcagctgatgacactagttacccaggtggctgtggcctgtgtggctcctaccatggtcaatcgatcgatcacttgccccgcgccggcatcccactcccacccaggcgcgggtggtcgtcacctactccaccaacccggcagctgcaggaaggcgctgcagttgatacgcttgtctctttcccatcattagctttcccccatagcacatgccgctgctcctccaatccacccatttctccctctcccgtaatgcaaaatacgcaatcgctcgcctgatcctctccccctctctgtcgctcgctgttcctgtgtaacttcaccagttcactcccaagcgctatgcgaaacatgctgtcttgccccttgcccccgactagttcgttcgttaccaactgtggcattggtgtcacaaagaacactatgcaacgcaggcaggattgtgacgtgccacatgtagtttagcggttgcattgacttaagtagcatattcatgatagcaaattttagattgggttaggctaaatttataatttaaaaatattgcatatatccggtcggatgtagaggccgataaaaaatacccttctctaagaaaagatcgtgatgtgccctatgggatccacgtgtcagtgacgagtcatcctgggcgttgccgagctgttcgtaatgccgattggtggttccaccacgtcagccagccgctgtcagcttgcggtgtgtgtggatgtgcagcagcgaattattgcccaggccgggacttcgatcgatcgatcgatcgcaacatgcaatgcgtacgctacgccgtaccagatccaacttatcaattcggagctcgggaagaatgctgcgcccatgtggcacatagcggtgcacggtttcgccgctttgattgataccccaaagttaccaaacggggtttacacctcgagaagaattccgtgtgcgcgagaagaaaaccgtgtacgcgagcagagagcatttacatggcgctcaccgtgcgtgcagtatgccagtattcacatttcacagacaagaacgggtcacacaccacccagcagtcaaacacatgcctcgctggctccgtggcgcggtgaatggtccaatcttatccaatcgccgcccccccgcccccgcgcgcacaaagcgagctcacttttggcgagacatgtcagagaagagccaatggcgagagggagggagagaggtactgcaagctagggaaggcatatggtcaatttggtcatggatgggcacagatcacaatgctcgcccattctctcgcgagactggcgctagctgatcgagaaggcgaatgccgccgaatctgacgcatcaggaggagactagtagcagtaccgcaggatgcgcgatcccattggatgccaacatggacggcttcgcctcagatacgcgccaccggagcatctagcagcagcaacaggacactgaaagccaccggaggagacgcatcatcagcagcgccgagagagacagacagcgacgcttgctgtgctacccaaaaccgcatcatccaacggaacggaacacgcgtgttttgccgatcgccacgctggattggatccgggaacgatccaagttcatcgcccacggcaagaaacagattcaacacgttgtaatccccgaaccatcataaccacgaaaaattatcgccgtggcggcgaccggaggccggcagcctcctctaccggccaccgtcggccggctttgatcgcactggacaacaagaacggcaagaagaacagagtgatgaggaatgaaaggttactaactagtagtagaaaacgaaaggaatgttcattctatctatctgcacagatgccggcccgccggcgacggaccggccgaccactcccatgcctcaaaactgcgcattcttttggtttccgcctcgccgatttcaaccatcgagtccgtccccttcattgcgacgccgcgccgccgccggcgaccgatccgtcctcacacacctgccccgcgtgagcgcccaattcagagatgaactaggtgggtggagatttcacttcgtgattggttcgaggaagaaggattagattacctgcgtgaggaggaggagggggtcgggggtgcagggcggcggggcctcgaagacggcgagggggaagtgcttgaacacgacgccgacgtcgaagtagatgacgccggaggaagggacgtcgacgcggatgccgcggacggggaaccagaggaagaggtcctgcgcggagacgcccgacagcgacgcgatccggccgtagctgatgaccccggccaccgtcgcgttgtaccgcagcccgacctcgaactgcgccgtgcacgactccccgagcgccgcctcgaacctcccgctcccttcgtcgtgcctgaaatccgcgatccccgccggcaggagcccccgcggcagcccgtgcgcccgcagcacctcgtgcgccgcctccgccgccgtcgccgccgccaccccgccccaccccgccgccgccaccaccatcaacaacatcaccacccaccacgacgacgacgacgccattatcaacgaggagataactgccgacgcgaggaggagaagatatggagatgaagatggaatggaattggagggggaggggatggacagaagcggcaataattgagggggagaaagaaaagaaaagaaatggaatggaatggaatggccggggtggtggagtggatggggacttggggtggtgggaccgacctgcccgtgaccgagaaagcggggtttaattttagttaattagttccgcgtaaagcgctcctctattctacggtgtgtttagttatgctgcaatgatgcccaacccttagctgggtgtgcgttttccgttttggctttggtcgcgggtgtaacgtgatttgttgttttgttcctttaccttagtgtgcgattttggttgtgttctaaaggttgttcattaaccctaattttagtttaagggttggtttggtttgtggcctaaataggccttaccaaattttggcactactaattttggtaaggcaaagttgtgtttggattgaagccaaaatagcctaagttcactattaaaatggcctattttgttaggcatgctaaaatttggcttcaaaccaaatagacactaaacactattgaaattaccaaatattggtaagcctaatttagacttcaaaccaagctagccctacatcttaaagttgttccgattcttttttaaaaaaaaacgcagttcatacaaagtttgagctccgtcggcaaaaaccaaaatttaaatttttcaaaaataattttgaagttgattttaagatattttgaacgtttttttttcagcattggttttaaatcactaagaacacatatataaaaatttacctgtaaaataatttttatttcttaataagcccttacggtgtgtttggataatgggaaatggagggtgggattgggattaggaaatgaatgaagggttaggattaaatggaaaagggagaatgaatggttagaatctaaagatggtgggaaatcatttccgtttcccatttgccaaacactttcttactgtttattagagaatgtgggcaatcagtggtaccttagtaacatttgtactgacattggaacagcgtgttgtgtatggtaggagcatatgaccgggccataagggagccgtttgaacgtaaaagcatggaacaaatggatgaaacttaagtaagacttgcgtaaaaataaaaaaaaaaacttaagtaagacgacgatgaggatgagaatgtcgggcgccctcaaaatgctaatgccaatgtggcggagcttgagccagtttggctttgcacgaattatatgtaatttgacctttctaaaaaaatgtaatttgttgcctgtttccttctttcttaatgacacaaattgagtttttttaacacaccctaattttacttgtagactagagactattgtgaatttgtaattatgttcgtagtttggacgatggttcgttactctctagtagaaatgatttgatccattagttattagagataaagataaactagtaatttactgatagattgattaggggtaactttattatttatcattttttgactaatcgatatgtggccatccacgttggcatcactcatattcaatcgaaatatgccaaaaaagaaaaaaaaaagagatttagccactactaaatttcaattatatttctccgtacttttttttatatataataatgtccctccatatttctaccaccgttatttgaggtggggtgatgaaaatgtacatttcactgagagaatgaacgaaaggaatgtaacacgaggaagacaatggtgaggatgagaaccattgcatggtaggctatcctacgatcacacctactacttgcaaacttaagtacaactagagggcaagatggtggagtggacgggaacgagatgatggtgctaatttgcccgtgaccggtgacccccaaaacagtttaatttaggcggtaatttcacgcatagcgttctttccttcccacatggtagaatgtgttttagttttgttgaaacttgagagtgatgcaaaacctgagcggttttaccggttcggttttggtcacatgtatgcctactatttgggcttgttttcctagtactccaagtatatatttttagttgtaaactgaaggaagacgacgacattgacggcgagaatgccagtccgaccgtggagcagcagtgtcttctgctgtcatgtggggcccttgttgcagccacagtgtagagaaagccttgtttctttctcctctgaagtctgaacttaacgtgggctgcctttcctcactgacgcaaccatcgtggcacgaacacgctgtacatacatacgcggtgaaacgcccctaatgctttgcagaattgcaaaagcacaaacgaacaagaaacaaaaatgtcctgtgttctcttctcttggtccaatgccccatagagtgaatgcattagctgtgcatctgggtttttggatgcttccggttggtacaaggcatgtgcgccctcgtatatcattctgacatctcggtgtaccgcgatgaccgggagataaattttgcatccagctcaagctagccaacgaggtacagtattaattaggagacgaaacaaaagcaccgaaacagtatactccttgtttcccggttcagaaaactactgaacaaagttaatgctttggtcttttaccaattaccagtgttcccatttccgattgagcgacgaatcccgatcttgacggtatgacagtttttttttcaaatttcagttaaatctatcgtctcaattttgaattcttaaaaaccatttgaaattttacttataatccgcttccgtcctccgtgaaaacaaaaaaaaaactacagttctcaaccagtttttattgaaaacttaaaccctggtctatattaatgatagaatatcatgtagtaaattatgttttgagattcatgcaaagccctcaaaactctaaccttttctttttttcctttttcctccccatcaccacatgaagtgctcaacacttccgcttcttgttgccaccaacgccctggccttgtcagctgatcgaaatacgctaatggcaccagagaggctccctcgaccagccgcctcccctccctactacccttccccctctatttctcctcaaggtggcggcggcgaggtgcccccgccccaccgtctcccccatctccagcgactcactattgtcggatccaccaccatctcctaactgtacacttgctttgcctccaccaccaacaccagtccaccgtcttcctccatccccgtgactccgatgtcgccgtgccgtccactagttccaccatgcatcgtcgggccaccgcttgtcggcaagacgccggtcgtcatggctggtgaagaaggggtaattggagcttgaggagaaagaggtgaggtcgccggagcaggaaccgcaaagcaaatctaatggtagaaatttacaatattttagcctcaattttctaccaacagtagtttagcatttccgtgtaaaaaaaaatggttgacatgtccgtatagctggctagctattactttctccatttcacaatgtaagtcattctaacatttctcatattcatattgaatatctagattcattaatatcaatatgaatgtggaaaatgctagaataacttacattgcgaaacggagggagtagctagcagctgtagttagcaatctcgtgaactagtgttggccctgcgaggtgtgagttcaggctgcacctgatgggcacaacctgtcggggaagctagcgagccatcattgggagcagcatgatagcagtggggatcaacccattgatccgagcaaaaacacgcacacagggcaggcagagcaggcaccacacgcgcatacgggattcacacgcctccagtacgcatagtgcgaacatattctcctttctgctcgccatgaagaggaaaatctctgcagaaatgcagcctctcgaccgtggcgagctgaggctgagctgagatgagctttcggtcgccatcgacgcatcatgggtggcatcgttgtcgtgcatttggatgctgccgaaagaatcagagaaaacctcgagaagaaagaaagggagagatgcagatactctgtctgtgctgtccaggtttgccttcccttttcttcctttcatcagtcaccaacctgcatgcatggatgatgatttggagagaaaaggggaaatggatgaatgatttgattgcacaagagcgagctaaagctctcatcatgtaccacaacctggatgcacctgtaacaagctcgtagccgtcacctacatcgggaaatattcagcctgttttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtaggatgggtctttttctagacagagagagtatacttcatccgttaaaaaaaacaaacctaaaactagatactatcatatattctagtgcaacaaattatagacatacttctactagtatatatcacgttcagttttagattttttttaaaaaacatatgtagagtagtcgaatgcaagattgcaatgcagggatcaggtcaccaggacaacggatgggccatgcacccatcgccgtcgccggccgcgcggcgcggtggcgcgctccgctccacgctctcttcttccctgatgcccgacaagacccgttctttgctaatggtggtatagaatacttctgtgatgcgcttacaaaagtagatttcgccaaagttaaccttgtacatcagtattattagatataacttttctaactatttgttattttctctttttgaatttatttatgtatttatttatgggactagctatatttatgatatcatattaaaaaaagttaaaatcttgttacaatgtaaatagcatacatttacacttcaaaacttatactaagtaagttatttatattgtaaataacatacatttacaatgtaaataacttatggatgttaacatatatataaatacgaacaatattagaaagtcttataatatgaaatgagggaagtacaacatttatactgtaagttatataagagaataatgataaaagtaaataattaccaacttggaagataagattgagagagaaacactagcaatcacatatttaaaaaatgattgagtcaagtcagaaatgtggcactatatttacaccaaattcgttaatttattggctaataagcttactaactaaaccgaattaacatgccataattacggtcacttggagcctggaggccaagtcatcaaacggcaccggctggacccacgtttggttacgtctcaccaaccggttcccgattctgtgcaacagagaccgaaaggaaagggaaaggattgggatatttgggattaggacaaacagatggtacactttgtcactctatgattattatcggtcacgtacgtactagtaagtgcaggcccctccacctgagccggagttgatagcattagtttagattgttagctagcggctacagaaagaaggattagttggtctaataaaaggtttagttttatggggatcttagaaaggctttaacttttggacgtgttttagttaatcatgagcttgattgggtgccggctgctggatgcatgggcacgttaagtacgaacacgcggcatgatggatgcgttgtcttagctttcgggacgtcccggccggaaatgcctcttatgattattaaagaattaggtcatggggttaataatacatggaaatacagggtctaatgggcgacctttgatcgaggcccagtactggttatgggcccaataaactgtgcaaaggcttcatgggctacaaaggagatcatccacaaaatttgtgggtccaagatagtcacggcccattatttgcaacatactccctccgtcccaatatataagagcatccccagcagctcatctaaatttcatcctccatactcccatttggatagccatccaaaaaaattctcactctatataacttttcacttcaacagatcatccatattacatcctaaatataccaacatcctatattttattaatatttttcaactaccacacatttttactcatatccctctcacctttcaccacttaaaaaaaatctcgggaagtgggtagttgaggatggagtgaggagagagaacctccatatttagcataggaagggctaggtttggagaatctccaaaaatggagtatgtgatggtgactttgctggagcactatttttctcctccatactccaaatatcggatggatgactagataaaggagctgctggggatgctctaagaacctagaaccggataaaacattttatagtactatgaatctggacatcataggctacctgtccagattcgtagtactaggaaatatcccatccgattttaggttcttatatattgggacggaggaagtactcatcagcttccatgtttaatttccacgataatttttttcactaaaaaccaaactttcttcattcattcacgggagaatgtggactggactgtcagtaccgcgcgcacacaatcaacatgaccaaaaagcatcagatgccgctagggatggcaatcgggtgcgacgggtacgggtagtgcctatccatacccgtgcccatgagattatttttttccgtgggtatatctattactacatgacgggtaagaatggttgcccatgcccatcgcccacgggcgccttgtgcccgcaggcgtgcccgtttacccgccactacaaaagtagtggaataaaaagtctacaagcttctaagttcgatatcgaatttaaaacatcaaatattctctgtctcggtgtggtgtctctcctctgacggcgatagagtaagagggagagataataagggaaataaaaggaaaaccgtagaaaacaaagaacgtggcttatgtattctagtggattttgcttctagcctacatgtaagttagatttcgtgggtaaacgggcaaagcgggcatgggtagtgattacccatacccatgcccatttacccatcaggcatagcttttaacccaataaaatatctatgggtataaaatggagaacaaatttaatcctaatagggtttttaaccacgggtaaatagaaaaacgggcacaattgccatccctagatgccgccatggactgtctccatccaaacctacgtgtatcttcaggatgagacacgccgacgcgtcatgccgcctcaaaggccgcggaaacccaaccgcccgtccgccagcccagccgctgtgacgtgctcactgtttcggcggacggacgcatatgtgtccgtttcgcaataaacacacgggagcaatcgcatcacgccgacccaaaaaaaaccgtcccgtccgctccgcggcgcttgacaacgcgtggtgcacccaatagctctagcgtgacaagactcctacgccgtcacgcacccacgcacgcacgcacgcacgcatatatgtgcagtgtagcgtgatgtaccacttctaccaactggtggtagtagcattgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggagatggagatcggcgccgttgagaacgggggtgtcgtcggtggtgaagttgtggcaggcaagagggggaagacgccgcaaggttggaagtgcatgccattcatcataggtgaggctcccgttccagtgatttctttctacgttttgcgatccgtatagtatgttaacggccctttgaatcgtaggattaagaaaacataagaataggaaaaacgcaggattttaaaaaggtatataagtgtaaaacagaggattacaaaacgtaagaaaaacacatgaattaccgtttgattgaaccgcaggaattggatgagagagataaactcaaagaaaaattaccaagaggttaaagctcatgctaaattttctctaaaatctctataagattgtgcattccataggaatttcaaagaattggataggatttaatcttttgtttcaaatggcttcatagaaaattttcctatagaattgaaatcctctaaaatttctatgtttttcttccaaatcaaaggggccctaaaggagcgaaggcaggcctagagtagttagggcttgagccttagacttgtcttcagaattatggttaaattatcttaaaccaccatgtaactttaagaaaaaaaaagcaactcactagtttaagttcactctttaatgatttctagctccgtcgctgacgttactagacctaatacctctgccgtcactgatgttacttaggctgcgttcgtttccagggacctaataccaactccccctctcatatttcgtgtacacgcttttcaaacagtgcgtttttacaaaagtttctatacaaaagttacttaaaaatcatattgatctattattttgaaaaaaaataactagtacttaattaatcacgcactaatggaccactccgttttacgtgtgaagggaatgagttccttagccaagaaacgaacgcagccttagacctctcaaatgctgcacggctacaccgtaggcttgaaaataacaagatagacgcaacgctcaaatacacgtatgtatacacacgcacacctacctacacatattgaatggcaaggtttattttggctacaatttaaacatgcccgaagtcccctttttatagatagtttcatgtgaaagatcaattcatttcctttgataatatagaaaataaattgcatcctgagaagggccatatatatagatcatagatgtatatgtccatggtattcgtattcgattagcacgtacggaagactcttttaatcactcgtattcgtgaatcatctcattaatacttctacatgactaccgtaaatcatatactaatatccattcaatataagagtattttcagactctgagcctagaccaagtatatgttgatttggtctggcttggcttggcttctttgtctaaatttagacatgacaacatgggtgctctaacccggtgatccctgcacaggatacaccctgcctcaaatcaaagcaaaaagggattcacgaatgaattatgttgtacttcaagcggatcaaatcaaaatgctcattataatgtactgaatggatgcccttttctgattgtatctatgtagcaactgagacatttgaaaaggttgcgacaattggagtggtagcaaatttgacggtctatcttgtgaagcgcttcaacattgggcaaattgaggcagctaatattaccaacatattcttcggtacgcttaactttgcgccattgctaggcgccttcatctccgacgtctacttgggaaggttcaaaacactagcctatggatgcttcgccagcctcctggtatgtccatatgatgaccaaaccatctctcttagtagtttcatttcacctgcttggcagcagaaagaaatgcaaggtcacttgtcattgtcaaataaggcttcacccaacgaataaaaagatcagcaatagcttaatgcttttttttcattagaaacgaagaatgtacaataagccccaactgatgcaagaaactgatatatagtgcacatccaacatttttgttgatttaagctcttcccaggagtgtagttcatcaacatgaactcattttaatttatttatttgctaaaataacaggggatgctgggaatgactttgtatgcatcacttccagctctcaagccaccgatctgccatgaaaaaacccgactaggcggaggctgcaacagtccatcaacactccagctaagtgtgctatacctttctctaggctttctaattatcggtggaggagcgatccggccttgtagcttgccctttggagtagaccagtttgataagaccgacgaagaaggtcgaaagggactaaacagctattataattggtactatggaacaagtactgctgcccttgtgttatctatgattgtcatcatctacatccagaacaatgtcagctggccaataggatttggcatacccacattactcatgtttctcgccattatcatgttatttctgggtaccaacctgtacgtccatgtacaaccagagggaagcatatttgctggaattgcccaggttttagtggcttcatttaaaaagagaaatctcaagcttccttgtcctcatgatataaaccaacaaggattgatgctctacaaccctccttccaagggcaaccgcgtattcagattgccacttacttcccagttcaggtaaacatctgttaccactaaagatgaacagaattggaactaatgtagctagagatgtaatcaacttagagtggaggaaaaactaaaacaatgactagtcatagtgaaagtattagaacatccaacaaactgagaagtgataaatgcattgtcatatgtatatgtgcacacacttttacgcgtatagtgtgcttcaggagtttttgcaagaacattacaatgaatcggatatgggttggttttcttgaaatttatatctgcatcaatcccgaggcacatttgaaattatgatgttgcatgtatatatgtacatgtggaaaaaaacgaaatttgaaaaacataagttcttgacattgttctattttattgccaaaacattgtaagttttcaaagcaaagcaacaccaaataattaatcaggttgttgaatttagtgatttttattcattacctcttaccaagttgtaagactcagataccttttatacagttgaatattaaactcatatagatcatgcatatcataacttgcacgagtattttgtatgcttatcaacacgagcacacataaatatttactgatagatgctatattgctatctatgtgctgggcaagaaaatgcagaaattcatatttgttggtaaatatacaccctttttcctctagtaaatgcatagaatgcaccacatgcttaaatggagttaagaagaaacatgctggtcatatcaaacaaaatactgaccctttcaaagaattatatgctagatgccatcatagtttgatgcatgttactcatcctcaggtttctgaacaagggtgcaattgtaatgggtgatgatataaatgttgatggttctgcaagaaactcttgggagctttgcaacgtccaacaaatagaggaggtcaaatgcttaataagaattgtgccggtttgtatttctggagtcttatgctttgtcgcattggctcagcaattcacctatataatcttgcaaacatttacaatggactgtcactttgggacgcactttgaaatcccagcaggctctgttgtatccatatcccttattgccctaactctattcatccccatttatgaccggattttagtaccaatagctagaggattcactggagtggaaagtggtattacacttctacagagacagggtataggattggccatttctcccatttcaatggtggtagcaggacttgtcgaacgtaagaggaggaactcagccttgtcgaatggaggaatatcgcctatgtcagtcttgtggcttgcaccccaacttgttttaatgggtattgctgaggccttcaatgcagttggacaaatagaattctacaataagcagtttccagagaacatgcaaaccctagcaggatctctgttcttctgtactatagctggagcaaactacctgagtactgctctggcaaacatcatgagaaaggtcacgaccagagatggtcactcaagctggttaacagacaacattaatcttggcaaactcgactattacttctattttattgcccttatgggagtcctgaaccttatttattttcttatatgctcacacttctaccaatataaggtaatgtcactccattctgaagaatccatcaaaatacctaccaaggaagaagaagccacagagatcgacattgacacagatgcacctagcaaatgaatagtgcaactgcgagtctaattgatctggcacaaggaatatacttttggacatggtgacatattcaaattccaatttcgaattcactttagaagaggctctaatgtttgtaacatcaaacagacctctgtgtcatcttatggatgtgacaaaaacaagtgtaccatagcaagggggtgacatgttatctagcaaacatgaataaagagtttaaatggcctgtcctgttgtattcgaagtaatggagtgtgagtgatagcttatgaaacttaaacaagtccataatggttatgcgacaagtaagcacaggtcatacaccatctttttctattagagcctttaatgtgcaatatttgaaattcttatagatgcttttacgaacatgatttgcagtaactagccatttatcaggtaataagaaaaaagtgagctctattaatagttgtgtcatctttgaactattgctgtcggtaatctcacattctcacacagtgtgggtgatccttcgtatacttaatgtctaatataagtaacttttttttattaaaaaaagtcatgccaggtggagagatcttatttgattgcttaaaatgttatatgataaaaatcacagaaatgtttatatagaataaagaatttatggtaccaaaaaaatcttcattccagaaatgtaatgaacatgtcaatcgttaaactcaccgtggaaagtcgtggaacaacaactggagcaccacggaccttgtcaagagcaaaacttatccgcaatggtcgtcctagcattacctgtagaataaaaagaaagaccatgtttattttcctgtttatttttcactgaaacagttaatattacaatctgttagacatttctcttcatcaaacagtacctttccatccatagcatccttggcgcacttagcttcatactcgtttgagaagtgcacaaacccaaaacctcttgaccttccagagtttttgtcatacattattctcactgcatcatcaaatagtcttcatataattctgttcactaataccagcgtaatgaatatgtaaggaagggattaagcattgcaatttgtggggtaaatagaataaacaatagcaaaacacatgttgccacacacatcttataccaggcaaacaccaatatgcctccaccagataattccatggcatatgcatattgagatgtcatctttcagaataaaactatatgataggtgataaataatcacgccacatatgaacctgcttcaaacagaagcaatagccattgacactggggcatacgcatgaaaagacatgaatggcagcatctatacaaatatgtgggataatttagacttacagagcagacaaatgttcattgattgaagagaagtgttagtacttggtagatatatatgtcatgaaacaaatatagctttcctctatgattatctatcgagtgtcaacatttgtgaactatatctgttggtgggagcatgaaacgttaacacctttaaggcagaaaagtgggacaacgctactagatccttgaacaaacatccaagataaattttaaagtggctgattaatagggactgccaggctgccaaatgaaatggaagtgcaaagcaacacttgcacatatgtagaggtgcacacccagcagccccaatatactgctcatttttttttaaaaaaaaaaactgccacagctggtatttacaggctctatcaccaattctttttactatcaatagtatgttgttgtcctagcatgtaggaaagtcaacatgcacaatccagatgagggcataaggtcagatggaggatcaccgtaaaaactccaaggcaacttttaaaaaggaaaaaaaaagacaaatgaaaaaaaggaagtaatgaaaaatgagtatgcactaaacaagctgccttagaccttagtgtgtcagtaccattagaatccatattcacgtgttagagattcctggagcaatagtgagttgagatgtgatatcgttggtcatgttccatagaccaaggcatatttttcttttaaagaaaaaggtccaaggcaatcatctatttcatcaacttgcatttgaaaatcatgcttgatgctttactttttccacaggagacttggcaacctgaaagtgaatactcaacttatgcctgagatagattccaatagcttgagacagacagacagtgaatactaattgtttgatgtatcttctctcttccctaggtaagagttgttctactatcttctgctgtacggcactatctcaatggaactaagccctaaagttttccttgtaattcgctttgcataacaggatctgacagattcagcagctctatatttgccagatgatgcataagcattagaaagtaacacaacatgcccataatcaaatgattccgtggtgagcaccttctttgcagcaactttagtaaatttcatgtcaccatgcaaatgccctcctcccatcaaagccttccaagcatttgctcctaatttattgtgagtcaagctagccactcctgctgcttcctccaagcggccagctcttgccaacatatcaactatgcatccgacatgctctgggcatggaattattcccttgtcattaaccattcttctaaagacgagcatcccatcatccaccagtccagagtggctacatgctagcaatgtgttcaaataagtcacactgtcttgatcctcgctagatttctccatttcattgaaaagtgatactgctttctctccttggccatttacaccataggataaaatcatagtattccatgagacagcattccgagaaatcatctcatcaaacactttatgcgctaaagtcgcatatccacacttaccataaactgcaatgagggtattaagaacaggtttgtacagacacaaacccgatttgtaacaatatgcatgaagttgaatacatagttcaaacttagcaacctcatagcaagcaagcaataaggtgaccagtgtcacagaatcaatcataaaggaaccttcatgcctcatcttcgcaaagagatacatcccttctagggcatatccattttctatatacgctgacaccattgccgtccatgaaaccaagcttttctccattgtaccatcaaacaacagtcttgcagaacttaaatcctcacatttagaatacattgtgattaacgagttaactgcaggaagctcaccactgaacccacagattacaatctcgttatgaaccaactttcctatccttccatcacccagatgtgcacaagcttgcgccactgtaaccaatgctaccctatcaggcactatgccactcaacctcatctgaacaaacatatgtataacttcaatagcctgggcttcctcaagaaggaaacccatcatcatcgtccaagaaacaacatcattaacagcgatctttttgaaaatctctcttccaatcgcaagactaccaaagctcaagtacatacccaagattgagtttgtcactgagacatctgaatcaagcccaatcttgactgaataagcatgtgcactctcacacaatccaaggtcaccacaaccagcagaagcctgagcaatgctaatcatagtcacaacattatgaactggtccaaatgaaaacagcaacctcttgaaaaccagcaatgcttcctcaaacagatcgttgtgcactagaccagaaatcaatgcattccaagtaactataccaggatccctcatttcaccaaacaatgcccaggccttcgtaggacgtccacatttcgcataggaatcaagcaatgcggtccgaacaaaaggattggattccaacaggctcttcatagcccacccatggatgcactcagcaagcaccaagttgcccatcccagcagctgctattaaagcaccaaccaatgtgaacgagttggggctcacccccaccctcatcataccaacaaacagcctgacagcctcgccaaacaacccgctcttcgcatgccggtagattgcagccgagcatgcgaccaaatccctaacaggcatttcatcgaacatttggcgaggtcgcgcgcgagcggaacacccacttcctcctccgagccgtttcatcgaacacctaccgcgcacaccatctgaaccctcccccagtcccccaccgacaaccactcaataggttattctctagaccctgaaacgaaactgtttcaagtgacaaaaggtcgcgattcggggattaccttcggtgacggtgccgaaggaggagaaggcgtccgtcagcgaccgctcgtccgcggaccacgacaaccctacgcccgcgcgcgcaatcgcgcgagagagaaagcgtagcaaagcaacaaggtgagaaccatggaacagagtggggattggattgcggggaaggaaacggaggcgggagagcagaggctttaccggcgacgaagagcttcgagttggagggcggcgtcggtggcggtggaggatgcggaggaggagggggcgactcgtcgggtggtggatcggcggtggcggcggcggagagagcgcggccgaggtggcggtggtggtggtggctgagaggagcgaagcggaggcgggagagcagcgcacgagccgccatggcggcggcggagactgcagctgcgacggctgggttaatcgcgagcacggcggcgccgcgatactcaaagtgaaccacgtcagggtcgggagaggaaagaggcctcaaggctgcgtgggctatagcctgagccccgaggactcaagtttcgaagcccaccaagaatcctagcagaccttggctgctatccggaaaaagtatactttgactccctcaactatgacacgagtatgattcatgacctccaaccataaaaccaggtatatcgactccttcaactatcaaatccaatgcaaactatatccttgagtggttttggaagcggttttggctgacgtggcgcctatatggcggtgttgacccggttttcgtctcatgtgtcgcttatgtggcattagagtaaaaaatatatgtgggaccgacatatcattcatacaaaaaaaaagtgggacacatgtcctcttcctccttcccttcttcctctcctctcttctctctccttcctcttcctcccccctcttcctcctcttcctcttcctgcggcggcgagcaagggggtacccgttctgcaacgagacgctggcagcggtgggcgggagcaggagtggcagtggcgggcgggagggcgagcgaggactagagcggcgacgggcggcgacgaccgtcggcggtggacatgagggtgccggagtgatggcggtggaggccgttgttgcctccctcaccgcgggtgaccccgccgacctccgtcccttgctcgccaccgccacaccaacattcccctccctccgcatctcttacgcgcccaacttgccacttttcctctctatttttcttggctccggccttgccgtcccttcttgctcgtcctcaagccgtcattcggcgattccaccggcagcagagacgactcagcgttgacgacgtcgacccccgccgtggccacttcatcgtctacggaggtgacaatggggagcgtcatcccagtgtagggtgacgtaacgataaggagagcgagaagggggaagatgggaatgagagatatgatgacatgtggggtacatatgtcactgtgtcccataatatttatttgtgaatgacatataggtcccacatatttttttgcttttagttttttattctaatacaacataagcgacacgtcgacacacgtgggacaaagaccgggtcaacaccgccacgtaggcaccacttgaaccaaaaccgcttccaaaaccaccaaaagatatagtttgtatcggttttgatagttagagtccatatacccagttttgtggttgaaggtcatgaatcatactcgggccatacttgagggagtcaaagtatactttttccctgctatcctcattatgcctatccggcccgtagatcatagcccaaaagaagcccaacagggcagcagcaagcagacacagactcaccctataaagacacacacatatcctactctagatgtacattcggaagattggaccaaattggagtggcatataatatagttatatgctatagcgcatgattcggatatgatatttctaaaactgtgaatgatgcaatttttaggtggattgtttgacaaagttctatttggacaatatgatttgatattctaatctatttattttatattataagtcgttttgatttttttagttaaaagtaaatttatagaaaaatatagtagtatttccaacacaaaataagcatattactccctcccccgcattcaattagacacggtcaaatttagcacggtttccaaaattaatttttaactctaaatttatcatatattacaatgtttgtagcaacaaaatcataatcatataaaatatattcaatgttaaattcaataaaattaattgttttagatattgctaaatttttctatgatactgatctaacttaaaaaatagtttgaccaagaaaaattcaaaacaacttataatataaaataaaactgagggagtacaaattagtacggaaaacaatcacggacacagggacgcttgacggcttgagtaaagcaatcttgctaattaattcatcgtatgcggaaatacactggctgatatccaaggcaacgaaagaacaaggatcacatactgcaacaaaagaactggagtagtagaaggctagaagctagccctaccaggtgacacgcaactttcagtttatactgtacgtacggtgctttgccaccggcagtacagtagcctccaggtagcagagatgcgttgcttctctgtaacgagcattagctgttatgtcactcttcctaagcttgctttcatccatctcaagaaaacggcgttcctgcacctaatgcactaattaccctatactcagtagcagaccagagtgagaggccgagagcaatgccaggtgcaaaaaccatcttaaatcacacgcaaaaatcttgacttgacaggcagaatcattcatcatttcgtcaaaggaaaactcagctaccaccactgcactgtaaccaccgagacattcagaattaagcaacgaattcgatctgaaagtgcatgtctaggacaattaatcattagctcaaaggaattgatcagctggtgtgtttcaggcaaacaagtaaacaacagaattcagtagtacataaatatatatcagcgcgtctccatgtatagagaatcgattatataggtttgaataaacattatgcgaccgaagaacaggaagaaaaagagaaaaaagaaagtgtgacaagctcaaaacaaattaaaaggcgtttaacgatgacgacacattgaatcatttctagaagcaacagcgcatctgacttggcttagctagcagctaacatgtttctgaagcccttttttagttccacacatcattggatggttggccactccttcctaatctcaaagtagtaactcatctccaagtagcatttgccatcatcatcaacaaactgatttaacagaaaaaattacagccatggttagtaaggtaattacctcgattaacacatcagagctgaacttgatgagtttgaatacctttagtttagcagaataggaacctcttgcgaacatgccagctggggtggtctcctcttcaccctcatatgtgtagggctctagctggggactgaatgtccccagcatcaccttctggttctcaactgcaagtcagaatgcacatatatgacacatcatatgacattattggagttcattgttccatagataaaagaataccttaaatgcataattaaatttctcttaattaacatatttctttactgaagaatgtaggaaaatcctcgaataaaatgacctaatgatctaagatcagtatctaaaatggcatgtcgtcgttatatttatgaagagattgcagcacatacatgaagatcatatgggaaatttaatggaacgatcaatttgtgccgttgtttctagaaattcaagcgccattttatctgatctacaaaataaaatacgcaggttcaagtcgtgcgttgtgtgtcacctcttactccagtcttccagacagtgttggtgtacttgaggcctgacacgatgttgttggagacgatgaagctgaagcggaagctgtaagtgctcccgtccttgagcgcgaaggcgtagcccttctcgtcggggacgaacgggatcggcagtacaaggtccggcctatccggcgacaggatggtcaggttcagcaccttcacctccggctcagcagtctctgcatatccatgcgcacgcccaaaatgtcgttacagatcgcacatcaagaatgtgtcaacgaattcaggcgagaagcatatataatgatgaattggaaacaagcgtagatagatacctccaagctgttcagtatcaacctgcccgaggagttgctccttccacctcctcaggctctcatcatcctgcattcgcagaaaagttaaaactatattcagactcaattagcatcagatcaacaacaatggaggaatgcagtggattatattacgtaccttgtcgagctcgagctgctccttgagggggacctgggggccgagcacgacggcgcgcttgttgccctcctcgtcctcctcctcctcctcgacgtcgttcacgtcggggttcctgcccgacgcggtctgctcatgctccttctccttgtccttactgtccatgggcgcgcgcgcgcggccggccggttggtggtggctcgcggacggacgacggcggacggagctagcgaggtagcagcctacagattaaccgatcgatcgcgcgctgcggtgggtggcgctccgtatgtatgggtgagggggagggagcggctgggcgcgaggggtggagggccgcgggatcgatcgagcgcgcggtggtggtggtaagtacgtggtgtgcgtcgcggggggcgaggaaagggtcgtggcgtgcaggagaaacgcgcggccgcggcgggacgggagagggtgccaagtgtgcgcgcggccggcgcctccgcggcgcgcgcgcgcgggatgtccgctcgatcgatcgctcgctctctcgtcgatcttagcagcttgctcgatcgttggctcctggctgctattgtggttggcgggccttttgcgttcgagttcttcctccctctctctctctctctctctctctctctctctctctctctctctctctctctctctctctctcgtattttcccatgttacatgctctctcttgcgctccatatcctcgctcctcttcatgcaacgaacgacttcattaacgaactttaaatgatattttatcttaaattatacttatctaatatgtaatccgaatacagcgccctatttgttacaattaaatctctactagtacaaaatatcatgtaattatattctaataaaaaatgtttagatggttaaaatattgtgttttataccggacagtgaaatatttcaacagatattttattgtgacgttgcaattactaaaacgattttgctatacatcttacaagtgattttttcactagagagaaatcacccgacaaaatggatagacagtttcctttgatcatgtgacgtttgattatttttttttcgccactagtcagacgcccgatacctagctgcgtccaatgttttagaaaggttttcttcatggaaactgtagtcatcagatttattgtaggaaagcaattgattttttggaaggcatattatctccagggattcaaatcgattttacattagggggaggtgttaacagactggactctggagtttggacggtattaaggcctactcaggctctcggtccatattacaactgggcccaccaagttcgtgtacaatattgtactaggtgggctgagcaaagtcgagtcagctaccagattgggccgggccgagtagcacgaaaaccatcgcgtgcacgaccactccaaagttgctggaagtccgggacggcgatggtcgccacgcctgtgcggtggccgcgggtgctgactccggcgcacctcgccggcgccatccgccggcagaagagccccctcgacgccgtccatctctacgccgacgcgccgcggcgctacccgcgctcctcctaccgccacaacgacgccgtccactcctcgctcctcgccgcggcctccgcatcctcctccgatctcctcccctccctcctccgccgcatcctcccgtcctccccctccgccgactccctcctcgccgcctccatcccgcacctccctcccgctgccgcagtctccgtcttccgctcctccctcccatcctccctcgccccgtcttggtcacgatccttctccgccctcctccgccgcctcctctccgatggcttgcttcccgaagcggcccgtctctttgcggacttcgcggggaggccggaagtctctctagcgtcagaagacctcacctcgttgatcactggattgtgccgtgcgcggagacctgaactcgctctgcaggtgcttgatgaaatgtctaaccagtgcctcgcaccagagaaggacgcttatcgcgcgatcgtgcctgcgctctgcgatgctggcatgctcgatgaggccacacacgttctctactccatgctgtggcgcgtgtcgcagaagggatgcgacgaagatgttgtggtgtaccgggcattgctggtggcgctctgtgcggctggccgaggtgagcaggcagagattgtgttggataaggtgattaggaaagggttgaggtcctcaggtagccggcgatctctccgtgttcctatgcttgctgggcttagtattgaggatgcccaggaaatcattgatcaggcattggttgttcgaggtgggcgtactgttgcaagctttgaagttatggttattgacctctatgatgagggaagattgaatgaggcagacaatttgtttaaggagatgggcaagaaggggttcaagccaacaatatacatgtatgaggcgaagatcacttctttatgcagggaaggcaggttggatgaggctgtgaaggtgttggaggaggaattacccaagaatgatctcattccgaccgtcacaacatataacttgctaatgaggggactttgcaactcgatgcaatcaatgagggcactcagataccttggaaggatggataaacagcttggttgtgttactcggaaagagacattttcaatcttgatcagcggcttgtgttcagaaagccggttcatcgacgcagcacagattatggagaggatggttaagggtcatcatagacctgaggcaggcgaatttaacaatgtcattgaaggtttatgttctgctggtagaacatatgatgcattgctatggcttgaggagatgatcgaccatggagaaacacctgatgttcatgtttggtcttctttggtttcagcagctttaggattaggagaaggccttacaactgctgctacgcattaagtgggattgggccaagtacattctttaagcacaaaaacatcactggtttgagcgtacagaattagcctcttttgtatgtaagtgaagtaacatttttatcatcctgttatttatgcagttccaaaaggaatatctgtaagctaattatttctgcatgtagtaacaatatatcttaaatctactttagtcttaataatggttgcgatgaggaaaaacagtaagctgtttttatttactatacttaatactacatgttatgagttttgagtccactgcttagacgttaaacagagcattaacttgtcaatgtgatgtataaaaccatattgaaggttgattatattgttgccacaagatacgagttaaattaacaataaaattagcatgtggtattttgtacattacaaaattgccaggattacatcaaggcagaggtacaaaattgccaggtggctacatatctgatggatcaaccaagcagagtttacaaaattgccggatcttctccagactactaaaactgctggatcaatccaatctaacctacaatattatcgggtcatcgaagcagagctacaaaattgctggatcttctccaagcagagctgccggtctgacagaactgctaggtcttctccgagctgaactgccgggtttccaaaacaacaaggtcttttccttgcatcaaacctatagatagatagccccatgtccctcgcttgttggccaggaaaattgctcgggaacttggcggcggcggtggcaacatcagttgaatccggcggccatccagcgtccaaaattgccgggtttcaccgtattgcgacggctactctagaccttactgcagatcactcagtccaatagcacgtcgaagttgcatccaaagtcgaagccatcggccagatcactgagataatgcagctcctcgaggccggaagaatgctgggaggcgtcggagcactggaggagatcgtcaatggagaactccgtctcgtcgcagccggccacgttcgtgacgatgctctcgtcactgcccgtggcgatgaactggacgggcgcgtccatgaagttgtcgctggtgctggtggtttggtaatcgaacacggttgtgtcgatgtagttgccgtcgatgtcgcactcgatgtcgatgtaggggtgaccagctgatggcacgatggcgttgcacggctcgccgtcgttgccccatgtgccggccggattgtgccagcagccgttggccgccggcgccggcgccggctgcatttggttgccgtagacgccaatgcccatgtaggggtcaccaaatgatggcacgatggctttgcacggctcgccgccgtcgtagccccacgtgcccggatcgtgccacccgccgttggccgccggtgccggctgcatctggttgccgtagacgtcgttgccggcgatgtccatgtaggggtcaccagctgatggcacgatggcgtcgcagggctcgccgttgccgtcgacgacattgttgtaccagcattggaggttgccgtacacgggctggacgaaggtggcgttgcatggctggaagcctccccacgcgagccggctgtggttgttgctgccattgcccggcatctgcatctgcagctggtagccgctcatgtccacggcgccatggccgcccatgtactgggcgttgttgtaccctggctgcatcagcgtcacgccggcgttgtacggatggaaggggtcacatgtcgccggtgcatgcacctcctggtgctggtagccgtgtacgccgacggagttggttccggcgacgtcggcgtcgcgccgccggccgccgccgtccgcgtcgtcgtcggcgccgggcagcaacccgagcgcctcccgcctcttggccgtagccagcagcgtggcgtcgatggacgcgagcagctgctgcagctcgtcctgggacatcccgtccagcacggcgtccggcgggtcgagctcgccggggcggcccttctgccgcagcctggcgagcttggccctctccttgtcgagctcctcctggaggtaagccacgtgcgtgtgcctcgcccgcttctccgccggcagcgcgcggtacctctcgatggcgtcgccgccctccggcgacacccacacggtcggcgcgccgccgtcgggcccggcgcacacgacggcgacggggatgtcgcacagcgtggcgagctccccggccttcttgatcagccccgccttccgcttcttgtaggtcgtagcgcgcgtctgcgggttcgcgatgagggctatggatgtcttccggcgagacatcgctggagacgggagtcgatcgatctcgatggcgaggagacgacgggtggattttatgtggtagtacgtgcgcattatcccagtccgattcggacttcgtatcggcgaaaatctgagtccgcattggattttgttgcagatcacgtatatggatcagacggcgccctgtactcggctccaggctcacccttgcctgtgcgactatggctcagttctaaccccaaacttcaacttcctcatttttttttgttagtttcaagcttataattattaatgcttgtgctaatgaggtttaaatctgtcttcaaagggactgcctatacatttgtcgacaaaattttcaccaaaaaattgacagatgtaattataatataatcgtagtgtaattacactataacttatatgtaactacactgtaacttacatgtaactacagtgtaacttatatgtaagtgtcacataattttgaatcgttagatctattacacgatttgttttggtgaggaagaaaacaaatcatagcacacacatatatgaaagaatttgttcccacgacctccattttaccgaaataacatgttacggagagatttttgaaagttacatacaagttacactataggtacagtgtaattacatacaagttacagtgtaattacactacaattgtactgtaattacatacaagttacagtgtaattacactacaattatactgtaattacatttgtcaaatttttggagaaaaatttgtcgacaaatgtataacaaaatcggtcttgaaaacggacgatcgaaagcacctctctccggatagtccggtgagcccacaccaccgttaaggcgttaggtatcgtgaggcccttcctttaactttgcaacgcgtatcctattcgatctgttctgatgcctcctaattttgctatcttgacaagatttcgattaagatttataacgagctacgatcagtggaggtgcataatggaaagcgtatttattattattattatcatcatcacattcatttttttttgaacggacatcatcacattcaatcgagtccaaacagtaatcagtttccattacttccatatcagcacacaatgtacatacatctctttctaacacccaaacccttgggagaaatttattgaggctagttgtttttcaagcgatgcagttcacgccaaggcaccctcctagcaaattcctcagcaacttcttctgcagcacaaacaaaagattataattagattaggaaaaaaatcgcagtcaagttcaactagatctccctgaaatttacagtccaactttaatctcgattaataagctccaagtgttctacaaatgcactacttaagctttttgaacaaaaagggtagtgtgtgagtgttgctattatcctaagaaaagctaattgcaaaggctcagcttatctcaaaaaaggtttgtgtcaatcacatgatagtactagaaggtaactaaagtaaaagccacttggtcatcacacacaagggcccagcaaagatgcacagattttggaacaaaacacaattacagtgtactactacttgccttcttcaccctgcagattagctttggtgagatcttgtacaggtcctcatccactgccgtctttggcttccacttctgctgctcattcagatactgctgcttccttcctccctttctcacacgcacagcattcgcattcgcattcgcgttttctttctcccctttcactcgaacaacgcactgcattttggtcacgaaatcatcagtctaaccgtttgttcttttgcagcaacgctatgacttaaaactgaactaaactgatatgataatagttaggtgaagaagactgaagaaaagttcaagttttttttttgtcagaccttcttgtagttgtaggggttggcagggaactggggcaccttgaagaggtcctcatctttctctgcttgtgctgtgaagaagaaagtccctgactcgaagtattgggtgacgggcatatcatcccatatattccagtcgccgaacgccgggatttggcgccacttgcagtcatcgagcgcctgtcagagaatggaacaatctttactgttaacttatctctgtaagcaactcatcctacatatatgtttgtgaaaaacagaaaagatatgcaggaagcagggacgttgataaagaggcatctgagaactgaatctttgagtcaacctctcattggataaggaaaactttgaggtgatcaggagattcagaaaatcagaacagtatatgccaatgcagcagaacatcacccgttcttttctccctagaaaaggctctactattaagagcagtacaaacaccacatctctacatggcaaaaaaaaggatccaaggctagatagtagaacacaagctagttttgccacaagaagccaagaactgagatagagattagtgaagaagagaaaggcaacgaaatgcaaagcatttctccatggctcacctccataacgcagtgacagaaaagaatcagatcgcgaagaggaggaggagacgaagaagacgatcgatgactcccaacgatttcaggagacaggtgagcagcagcaacggctcagtggtcaaagctgtagtggagcttgctagctaggcattggtcagtagcaacacggccgcatgcagatgagcaagggagctggtggctgtgtgcatgtatacatagccacgcgaaaaagctcgaggaggagagggggtaaagagaatgtgggggcacacacgtaccgaaactttgcagaaagcccacaagaaagcaagcgcccaaagcagccaagcagggcagtgtgtttagctgttactgaaccgaggcaatgagtgctgcactgccagtctgctactgctgcttgcttcacgctcgtacgctctcatctcacgcaccaccctattacctattactcccacataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaattttttaaataagatgaatgatcaaacattgataaacaaaaactcgaaaagacaattaatatgggacggaggtattaccccttggcccttgctttacgagtttagtgtctttagtgcagtcataatactgttcatcctgtcccatcttgctcgctcactcttgtcaaggcccatgcttacttcgtttcaaaataaattaacttttacacataaatctaaatagaaggctatacttatatttgtgtaaaacttttttctaaataaagagtattttcagcttatcagcccgatatcattacagattattcatgccatgcatataaaacacggtttcttctgaaaactttctatgcaagcattatttataccaattattataggccatttgttatatttataagatatatggtttgtttggacgatggaaaataaaaatgatttcccgccattaaaagataactttaagttctagccatccaattttaccacatcatttcatccaagccctcatttctctctttttttttttgagtaaatttcacaaaactacaggtattttgaccaaattatcacaaaactacagatttaaggagttatatcacaaaactacatatttaacaccaaatttatcacaaaactacatattttaggttaaatatcacaaaaatgcatatttaatattgaacttatcacaaaactacaacttttggagtttaaatccttagcacccttgttatggtggagctataaacattattactttgtgattaaattggttctaaacctgtagttttgtgataatttagttactaaacatgtagttttgtgatacttcatcttaaatgtgtagttttgtgataaatttagtgttaaatgtgtagttttgtgataatttagtcatactatctatagttttctgaaatttactctctttttttcatgtcccgttatcccaacagacccataatatttaattctttcctacagataagcaagtagattatccactagtttctcatcccatctgcattattttacctaaaaagagcagcactctgtgtaaacacctctctatctgttaccacctgtcaacctctgagagggagagtggcagtaaaggtggtggcttttgggagcaagtcctggggctgtatgatgatggcaaacaatgagtgtgcgtgtccgatgcttttgtcacgcactgaccgggtgatagtcgatggagggccggggcggtggtcgtcccggccggccgcccggtcggcagcgcctgcccgcggccgggctgcggctggactcgaggacacgcatgtttagcgagaaagcagcgaaaggtggccgcttttctttccaaccatggccaaatcacaatgattccttggttggccggccccccctctgcacgctttgcccgcgccatgcgcctttaatttcccacccccctgcctttttcaccacttcgccattacggtgaccaggtccaggctttgattacagccgtgacgaaacctgcgtaatcttgtgtacttttgggtgtgttctttctccctttcctaatttctatagtactagcttgctttttgtgcgtacgcttttcaaactattaaatattattataattgctttgaaatcatagtaatctattttaatttttttaattagtacttaattaattatatactgatctgtttcttttttacaagtgtgaaggattagtttataatccactatacgaacacagtattaccgtggcatttggcgcttcctaactccaaagcttgtaaacggtgattttcctaaaaagaaagttatataaaatattctttaaatactttttagaatatcttttacgtttataagagttaattattaatttgtttatactctcagataactatagaaaaatcatcaatttcagctatctcaagcagtgcctaactgcctacttacctgtggctctgggctgtcatttcgataggaaaggagaaagttctgtacttagtagtactagtagatggaagaactagtacattacttattacggaaaacaagttacgaattgctgctgattagctcgtgtgtgtatagtcgtcgtacgttgagtatgagtcaggtgcgtgaggtcttgtactcttgtgtatgatgtgtgtcatgacccttttctgaaagtcattcggtgtgccactactagtcagttcgccagagcatgtatggtggtactatggtatgatgctgaagttacatgatggtggtactcggtagtacttgggtataataatacattcttggtaaagagaggagttcatgattatgtatgtatgatcaccccattggcaccatgtattaccacgcaatcagttaaagcaactttaatttagccaagttggtattactacctgcaaatgctttggatttttcatgtattgaggtttcaaattaggctatatactgcaccacaaactacaaagtttacaaaaggaattacttctggccggtctcagcaaagcaaatggaagcttaagtttactgctaatctaatctaaagttgttcttcagaaaacaaaaatctaatgtaaagttgtctacctaaagttacatagagcaatgatccgggccatgtacatgtggatacatctatatgggcctttttgttgggccagctaagaacctttcggaatctgctttgacaaagacaggtgcttaggaacctggcgaaaattttatacttcacggcccacatatatagctacccaacatcttcttccccttctttttccactttatctttctccaaattttaacatgtcttctcctccttttgattaaaagtttacagcctctctgtttaggcttttgatgtaccctctcctaatctttttttttaccttctttttgatgggtaggcctcctaatcttaggtacagtgacagtgcagagtgtcacaagtgacatctagatctgcttttcttgccagctatagctgctgcaggcagctgtagctaacagtaattaagcttctgatggttctcatctaccctactttgtgtaggtaatagacatggtcaatttgactttcttgttgtccattccatggcagagcataacatggggcaccgggaccactgctgtgatgcaaccccctgctttcgtttttggttttctcggttctgaagtttgaacaaaagctgtagcagtgtaaccgattattaatctgcagaggctgcaatgcagttctaagtcaccaggttatcaaacagtaacagtaatagaactgcatctgcatagttagagacacaaatcctagcagtatagtacaatactgtagtggagtagtagttacagtgagcatcagagcatcagttgcaacttgcaagccaaacattcatcagttagatcagtctgccttagtaatcatgagtttgacaggcatttcatcatgccaagatatgattataataattctgtaatgcaaagtgtcacagccaaaataggacttttgtgcatattctcccactcaaacaaaagaagacataatatagtttggtgatcagaaagaacataaaaaaaatcagaattggtcacgtctaaggtggtgtttacatccagggacttaacttaagtccctgtctttagacactaatttagagtattaaatatagactacttacaaaactaattacataaataaaagctaattcacgagacaaattttttaagcctaattaatctataattagagaatgtttaatgtagcatcacataggctaatcatggattaattaggctcattagattcgtctcgcaaattagtccaagattatggataggttttattaatagtctatatttaatatttataattaattttcaaacatacaatgtgatagggacttaaaagttttagtcccatctaaacagggcctaagattataaccactagcactcaggccaggccaacaaactgtcacagcctcacaggaatgcagataggttactttttacttcacttggcccggtccatgtcccattcccggacggaaaactcttttaatcactactagtaagtggatatccacccgttgattattatatcacctgaatagttacaaaaatattttaaaaaataataaaatagatcaatatgtaatatatcactccacaaacatgtaagttaaaatttaactttctataaattgtaatgaaaataacaaataaaactcaaatcagtatagatatatttgcagttaaatttgttatttttgttaagactcttataaaatttgaatttgaacttacatgtttatagagtgatatattacatatcaatttatcttgttaatttttttaaaaattgtttcataatcatttagttgacataaaataaaaagatagacgttcactcacgtgattagaatccatctccgaccgaccgcacatacaaagaaactcctacttggcgcagaacggcggccaactccagtccaattctaacccgaggccccgccgctgcatgccaccatcggctttcccgccggtacggccttgcgcccagcagcatgcacatggacacatgcaattgcaaacgcagcgcgcatgtgcaacaacgcgagcagcaatatatgagtatctcatcaaatcgtacgcgcgcctgcatgcatatggccggagccgtgtcttcacggccggcgacaagccggcgagcacatggacgcacgtcgtcacgggtcgccacggcgcgcgtgagatcccccatgtacgtacactctctatatatacaaggacatcgattgacagtacacatcgtagcctgcatcaacgcagagatcgatcgatcacaagaacagtaataagctagctaccgcaccaacagttaataagacatggccggcgggaagaaggcggcggtggcggtgctgctcgtggtgatggtggttgtgtcgttgtcggcggtggcgccggcggccgccgcaggtgcgccgttcatggtgtgtggcgtggacgcggaccggatggcggcggattgcgggtcgtactgcagggccgggagcagggagcgggcgccgcggcgggagtgctgcgacgcggtgaggggcgccgacttcaagtgcctgtgcaagtaccgcgacgagctgcgggtcatgggcaacatcgacgccgcccgcgccatgcagatcccgtccaagtgccgcatcaagggcgcgcccaagtcgtgctagagatctagctagctagcttcagttacgagccaatagctagctagctaagctcccgacttaattaattagtttcaaataatcaatggtccagtaagatttgtactcaatatttgcttcttggtttgtcacagtatttcatttggtattgtcaaactatatactccctccgtccctaaatatttaacaccgttaacttttttaaacatgtttgatcgttcgtcttatttaaactacaacatatatatatatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatcatggaactttttggtttgcagtatatatggggactgctatatcacgagatcgtgtttgaacaagataataacaactacatagactattagtgatatctattaagtatcgatacttgtgaggtattaaggaccttaataggtatcgaatgatatccatcggtactagatctagtaccccattggtacttgttgatacccgttaataccactcgatactcgtcgatatcaggatgatagcaattggtaccagacctgaggaagagagagaagaaggaagccacgacattgtcggtagggctaggtcaagagcctaggacaactcaaggatgacgaatagcctgggaggaggagcaactaggaggcgaagaggatgtcggtaatgacgaggagctcgctattgcacataaggagcggatctaccttgacaatgcgctttgcaaactacttgcaaccaacgaggagcttccccatgatctccaaccaactgcatatttacaaaccatatatatcagtattatgcctgtttcaatttgtacatgtcaaattaaacctatatatttgtagaatttgtagagtgatgtgtcattgatatgcattgaaaaccttttataaactattaagaccacacaaacgataactcatctccttaagagacaatgataacttatcaccgtcagcacccacaggagtgatagatccgcccagtccaaggatgacgggagtggcggtctcggactgggcagatccgccgccagtgcccataggagtggaagatctacccagtccgaagacggtgggtgtgatagcggtggcctcggatggcgggagcaacctcgaactaagtggatccgccatgggatagcggtggcccattggagcggttgatccgcccaatgggagcggttgatccgcccaatccgaccggcagctggaacgacgatggcggtgccggctgtgacaacgacgacggccacggtgacgacttcaggtgcaacggtaatgatggtggctttggctgtggcgatgatggtggtggctccgatgacgttggtagcttcaggagctatggtttcgactgaattagttttttggaattttattttttttcactgaaattgttttcacagacagacaacatatgtgcccacgtacgaaaaccccatatttgcacgctgttgcgcgcgctgcatatatgaaaatgtgttgattttggaatacacctaaatgcagctggctgcgcatcacccacatatgaaaatggattttggtcatctgcgaaaatcgtttttaagtagtaccctacctttttagcgatttctgctccgtcctgctgctaccgcgtacatatacagtaccgcctgaatctggtggccgccgcacgttccattcgcgccgaccatgaattaacttgttctaacaccgcgccgtccttgctctgatcgaagctctgaacaccacccagccagccggtcggtcgacgaacctgggtaaataacagccacttgatccacacaagatggcactccacacagatacgtccaactaaaattccagcctcctccgtcttgcccattggctgattggcttcgcgctgcagtcctcacatagggcatgtttgtgcagcttctaagcagcttttcatccagattctgagaagctgtagttataaaatttaaaaaatgaactaaaagccaaaagcggagaaactcagcttttctagattatgataagctggctactaatcagctgcttctcagaatattaagctctctaaatatgccgatagagtactgtaccgtaatacagacatgcatttcaccgtacgtgcctgcagtagcagacatgcacatgtacagatgtactagcgcagttgcgctacctgcatgcgtatatacgaccgtgtgcatgcatatgcatggcccgggaatccacggcgtctcgtgaacgtgccgacgcgatttgatctgagctttgcccatgagtccgtgacatagctagctaatggagacaaagctagcgcgcgagcacatgcacgtcacgggccgcgctaacttacccccacgctatataagccgaccgtatatagccatcttagctacgtaccacacaacgtacacacgacgaacccccacgacgcacttagctaagctagcgtatagtctctgatcgatccgatctccgacgacgacgacgacgatggccggtaaagtaagcgcggtggtgctggtggcgttggtggtggtggcggcggcggcgggcggcgcggccgggctgtcgatgtgcggcgtcgaccggtcggccgtggcgctgtgccggtcgtactgcacggtggggagcgcggagaaggcgccgacgaaggagtgctgcaaggcggtggcgaacgccgacttccagtgcctctgcgaccgcagggacatgctccgcaacctggagaacatcgacgccgaccgcgccacgcagatcccgtccaagtgcggcgtccccggggcctcctccagctgcaagtaatttacattaggtgatcgagatgatcactctagctagccagctgcaaaatcacactctagctagctagatgatcgatgatcgatgatcactagtgtgtttctagtggttaaataagtattgttggttggttaattaggggggggctaagtatgtgatcgatcgattgctagtagtggccgtgttatgtcaggccatcgtcgcgtcagctggatcttattttgttctgttgttttgagtagttcacgttctgaatgtcgccaggctagctgacatgtgctcgtgttgctcttgcatatatgcatggcgcagtctgcctgtctctatgtatcaatcttgtgattctcttgtacgtcattgctgtgtgtctaccttaatcgtgttctcataataaattttgctgcttgttttgatctaataattttgctatcttgtatatctgaaattggcccaggaagcattactgattaaacaatggcgagattaattggatgtttcagttggctaaaatcaaaattttcccatttttgcatgaatttatcaaaattcttgtttccatatataatttcttcgtgacatgcaacgtaagaaaatcataaggtatttagtagcagcaacataagaagaagaaatcaattccttggaatttccccaaatgtgttgtctaaaataaatttgcatggaattttcttttgataatctctaccaaattgcatgaaattcttgagatttctgatctctgaaatttcagaatgccccaaaatttggaacatcagttatgggcgaaaattcattatgtgtccatgaaattgtgaccaatcccttctatacctccaagttttgtccacttccttatatgcattttttttttttgtgcatcacttccttatatgcatttgaatgttggttttgatcccttttggacccattttgttagtagaccatttaattcctataaaactgttcattttgtccttatgtataaagaaatatgaaattttgtatagtttattgttgttggaagtatataaggttgttatagaagactattatattcatgacttcattgcacgaggtatattcatggtaatgtttatttttacatattgatagaaaaggtttaatatttattttatttctttattaaaagagtatgcgcagtatatttgtgtgatgctagttttgttgaatattatatgaaaggaatgctatccaaaactatgtttaccattttagaaaatgctctctctctctctctctctctctatatatatatatatatatatatatatatatatatatatatatatatatatatatatatatatatatatatatatatatatatatataatattatataaaacttcgatgtataatactttctcatacaacaaacttatgaatattacaaccacacaacaaattactatattcccaataatagatacaaatttctacatactccttgcacgtccaaggttaaaagcgatattttttacactattaaacagacaactaatggtgaattgatgggaaggctgtggaagggatcaaaaccaaaatataggagtatacaaaggagtgaagaaaattcaagggtatagaaaagattggctaagatttaagaggaattgaaggaattatctctttttctatttgttggaagcatgtaaaacacctactacttctgtgcaatcctattaattgggccagcacatggacacggggggaaggaaagatgtccccaatctcccaacatggacctattgactgttgaaaaataactcactcgtgtcctccagattaaggggatctctagaacgatgtgctatcactcgtaaccttgtaacaaattggttaggcccactatgcatgttgttcattgatagggcccatagtcaatggacaatgctacaagcctacaatggctcgattcgaagagcgtatggcacaggatttaccaggaatacatacttgcgaggtaatttataaaatgtatctctacaagtccaaagtctatgagtatgtccttcgatgtcgttgagacgttgattgtaaactcaagttgagacgttgttacatagaagtaacggactcaacatcaagcaattcataatgaactaaggccctatttgtttcagcttatgattattataatctagattattaagccagattactataagctggattataataagctagcatagaataagctgtgagttgtttgtttgtctggattattgaaggcatggattattgggtttgaaaagctaaagtctataatgccctcaactatatgttcggttgatggcataggtgggtaatttttctcaagtatgtaggggtagtgggtctttagccactcaataatctgaaaaaagctcctctagagcagcttatcagattataataatctgctataataatctacttgtttgtttcagtttactcctaataagctagattataataatcctaagctgaatcaaacagggcctaaatatcatgaaatcccttggagtacccatatgatgaaatctcctttgatgtcgactgggcactctctctcttttggagctcctctccttctctgtggcgagctatatgcctatataggtagagtggagaagatggtcggtcaatagcgaaaggctcgggctaccaagacgatatcgcctaattctagactctccttggctagatctggcaaggtggctagtagacagcgggtggggcggaggagacctaagctagtgcacaaaagtggcgacagggtgcgctggtggtcttgttggtggtaggactagaaatcagcccgcggaagggtgttggtttggtgtggtggagggcgcatgctgtgaacatttggatggtggagcctaagatagtgagtgacataccacaatgatacgattgtacagggttccaagcgaaagcctaggctgatgatttgttgggctaatagcgggtacacctttgggcatggtaatccccttgtggcactgttgaggtacctccttcctccctatcttgacaagaatttttaagtgaaaaccatgtctaggttccttggatgggtgacggcagcatccttggcatcgcaaccttcgtggtgactttttttttggagactccgctatgtggctatgtggtactgttgtaggcctaacgacaatcggccatgcatagcgatgacaggtttggtgcctgactcccctcttagtagcatgtgtttgtgtggttggcacatggttcctaggtgtaccaactgcccacgtgtgctctggtacatgaacaatctcaatagccttctgttgattacagtatttcttgaaactttttccctcgatcttaataacatttggattgagcactgataatctattagactttgttcgacaggatcctcaaatttgacaaggacctccgtggtaaccttgagttagatccagtgaagcaaccaacatttctgcgactcaactctaaatctcaattagtgccgaatccgtgaaagtagccataggaatcgttgacatgtcaagagggaagcacgtctatagaggccctagaatatgatagtcgcggcaatgccacaagtccccaacgattgcatcttttattggtgcatggttctccatgcaatctggaattttgcttccttcattcagtgtttttagaaggatggttctccaagtttattggtgtaatccttttgctaggcgatgtatcagggaatatatttcccgcttatatactttttcctcaagctttaaatacattttatgagtcctagaaaaaaaatatttggatgcctttttcttacgggttgattccgtcatcccgtaaggttacaccacgctattctagttacagaaagaatacttcgagggtctacctatagtgttcctttcttcctaaaaaaagcctcctatatatttggcgaatatttttaatactgaactgtaattaacgcgtagtgttaattagtgtaactttcggtactagatcatattcttaggtgctagaagggacacgtacctgcagggccgtgaagaaccccagttgggggaaccacagccaatcatctctgactcatcccagcaaccgtgaatcagctcagggaaaaactgcggaaaaacgtaatcacatatcaatgtcctatgctagtagcctgtggttgtgcaacatttcagcactctacgacatgcagaatcagacaaaaagggaaagaaggcaagtccctacaggcttcaacgcgtgaactcgaccataaaattcagtaacttctcacaggcagtaagaatttttacgcaccgaatgcttcattgcgtgcaaacatgccctgacctggaaaatcagaagcttgcagtccgcttgaaaaaacaatattgttgttagtttgaccaagtttagatccagttgctgtctcgtgactcggtgaccatcaccagcatctcctagtggtgactgcttcggaactgaaagcaacaagagctaaacattgcccatatccaccacgaccaacatctttagaaaaagaaatagactgatgcaccgcagatcagagcttccatcaattgctttctgcaagatatccaaactgttcatagtacggctctgatagtctgattctctgaatgttgtcccaagatccaggtgcagcccatgccgtcgtgtaacaggcggtaagtgccagtgatgaacaaacaagaggtaaccggccgcagaaagccagaaatgcaagaaccaagcatctccgtctcattgctttctcgcccatcctctgccaccccaatagtgcactgcatacaacttttatataaccagatgacacgccgtgcctgaatgcttctgcatcttcttttactgaataagttccaccgctgcttagattcgctgactgtatccgctgctcggatgttccatgattgctacaaataattgtcccctctttctacatgccctagttctgtagaacaaaaagaacaaagagggtgaattaaatggccaaaaaagcatgatatttgactattcatgttcaaaatgaagcaaataattacagaaaatacgatgcagaagagcacatgtataacggacaaggtggtgcaattgaaataatgcaagtttcagacacctctgctgtgattttatcctgtgtgcgcgtgcataccagggagatgagccatctggtggtctccgcagtccccactgctccccttctcgctatacaacactgtctgcatggtatggcacagggatatgcatatgcctggcatgagcagagccacaggggtgggcaggcacacacacaagagccattgcaccagcctccgatttatatagtctccagcatttgctccccttgtgttgcttctctaatccaggcacaccaccatcctcccattctctatccatttgtttgaagaagggttatggccaatgcttgccccacatctaccacaagctccttgcccctcttcttcctcttctgtttcctgctcttcagtcatgctcgttgcaatcaagggcaccatggcagcatctcaggtacccctttgcatcagattgatatcttgtcttttcttctgttctcctgcatctattaactgtgatttaggttgacatgataaaacctatgtatttaaatgtttcaatttcatatgatgtcaaggtacagactatggagaacaatatcctcaccaaacattacctgaagaacatatacatttgcaggagaacatcaaggtacatatgccatcttgctattacaaagtatgtaattaattgagttttgtgtttttctgttcctcaagtatgttttcttaaaactttagttttatgttttattatgttcattatatatgtcaaggaaaaaagctttcccccaactgtcagcttccttggcgcataccatatagttctggatggacttttcagtaggaagaaatggttgcatctatcaactgtgcactgcttggcatcttttgctaggatgagaaaatgattggtagcaacttgcctcccatcttttctcctaaagtagtatgaaaagacttaagaacaagaccaaacaaacatgaatgccaaagttaaatcagaaagtatgtaaatatctggaagatactatggttaagatgatcttcaaatgtatgccattaggttctaaacaaggagaggctgcccaaatatgcaaggagaatgttgattggttcgactgctccaatatgcacatacaacgagtgcagagggtgtcgattcaagtgtactgccgagcaggtcccagtggatgcaaatgaccccatgaatagtgcttaccactacaaatgtgtttgccacaggtgatcattaataattaagaggagcttctgttatgagtagtagtttgcatccattttattctctttttcccccttctacccttctaggctcaaaaggttcattttttccccttttgttttaacaagtggccagctagtagaggattagagggcattttgtattttaagatgttcaggttgtggactggtaattttggaagtaaatgttaaaaaatttgaaaaacagcttatttatactattgtgcagacaaaatgttccttgcttacgtattgcaccactgtttttagtctatgaacaaacctcgatagagttgtctgccagaatagccttggagctctcagctggatcatctggaactagtggtctgcaactgtgctagcctttcaaggcatataaatgtggtaaatgttctattgcatttgaaatttctcagtaccttcttcattctgggctgcttcagctctcatgggcttttgtcattcgtctttccatagtaacaaccatctgtacaatgagcagtaaattcatctagacaaatcacagaagaagttaaccaagagtaagggtaagcaataaagaagactttcgtgcagaccacactccttcattgaagtagacattgcattctaaattcaatcgagcagatatgtatgaggaaattgccaagactcagacaatcacatgcacactgaccttaaagttaccaagtaaacttatcaatagtattccagtaaaaagaatcaatagtagttcaaaaatatcaattgaaaccgtttcagtccaaacagggcatttattttgcaagcagagagcttgcagaggtgccttgtatttattcaacaaaatatttttagaggaattgtcttggtaagaaacacttattagctaacttcttttactggaggtgtaaggacaagagtaactcatgcttattagaggatactgacaaacgtagtcacattcagacagtactttccttttgcaagaagtgttctcttcagttttttttacccaagtcacataaattactacagtcttttataagccactgctcacccaatatactccgtagaagttttgcttgtgcatgagtgtgtgacatgactgtcaagctgcggctgcaactagagtgagacgagcaggtagcagaactatggtgatttgactgattggccacctaggatggctacgccaggtcttgtataatctatatatatggtttaccgaacaccgagatatgcacagataattatggtgttttatggtgtctgcttgaacattattcaattagtgaacaaaggaactggtgagcatgtgtccaaagaaatatatagtaatgtctcagttgactgaaaaacttcataacttcctagttcttatgcacacaaaaatcaaaagcccttctgggtgggagtgggacacatatactaattcttttattcagttggtaataggatacttgaagtcttgagctaagaaatagactgagcaactatttcaaacatggccagctcctatagtgtgacaggtgatgtgtacaagcccccagaactcaactttataaatggtcagccttgcagcaatggagacaaactctgcaagcaagtaaatcacactatttctgaccgattacatgtgaagataataacttcaacacaataacacatattcctattgtagcttcaaaaattcaagtggcttaaggaccagcattgctaatctcataatgagaaaaaaaggaaaatactagtagagtggtattctgagagtgacacaagagggaagatgcatatggtacaaggaacgaaagctgccacttagtggcctgtggctctaccgctccagtgctaccctttggaggtaccgtggtagaatgaggtcaccatttttcttaagaataggtcgtagttgctttctgtgaggtggtcctgcgtgcaaggaagaaggcattcacatggaagcaagcaggaggatccatctcgagctgttttgttttgcatgacagaagatggcagaatggtcccagtacgttggcacacgggtcatgcaccaaggttgacgtgaccacaacaccaagcatcatagccttgcaggctgtagcacctccgtatctccatggtgttcataattgttagtgccactaaaatataccctaaattagaatatgcttctagatcaggagcatacaggacaggctaattattttgacatcacgagtagatattctgggaaaagggatgtcatggaatagaagagatgtgtcatgcggaagcaaatcataggattggcgcaagctcaatggcataagaggttttctcatgtctaaatgtcagttactactatattttgcatgcggctaaattccattttcatcaacaataattagatggaatgtagaaaggaaaggaaagtaacttacagtattatatgcatattattcgacaccttcagccttaattccaacaaagtaaaaagatcaacgcagcagaggttcagactttagaggcttcttagtcaggattgaaattgtggttcagcctgaaatcatttcaaaaaatttcatgatcagaaagctgcagaaccacgctttttcaatatacccactgagacagatttcatagtaaacattagcaggatcatagcttcttagctcaaccatatgtttctagtacatatggaatctgaaaaataaaatgctatttaccatgtgaaagtaaaaaagaaacagatacgatggatcactccatggatgccaaagaactatatatgtttgggaactttgaatgagcctgcaactgaatcaagcaaaatgaaaaaaacaaagagcaccactatctgagtaactaagcgcctgcttgggctggaaaaacttatactatagtttgcttccatcagggtgcttaactacctggtacgattttcaaccttgtcgcaatctccaagttccttggcgaaaaaagccaaagttccaaacctccaaaacaacacttcatgttcctgaaccaaggaagccgggtaataatcaggagaactaactggaatacgaacacaaaaaagggcaacacagtacgtacttggataccttttcagtttgacttatcaagaaactcacaatggcaaacactcatcgttcagcttcagggggaaaaaaagcttaacaaactgggatataatgatgtttcaaaagctccctccagaattatagcgtcccatgtcaagaatgtcaaatcaatgaacagacacgataacaaaggatttggcacatttggtacacaacaaaggatcaaatagatgctgctatgttagataaattccacagcgtcaagtaaatttcctccttgtggggatgtgaactacctccattcacaaactcatgaatttgtccatccacctcaatcacactccgtccaatgttctttttcataccctcagcactcatcaacttcctaatcctgaaaacatcatcccacattccttcatcagcatagatattggacagaagaacatagactccagagtcatctgctccgagactggccagacgctcaactgatagctcagccagctccacacacctatggcttcggcaggaagcaagaagagatccccataattcaggagtcggttccatcggcattgtctctattgtgtttctagcctgatccactcgtccagcacggccaaggagatcaatcaatgcaccataatgttccaccttaggttctagtcctaaatccttctccattctgtaaaatatccccaaaccctctgagactaacccagcatgcgtgcaagaagtcaacacagcaagtatgctaagatcatccattggtgccctttcagtttccatttggttaaaaagcttgatggcatcaagtccataaccatgagttccaagtccaacaatcatcacattccaagtgaccacactcttcttgggcatgctttcaaagatcaatttggcaagatccaaacgaccgcatttcacgtacatatctatcaaagctgtttgcaccacaacatcgaacaacaccttcttcttctccaagtatgagtgcagccacctgccttgctccagagctcccagctgtgcacaagctgcaacagccccaactgcagctactctatcaggcttgataccacatcttagcatcctctggaaaaactccaaagcttcatttggctccccgaatctgacatagccatcgatgacaatactccatgagatcacattcctctcaggcatctcctcgaacagaaccctcgcttcatccattctcccatgcctggcataaccatcaatcatggagttccagcacaccaaatccctgtcaggcatttgatcaaacaactcacgtgcacgatctacaccacctgccatctctccgtacccatcgatcatggtggcccaggagaacgcatccctctgccgcatttcgtcgaacaaatcctgcgccagatccacctccccacacccaacgtaccccgccaccatagagttccaggagacgaggtcccgcacgccgtgatcgaacaccttcctcccggaacggcagtccccgatcctgcagtagaagctaatcagcgcgttcctcgtgaacaggtcggcgtccaaccccgtcctcaccgcctcgccgtgcaccaccaaccccaccctacacccgggcgcgcagccgcacgccttgagcacggccgggaacgtgtaggcgtcgggcgccacggcggctcgccgcatgcgcgagaagtagaggagggatctccgcgggctcgcggcggcgtggaggcggacgagggtgttccaggggaacgcgtggcgggaggcttcctccgcgaggtgggcgaagacggagtcggcgtggtcggcggcggagggggaggcggaggcggaggcgagggcgaggaggaggaggttggagaggcgggccggggaggcggcgaggtggccggaggtgaggaggagggcgtggcactggagcgcgtgggaggcggagctgcaggcgcggaggcgggagaggagcgtggcgagggcgtgaggaggacgacgacgagacatggcaaagtttgatttgggacgacgaggaagcagttacaaaacgactcgtttgtacatgaactctagcctcggcccctgggtcattttccagatgggccgtacctaaaatgatcagttgggccgaaaagaagggcaattatggttcattttgaatttcttgattcaaaaatggtagtggtggacatgctgcactctcatgtgtaaatgttactgctagctacttaaagtttactacatccgtcctagaatataacaacttttagctataaatctgaacacacagttgttcagattcatagctaaaaatatttacattttgggacggatggagtacttaagggcagtagccagtagattagaggatcaggttccattcagagtgtatgaatcgctgttggttcttatagaaaacaaaactgatttatgtcaaattctagtgagaatactgtgaatttcatggttccatctagagaattagccctgattataatgtgagactttgcattgactaataaaatacctgcttgttataacggatttctaattatatgtcttaagttgttagcttaaaaatactcagaaaaaaaacatatagaattacaagcaaatatccaaccaaaaagtttaagccacatgcacaaaaagaccatttatccatccttaaaaaatcatatcaactctagatgatgttagattcatcatcatcactagattattttacatagtagatatacggaagatggattgtttggtgtgaaattcttgcggaatttgtacgaaactcataaacccgcacgtttacatgggtaatatagatttagggacaattcagattaataccatttcaaatcataccaagttgtcaacgatgtacatacattaatttttttccaaactttgataaatactacataaaaaattctgtcgaaattttaataatatcatcgaggtttattttggatacaaaccctcaatgaagtcaggaatttatcgttggtttgtatatctttaagcgcgatgtccacagtgcaaacttggatgttagagtactttacggtgttcacgttgaaagacgagagaaagacgcttcgatttagagttgacggggcgcgggaacataggggccggatgaatccacagccaccccccagttatagtataggcaatgagcgcgggaggcgaccgacgcatgcagcttccctcgtcggggaagacgacgtacgaccccgacgtactacgcgcccacgcacgcacgacgggacggccggcctcctcacctcgctcgctcgcgccgcgccgctcgccggcaaatccaccacgccatggcgttccctgcaccctcctcctcctcccctcgccgccgcggccgcggcctcgcctacctcctcgtctccgtcctcctgctcgcgtcccgcgtgccgggcgccgccggcgcggactcggagttcgaggacggcgtctcgcccaagttccccggctgcgacaaccccttccagaaggtaagtaaatcgccgcgtcgatctcgtcggagaggaaggagatgacgatcgatcgtacgtgacggtggcatgcgcgtgtgtgcaggtgaaggtgacgtactgggtggacggcgacgagaggagcagcctgaccgggatcacggcgaggttcggcgaggtgctgccggccaccggctccgacggcgacaagcggaaggccgtggtccccgccccgaagaccggctgcgccaagtcatccgcgccgcttgctagctccattgccgtggcggagcgcggggagtgcacgttcctggagaaggccaagacggcggagtccggcggcgccgccgcgctgctcctcatcaacgacgaggacggtcagtacgtgtagtttttaaccgaacgactgcatttccatcgtgcattgtgcataccatgaaagtaattaacattgagaaattttatggtacttaaaaaaaatcctgagatacctaaaaatttggtacttagagatatcagtgtctcaggatatcaaattttacactaaaaaatatggtatcctccaatatttttttaaatggtaaaattatccaattaacattagggttcttcgtgtagatttgcagaagatggtgtgcacccagaacgacacggtccctaacattggcatcccggtcgtgatggtatcccagtctgccggtcgcaagatcctctccggcatggacggtggggcaaagggtgagaggctgaaaaaaagaattagtctgtcgagaagctgaattcatttcttgctgctgtttttgtgaaccatatgcttctgattttgcttaatttgcagttgacattctgatgtatgcgccggagaagccgagtttcgatggcgctatacctttcctctggctgatggccgtcggcagcgtggcctgtgcgtccgtttggtccttcgtcgtcgtcggcgacgaggtatatcaatcaatccacaaaaaatacgtttcagaagtttaattttataaattacgagtattatacgttttttgcagaagaaaaagagtgagacaaaatgcatcgatcatgtcacatcacatgcatttttcactgaaacgaatggcgcgaatttaaaatatgactttgatatggcggcgatattatttggtccaggataagaatgctcctacactgggtggagaagaagctgctgactctgaaatcgtggagctgcagaccaaaaccgcgctcgtgttcatcgtcaccgcgtcgcttgtcctgctgttcctgttcttcttcaaatccacctggtctgcatggctgctggttgtgctgttctgcctcagtggtctccaggtgcatggcaattgcctactcaatctgacatagtttggttcagttaatcagtaaactaactaatactgtatagctttgtttcatatcttctcttgacggatcctttgtttttcagggattgcactatgttgcctcgactctaattgtaaggtgtgatcactgaaaccatgcaaccttttgtatcatcgcaccattgattctgaatttctgatagtgctattacttgcttgctggtctaactgctgcaaagttgattgacagaacttgtgatcggtgccgcgaagcaaaagtagctcttcctgtattagggaacgtgacagtggttacacttgtcatcctaccactagctttgatcttcgttgtcgtttgggctgtacaccagaattcaccgtttgcttgggttggtcaggatcttatggtatggtttgttgtgtgcaccaggtacagtgcaatgatgatttccttgtcatgtttgctcatggattgttccttttcattcagggcatctgcatgatgattcttgtattgcaagtggtccatctgccaaatatcaaagtgagatcatcaagaacatatgatgccttggtttagtaaatatggcaattgtaatcatcttttgtacactgatgtacttgagattattttcaggttgcaacagcgcttcttgtgagcgctttcatgtatgacattttttgggtgttcatatcacctttcatattcaagaaaagtgtcatgatcacagtaagtttgtttctgacaaagtgcaaataatgcaaatattagtgcaaaaatatcctaatccaattggtatgggcatacaggttgctcgtggtagcgatgagggacctagccttcccatggttctgaagatgccaaaggagtttgatacatggaatggctatgacatgatcggatttggggacattcttttcccaggactacttgttgctttcagtttcaggtcaaaaccaagattttgttctctgaatccgtcaatgcattcagttaatatcagagtctactggatacttctagtgatcaactgttcattctcctgaaaatttaccgttatttttcaagataatatttacctactgttcttgagttgcaggtatgacagagcaaatggaaaggacttgactgacggctatttcctctgcctaatgatcggttacgccttcggtacgtaatattatccgcatttctgaatcacagaagaacaaaatcattgacatcaattatcaacactgtcatctcaatgcaggtttgtcatgcacatatgttggcctgtacctaatgaagagtggacagccagctctcctctacctagtcccatcaacactaggtatcacatcgattcctctgctgagattttagtacagaaatcttgagctccaacacctgtttcttctctgaaattatgcaggaactattgtcacgctaggtgcgaaaagaggagagctaagtcagctctggaatgctaaagtatagcttgtgaaatattgatacttgcttgcagtcttgcagcattgtactagttagagaagcgatcattgatctgtatatgagaatatctgatggttgttggtaaatatatcatgccaaccatctgcacgaactttggttagatttcttttttcagtgtacacttaccatgaatggtggttattagtgcgaagcagtatgctctggctgtaaatgtcatggctgtgatgtaaatgtgaacagaattatattctctgtgtcttgatgtgttcttagctgggtgtaatataaaaaatccactttgtttcagaaacttcagatgttgctcaagtatctgtactccggtgttcctttcttctcgactgtaattttaagtgtcgtcaaattgaactttacaaaagggcaagagatctgcgcagatcccaatgctcagtaggttatctgcattgcagtcatcgtacgatagcacatgaactcgaccgtaaacgctaagatagtgcatgggtgtcattacgtttgattcttagcagtttgcaagaccaagctctctacgctcccctttcgtttttcgcgcgcacattttttaaactgttgcatagtgtgtttttttaaaaaagtttctatatgaaagttgtttttaaaaaaatcatatttatccattttcttaaaaaaattagctaatacttaattaatcatgtgctaatggactgctccgttttccgtgccggagggaagtgtttcccaaccaagagtagcgaacacatacaacatagtaaatcaatcgcgatgtttaaccaacttccaaaaaagaaaaaatagagggagtacaaacgatgaacgggccaagaatattggatctatatatgctccctctactttttaaatagatgacgctattaacttttacacacatatttgaccattcgttttatttaaaaattatgtaaatacgtaagatatatatcatacttaaattacttttaatgataaaaaaaatcataataaaataagtattaattattgaaatttttttgtcaaacacgtgttaaaaaacagatatagtatgtacacctcagtctttaagaaaaagataaatgcatattctgaatagatattcaggtttcattgctagaattgagtatttcgagtaaagtccattaccggtccctaaacttgtaccgttgtgtcatcccgatccctaaactcacaaatcaaccgtttaggtcctcaaacttgtttgactgtgtcatcccggtcactcgtttaggcccttcaacttgttcagttgtgtcaccccggtccctaaacttggatttgaatatcatttgggtcaaataggacggtaaagactttatatttaaaaataattcataactttttcatgtgaactctaatgaagacaaactttatatcaaacttgtagccctcgacgcaatctacaactttgtagttgattttttttattttaagtcattttggtcccgaaatgtaattttaaattaaaatttcaaaatatataaacatgcaacaatattttgtgaccctaaacagttttatttcaaaaacttttcaactacaaagttgtatgtcgcgtcgagggctataattttgatataaagtttgtcttcattagagttcacatgaaaaagctatgaattattttttgatataaagtctttagaccgtcttgtttatgcaccgaggtaacacaactggaaaagttggaggacctaaacgagtgatctgcaagtttagggaccgagatgacatagtcgaacaagtttgaggatctgaacgatcgatttgcgagtttagggaccgggatgacacaacggtgcaagtttagagaccggtgatggtctttactcgagtattttttatggagggagtacatgtatggacagacactgtatgaatgatgtatgtattgtatgttcgtactgtacaacgcaccggatgtccagagtcgtccgatccccatccaagcgcgtggaacagcaccaacgtgaatgcgagcgtgagtggatcagtggaaatgtatgttcgcatctgcgcgtcgagtccaattttgtgagcgaaaacaacccttaagattcagaaaatagcccattttgggccctctagcagttcttccttccgttccttccctctatctatcctccgcctcgtcctcgccacgcgcgaaggcggcgtcgatcggttcccccatttttctcatcgatccctcgtggcctcctccccgccgccgcgccacctcgtctcgaaggtattctttgtcccaaaaccgcctccttcgccgacgagccggtgtagggtggagatccaacttgtatttcatttctttttgttgggatgaactcctaggccatagcatccttggattgtctagggagttctgctccggtcttgtttgtttatgttttgtggggaggaatttttgtgtcgaattcttctttgctactacgcgattaatccgtcctttcttggtttgcagatttctttgatgcgtggtggcagtggcgtttggatcttggtgccgccatgagtccgccggggaggaaggccccggccggtgcgggcgggatccgtcggtggctctccaccgtcgtcgtgtcggtggtggctcttgtgctaaccctagtagtgatatcgctatcggtgggctcgtctctgaccggggcatcgctacacgagtacctctttgtcagacctagtgattcatccaagcttactgatgggaacatgaatggtactgccgttggtgttccattacaagaggaagtgttgcagggtggcaaggaagtacccgtggagcacggtgttcagagtggcggcgtgaattcgagcgagacgggtgaaatcgataccaaagtacaagatccagttgttaccgatgataccgcgtcagtgcctgatgagagaaatctccctgtctcatcggattcatccgacaatcttcagaagactaatgaaggtgcggtgttagtacactttcctgtttgttttctcggcagcactgactaacatgaatgagatattgttttcttgctattttagtgtaatggcttgtttgattattcatgataattgaatgactgggataaaaaatggtatggtgtaattgtacaggtagctgtgatctataccatggacattgggtttttgattcttctggaccactatacacaaacaactcttgcccgatcatcacgcagatgcagaattgtcaaggaaatggtcgacctgataaggattatgaaaattatagatggaaaccagaacagtgcatcctaccacgctttgatggaccaaagttcctggagttgatgagaggcaagacaattgcatttgttggtgattcagttgccagaaatcagatggaatccctcctctgcattctgtggcaggtgctgatactattcatgattttcttttggccatatgattagttaagctgatgacaagttgcccattactatatatgacaattttttgttgacctggatattgattattaacttaaaatactaggcatttttgttattcatgtgagttaggtttgttacaaacttgtggatgacaccatgaatttttttatatagttttgtgatgttcataacaacattatttcgatttatttaaaataaatggagaaagggtcaaagtcatttgttctacatgatttgtttttaaattggtgaaatctacttattttgtagtacatctgtcagccaagttttttgctcgagatactgcaactgtattggctggtgtgggttcagttgctggattattgatgttgtctgatatcaactagagaaaccaatgctgtcctgttgcaatctgacactgtaccaatcctatggtttctagaagaaaactgttttagagtttagatttcaatcggctctttgttttctcaatgtggacaaatttaggatattgcaagattagcctattgaaaatgcctaccaaagcatcagaacagcagctaataagcagaagaatgcaaatcaatgtcctgtagtacatgatagtcttttatagataagaaactgtatgagttagaattgctttgtgaactaatagcataccttgtggtctcacgtaggaaattttatgaagattgaagcagataccatgtttattacttttccttatcatgcagcagagtcttgtttttcaaacatctgattgagaaatcttttgtcgttatatagtggaacacatctggttgggctttcctccttacagtagcagaaatgtctcacaaagatcaacctatacctcttttcctatgttaaatgattttgtaggctatgtcattaagagacatgatctgttcttttaccttctttttggcaggtagaggccccagtaaaccgtggtagccgcaggatgagcaagtggatttttaggtcaacctcaacaattatcgtccgcatctggtcgtcttggttagtgcacaggtcaactgaagctgtggggtttgctcctaagggtatcgataaggttttcctggatatcccggatgagacctttatggaatttatcccacgttttgatgtgcttgtcctctcctctgggcactggtttgccaaacggtctgcttatatcctgaatggcaatgttgttggagggcagctctggtggcctcgtaaagctggaaatatgcagatcaacaatgttgatgcttttggtatatctgttgagacatgcctaactgctctagctaccaatccaaatttcacaggtatagctatcgtgcgcacatattcaccagatcattatgaaggtggggcttggaataccggtggatcatgcactggaaagactaagcccttggatgtggtggtgaggaatggattcacggacaccatgtatggaaagcaggtttcagggttcacaaaagcagtgcagaattctgggaaacatggttccaggttgaaattgatggacatcactgagccctttgccctgaggcctgatgggcatcctggtccatatagaagtactgacccaaacaagaagacgcaaagaggtccagatggaaggcctccacctcaggattgcctacattggtgcatgccaggacctgtagatacatggaatgagatgttgctagagaccatacgaagagagttcgagggagtgagaagctgaagaaaaacactcattggctgcttgatttctatcatgtgatacgacctgcaaaaactaattaagcttctagcattggtgtatacctcattacatatcgtgttgttgttctcccacagataggaaggaaatatagcttttggttggacaaaaaaacaaattgtaggcatgttgtcaacagtcgggatagaagtacagaggggtagacagttagagagagaggttatgatggatgatactgtgcaattgatctgtatctagttttttgtctgacacattcttggagatatgatccgttgacgaattttgtggaactacatatgatctcatatctcgagcacctgtcaatctatgaggcagatgctgattttggtttataacagatgaaagagaacttgttcacacggttcgcttcctgccactacagtttacacctctcttaagttttatgaacttgttcatagggactgtttgatacaattcctattccaaggataaagtggagctaaggagccgcgagaatgctgctttactctcgtaatgtaacttgtggagtatattatccattggagcggaggtggggagcggcgtgaatgctgcttttaccgtaaattttaaatatatattatctagggtttcgaaaatatttggtacaactcaaacttcacgggataagaaacatatattctctccgtttcatattataacttgttttcttagttaaagtttttagtttggcctagtttatagaaaaaaaaaacttctacatcataatgttaaatatattctgatacaatatttattttgtattaaaacgttactatatttagctacaaacattatcaaatttaagaaagtttgacttaaaaaaagatcaaactgacttatgatatgaaacaaaggggaaactaaatggccccctagggaccgggctctgttcgcaagagctgttcccaacctaaacagtatgcacggaaaatggaaccgatcctctagcacgtgattaattaaatatttgcttgggaactggctcttgcggacatagcccaaatcgagtagtgtgttagttctaggcccaacgtttctacggctaaaagcctgccagaatatggcccaaatttaacaaagttctaggacgagatgggctcagttcagaaggaagtcagaaacacacctccccttccacttccacttccacttccaccgacgagagcgacgcggcggcgcggcgccggctgcccacaccacacactcctccctgctcctcttcctcctccccgcatccgccatggcccatggccaatcccttgcccagttgcccccgtgcctcgccgtcccgctcgcccgcgtccgggaagccatcgtcggagggggggtaactcaatgcgacataggtagatctgcaggcgccgtgctgggactacgaggagacggccgcggcggcggccacctttgccccgcctcgacggggaacctgctctacgtcttctccaggtcccctatgcgaactttccactactatttcgactcttcgtgtattcgttaatccttaccaagttaccgtaacctaaaattatggtaaagcatcatcatattgttttttttttgtacatacatttttcgctgtagccgttttggcagaatagattggacttgatggcattacggggtagcgaaactcttgaagcatgttcattaagcaaaacatggatgcatattgttacttgttaggtgttcactgtttgtattataatgtacatcgatatatattgttacttgttagatgttcactgtttgtattataatgtacatcgatatatcttgatgtgcatatatgtcaatgattccatgtattctatttcatggaaattgaagctaggaagtcgcatttttccactacgctttaagctggccaataaaattttacctacatttcatctttgctataggcattacagagctctgtatatttactgttttagcagaatatatgtgtttgtgtagaccactgtccttttagttagaaggacatggagaattggaggtcttacatgtttttgttgcttggatcagattggctcatcctgctgcaacagttgcattcaccatgaagccacaatacctcctacgccgtgaatcctcctactatgcctagcctatagcagaatgtgagccattcttgcttgcctcccttttcttctattctacaatggtacttgtgagtatatatatttattcatgtggtcatgtctcagggggataaattaaagattagttgttagtgacacaatcataatatcttcccaaggtccataaaatatgcaatccttttggtttctatttacagtggatgaagttgggtgcctcttcagttctttactttttttgactgaatttttgttgtcgattagcaaaggataagctttcagtatttgaattgtaatagcagtataggatttgagaccgctggctcatgatgtaaactctgtactgcaacgttctgcaggcaggattagcttttcttgatggaagtattttaaactctgaaagcttgaatacttgcgtggtaatcacagaactacttggctactacactggctgttctccctcaagacataaaaggttagggttcgtgcattgtaatcctatgtttttagttacagaaactttcctttttaattgccataattttacttacaagaagctggtgcacataggattttgtatgaactgtgcagaaaactgaaaggcactcttcgaaaagtgaaactgtcctcgaaaaacaagtctgatggaaataacctatcctataaatctgattacctggaatagttagcatcaaacgctatgccttattactcaagagaggttaaagcaaataatagggtaatgcactaatgtactagtctttcagagagtaattaacctagagaaaagatgacaggttgagttgttcaagaactgtaaagtagagaatattaatgtagttcctcatgagttatctttttgaaagggaagcaatctggttgctctctcactgctctgagaataaagtttcaattagcttgtttgttcattaggaaaagaaaaggaatgaaaagagtaggctccaaccaaattatattcccatcaagacttagaagagcttaaactattctcttgtgacccttcccgagtcagtaacgtcaattgatccaggaggaagataatatagttatatctaagtagttatctaagcttttgatctaatctattaggttaatcatatatgcttggaatatgccacattgcctttggctgtatattatctgcttctcaagatttgtcctaaagattactggtccagacattggtatataaaaagtatgaaacaactctcatatatttgatccttgtttggacttaggggtgtttgggtgagagggactccctctcaccaaaaaataagtctctagggagtgtttgggtgagaaggactaaactttagtttgtgcaatggtaccaatcactggtgctccttgctcttcttttgagtgaccatgtgaactgtgtgttaattatctaggttctactaatttcttttaatgttggaccacttcttgtgaatgtactatgtcagtacctcggcctttccattctgacaatgaattgaaacgtgcgacgagaaaagtcaatagaagcaaataaacacacgtgcttcaaaaatactagcagaatgcgaaaactactactccctccgtcccaaaataagtgcagttttacactattcacgttcaacgtttgaccgttcgtcttatttgaaatttttttatgattagtatttttattgctattagatgataaaacatgaataatattttatgtgtgactaaatatttttaattttttcataaatttttcaaataagacggacggtcaaacgttggacatggatattcacggctgcacttattttgggacggaggtagtactactagtagtatattacagcattatggagtagtatgttattggtgcaaacccatggatttatatcacagactaattcaaacaattgtatcaaatcaagtactgtgctgcatgtaaattgtataagccggagagatcaaaggataaattaaagaaagaaaacgaaaaaaaaataaaacttcaacgcggattcacatccaagtctgaaaaaaaatgcttaatcctaatccaacaaatccactagctgaaaaacaaatatccatttgattattcccccaataagctctctttcttcttgctttctcatctctgagcactgagatttcgcatgtattttccctatctttaatcccagcttgctctcccaatgctgtcacatctagctagccacatcaacccttttatcgttgtacacgtgcctttatatttgtgttgcacttaattaaatctccctagttttgtggtagagaagagagagatatctccgtgggtatactgtatacaactcaggcaagctgtgcccagcatgagtgcttgtaatcgcagtatatcagaatcagaccaggtggtccgtggccggctcatagtctcataccaaatctctctcaattttctcatttttttaaaaaaaggaaaaacacatctctctcgatctgaatgcatgtggcttgaaacgacagtacgacaccacatttacctggccagaatttgcaaagtttggagcaaaatcacaagcaaagctggaagatgcatctagtaggagtagtagggagggagtagagatagcaacggtacatgagtccacgtgtgtactgggcgacacgcccagtacaaggtccctttcgctagccgtggcggcgtttggtggtttcaccaagaagctcaagccctcctcgttgccacgtggatatctggtccaggacgcggcgggcccaccgcagcctcgagtgacaggtctccttgcaagtgggccccacgctattatttattatccgtaataatctgatggtcctggaccactgacaaattctttttctcctctgatcgcccttttccttatccgctttaaaattaaaaaacttcaaatggtatagtggattattcttgtttgtttgaaatggaattttcggttaaatttcaagcaactcgttactcaggatttaaagagtatttcgtggctaggtgatcaagggggagcaagtatgcgtatcatatgatcgacaatccacgatgctgaatcttgaagagagaaaaaaaataacgtacgcagatcacagcaacgagagaggatgattaggctgattgtattattattgttaaacatatcgtcgccgacaagcgccattagtaaagcataaacatccgtggcaccattcaatccacgctaattcaaccacacccacccgccgcgtacatcgtttcttgctttgttttcctgcaagatcttcatattataatcttttccctagctaaagatcaagttcaagtatgctacacaataatatatcatcaccttttgcaagaacaatttgctccttaataattaatctcgaccaaaaatatctgtacaaaacaaattcgagagcaactcaaagttgaaaggaactctcgctctaattaatctctacatctacaaacaccgttaattaatgccttgattatgatgtttcatcgccgagtctacttgatcctcgccgccggagcggccggcggcggcgtgaagaacccgacggcgcggcacttgacgtccatcccggcggcggcggcgggcatcggcattgctccggcggccgacggcgaggtggccgtcgacctcttgtaggggccgagccacttggcgagcatgtaccgggtcttgcgccacggcgggacgtgcaggccgtgcgaacggagcgaccgccgcgccgcgtcggccgcgacgcgcacggcgcgcccgacggcctcctcccgcgccaccaccaccgacgccggcacggcggccacgacgacggcgtactccgccgtcgcgcgcgcgacctccagccccgcccggaagtccgcgtccacaatgtacctgctcttctgccccctcgccgccggcgcgaccacgtcgacgtactcgtacgtcccggccgtgatgccaccggaagcctcccaccgcgacttgcacacgccggcgtcgtacccggcggcccgcagccgccgcgccacggcgcgccggaacgccgccccgtacctcctcagcgccggctccgcctccatcgcggccgccacggcagcagccagcctgacccggaacgggtcctcctccaccggcgggtcgagcagctccctcacggactccgccgccgccgccgcgcgttccggaccgtcgccatcatcggagtcatacccttcgccgcccttgctcgccggcccggcgccgtcctctcccgccgcggcgccctccgtctcaagaaacgcctgcacgagcccggacaggcacgcggaggcctcgtgctcgctgccgctgctcgccgacgacccggcgtccccgcggagccgcgcgcggacggcgtcgtcgaggcggatgtagacggccattttcgccggcggcgtgcgtggatttgaggtgtctgagctcgcggtgaggggaggaggcgcacacccgggtgactcgtttttatagggtggttggctatgaggcgaactcgagagagaggaagggtttattcctttggatcattagtgattagtgggggcgcttaagttaggagcaacgaatttgaggaagttaaccatggaatatgctttcctgatgagagatggtaggcaaaagcagtgcgccaaaaaaaattacatatcaaagctaatttggtgctgccatgtactccctccagttccatattaattgaacttttaaattccatattaattgatcttttaaattctatattaattgatcttttaaacaagtttgaggttaaacttttataactttaaccataagtaactttaaaaatatttagttccaaaaaattagaacaacatatatagatttgtctttcaaaacataaacatatatttatttattatatatattataatagaaaaataatgtcaaggatatattttataaatcatgtcattgtctaaatcgttaattaaaatgaaacgggagagagtaaacagatagagcgtgttggttgatggctcgatggctgacatgtataaatgtttatctctgttttctttctaggtccatccatactgacagggttaatgttgttacagtgcattttctgctgccagaggtgacaggtgtacagtaattagcagctgttagcacgtgcttaagttgtttccgaatcaatggacgagttatttgcatcttttaaaaattatcttccatcttcaaccatgtagaatactactcacacgagagagctggcgttcgcactgtatatatgctgttttctactacagcatttgaccacgaaacgtccagggaatggagggaaatagcgtggaaaagcaagcttataatccacacgcactatacgaatatacgattatgcaaccaaatcactttatttatttttaaccttaagcccccgtttcaaacgtgacgcttttttcacctgtataaaaacagtaaaaagctttctcgaaaaaccgggtcgccgcggtgtgttggcatattgcactattgcgtgtgtgtgttgctgccgcctgcgtgcgtgccgtgcgtggcgaggatatgccgtggcatcccgaggctttgtcctatccgcactgtcacgcgggccccccaacctggctcgggcgacgtcgattgggccaagtcagcagcaggtgggggcgcccccgtgtttggcccttggcgcggccgcggggtcgccgtgggagggacaagagcacgagatggatggcgactatgctgcccattgctcgatcgatcgtctcggtctcgccactagactcgataatccatatccgtttctgtgatcgcctcttcctaatctctatctcgacgctctcttctcgccccgtctccgtctcgatctcgatcggggccctaccaggttcagctgtacgcaactgtttccaggagtatctacactgttgacggcatgacatttctttaatgaaacttttttacttgccccctggtcctgagctgacgctgaacttatcaccactcaccagaaagagaggaggcaagtatttactgtacgcttatcagctgagggaacagagttgcgctgtgcgttggaggtaaatggtggcatacgagttacagttacttttgccgtattgcggtggagacaactcaccgacgcagtggagtaaaatctcgagcggagatgggatcaaactccgaagagaaaaggtcgcggtggaaacatccagggtcaaacggccaccagccagggcgtacgtgtaaacggcgtggtcgcggtggtacacatgcataggcccccgcgcacacgggggggcgagcgagatcacgaggacaccggacacgtaccggatcggagagaggcggggccagcgttatcaaggttggttactcgttgccgtcgcgaccggcccaccacctcccaactcccatcccgcgcgggatcctaatattcctgtacagtttggtcgagccaacgctgcgctcgcgccccccgcatcgacccaccgtttcgcacgcagtctcgctctcgcgcgtgctcgcgctcgcgcaggcgcagcaaacgcaacgaccgtaggccgggtaggtaaaggcacgtactacgccgcgcgccaccggtttgcgtcgcggaacgcccgcccgcccgcctctggtttttgctagaaacggacacaccccttcgcggaagccaaaatacccaaacccaagtggacgacgcggcccagcggagctgcggagggagcatgcggccgtggagggggagggcatctcgcccattccgtgcagcacagaaactgcccctgtcccatcgttttctttggcacagttgggtgtggttgcgcgtgatcaatgtgcgtgtggttgtgtagactactccacttgcttcccatgtaaattcgggtaatgagacccagttagatgacactaaaacttttaaatccctatcacatcggatgtttggacattaattataaatattaaacgtagactattaataaaactcatccataatcttaaactaattcgcgagacgaatctattgagcctaactaatctatgattagcctatgtgatgctacagtaaatatttttaattatgaattaattagatttaaaaaatttgtctcgcgaattagctttcatttatgtaattggttttgtaaatagtatatatttaatactttaaattagtatctaattatagagttaatggaagagagagagcagctcgacgactaatttgcagtcgggtgatacgctgctcccaatgatgtgttagtgcatttttctcttgcatgcatccaagctgctactctcagccaattgtagaatctaagtgaacactagaaaaatcaaagctagctatgagaaatgtgtaggatgtactctctttgttacagaataaactaacatcgtacaagatatgtgtcatatcttaaaataacgaatctgtatatacctatatccatatttgatgtattagtatatatcacattctgcacgaaattggtttattttgtgatggagagagtatatacaatctattattatattcactagtttttagtataatatgatgtgatcacttttggagccaacaactactccaaagcggtggaaggggtttgcctgttctccaaagcgtccacgtacgtgtcgtctagatacaatgaacctgtgcgtttcaagatcacgaaggagcattgttcgtcgtggttctttagcatctggacagaagtttgggtcaaattcaaggctgatagttacacaggaaccgttggtagcatgctgggataattttatggcctggtcgcgtgaatggcgtaagtccattataagaaacatgcagtccaccacgatacaaagatatcagcaaaccaagtgggtgacgatacgcggtgcggtgaaggagaaccagagagaatgaacaacgatggcacgccaagtcgccagcgggcgcaacgtggcacgtaggtctcatcatcttcttcgcctctcgatcttcggcatttttcttgtaccaaatgtttggagctaatagtatacgcgcatgtgatttcctacacctaaatattgattttgctcagctcggtgctggactttgtggatcaggaataacccaacaaatatgcaagaacaatgcacatacataacgtccctttcgaccatcggtgcttgtgattttgtgaatcattaccgatcatattagagtcgccgaagaaatctcgagcttcctattaaggaatcaccaccaaatcccatgagatttaatttgacggtgtttattacagactacaccatcacgtgatcccgtctctgtactcccaaataaactatttccccacgtacaatcaggttctataagcaggtgttttcccaacacctctttctcgttttccgcgcacatattttttaaacagttaaacggtacgtttttttataaaaagtttctatacgaaatttacttaaaaaatcaaattaatatattttttaaaaaaataattaatacttaattaatcacgcgctaatgaaccgctacttttttttttttacttccggttgaacatgggacactgaacacaccctaagtagagtactccctccgtcccaaaagttcagattcatagctaaaaattaaacatagattaacactgttaagtgatagtactagtaagcaactgtgtgtcccctcccctggccccgcgcggtcgcgaaaagcccatttaaccccacgcagcgcggcgcacgtacgactcgtagttagggctgaaaacggtatggaaacttttcggattccggatctattttcgaaaacggaatctgtcggtgagaattttttcggaatttttcggaaataaattcggaaatattttctcggaaacggaatcgaaaatgataagggcagtttccgtcggaactcgcaatcggtcggaaacttttcggaatttttttcggaatttcaggaatttttttcagaatttccagaaattttgtaactgaaataccctgggttctttttttaagcacttaatagagaataccatggtgttttgttgttattttcttgaaaatatttgttatgcaaatctaaaattacataagaatatttttttccttcattgggatttaccaacatcattactcttttaaatatagataatttatttcatagattgtgttttgtgatgtactattaatacttaataattagacttatatgattgtgttttatgatgaatcgttgaccgttgagatttgagaattggattaatcagtttgagagttttttttattccgataaattttcgttaccatatttgcgccggttcgttttcgctctgttttcggtttcgataatattcgattccgttttcgtatccaggtttccgattccgattctgatttaaaaaaaatataaaaataaaaacggtaaaaatggttttcgtccatttccgtaccgttttcacccctactcgtacacctctactcgtagtacgacattttttaccagaccggccgcatgcgattcttcaccggtgacagcgcaatgatgcggtggcctttatccagcggcacgcaggagctgtctgtccacgctgttcatgcagcttgcagatagtagatcgaggccgtgtttagtttccctttatttccaactttctattacattatatcacatagaaaacacacataaacttttaaccttttttttaaaacttttaacttttttcaaacttctaactttttttcagaaactaatcacactctcagacacacgacgtcaaatcgtcccgggattaggattaccaccgttttttcttttgtctcgctgtcgagaatcgagatcatcgtggacgtgtccgtgctaatccacgtcgaaatcaatcgaatcatcgtggacgtgttgctaatccaagttaaaccagccgtcaaatgacggccccttcaacagaaactcagtgagatatttccagtgagattagaaatatgttgttggtttcagtctcttttacttcccccgttcttaaatataaaggattttagttggatataatatagctttatatccagattcgttgtactaaccaaaatctcttatatttagatatagagagagtaatatgtgttagtttgttagaggatacattcatgggtacatgagtatgatgactaatgtgacgtgtatactgatatgcgcgtgtgtctaccgtgtaaaaacatatcttgaaaaacaaaaaacaacaacgagtgaattacatgttaggtcaacttggttacatatattacacattgacatatttggttgtcagggctacggcatatcgcaaccaaccaaaacagttctgcaagcaacaaaggcagttgcagccacagcccttgcctgctgaataggccagttggacaaggccctcgtctggaagtgtttgctgatacatgggttactggcctaaagtgcaaaatctggtatctaaacctaatccaacgtaaaaatattgatgatccatggtgagactaggataaaaataactggtccaaaattcaacttactcataataatatcatgcatgatagatatctaagttgccattatgtcattttacgtatcataagatttgtatcctgttatatgccgatactaccaaatatttgatataaaggattactacgtttcgtatcgcagtaccatcaatcttatttatttacgacaatatactcagaaatgatgtgattatattatataattctatccagtttggaaagaacgacatatcagtctttttttcattttctacaggatatgagaaaaattccgtgttccaaggatatcaaaattaattaggtgcggacgtttgtgacgattttatatttcataaatgaagcacattattgcatctaggttttttctcttgaaccaatatacacgaaactgagtgacttcaacatcatgcgtggcgccatggatagtgaaggcagcaagatcaggagtgaagtttgatcctgtgtattattatcatatcatgcgcataacaaactagatgcaataaacatttttttctagccacaatataaacaacttattatgattgatgtccttgttaattccggcctaatgatcagcacatacctgtcattcctctaatcaggtctggcgaaaaataaagctaaatcaagttcaataatacaccctaaagtaaggactgggtgttaaagtggggacacaaacgatcaggaagatcacattgatacatctgctcctagacttgtttggtccttttctgattcgttcagatatgcactctacctatcaagtagatgaagaccacatacagtagtgatcaaccggtcgtagtgccacaagtgtaaagtgaacatcatctggataacgtggtgtgtgcatttctccgtttagtagtgtattgacttgatagaccatgaacctttcattatttttttgccgaagaaagttgagagagatatttgccactcccactatttttcatcattattcgttccagggtaatcctccaaagagagttgataatatatatagcaggtcaatatataggcatgctttttttaattatgttgccgtgcaattatgcgtttgtttagtgtgcattttgttgtcgggttagtgcgggttaaaactagtcagcctatcatttttactcctaaagatggtaactgatcgatcagctcgatcggacaataaacccactgccactaccactagtactaggttagcctagtcctagtagcatgtaggccttctaaagttggaagtttgggttaaaattgatacgatgtgactgaaaagttgcgtgtgtatgacaggttaatgtgatagaaaaagttgaaagtttggatctaaatacagccgtagcatcgcaaatcagacgagctagctagtactacaatttaatcatttccagcctcatcttttcacttatacttatcagaaaaaaatttaaaatttcaatcttaaatttgaagctgattttaaaatcttttcatcggagtttagtttttagcatttacttttaaatcgttaggaacacgtatataaaagttttattaacaaattacttttcgtttgcaaatatgatgtttgaacgatggggctgtttgtttatgcttattcgatccgcttactaacaatttaaatttgtaaataaaacatttatatacacgtccaatttaaaagtaaatgttataaagcaatctataaaaaaaccataaaatcaactccaaaattaaaatttaattttggcttctaggtataagcataaacgaaacaattggacttaaaaaaacattgtcaggcgagtttttctttagaaaaaagaaatgctgcatgacagcatcccattccgacgggatgacacctcatcttgtccaaatgtccaaatggggtatcaatcgatacctactggatatcatacgatatttgcgaggtatcatcccgttaaaatggggtatcagttgatacctactaggtatcatacgatatttgtgaggtatcatcccgtttgaacgagttatggttcaggagcatttttcgaaaaaaagaacatgggcaggagcaatcacccaacttcctggaagttgcagccttgcaggtgacgcggctagatgggcccggagggagcacgcggcgcagcctctcgtggacgaacggcccatcgcacgaccagagcccacagggatacccggcgcgcaggccggttaacagagatgcctcgaacgcaggtgcaggcctggacttgtgttgtagccctgcagcccgcaccggaggactagcgattagcgaagccgcggtcacgcacgccacgcgttcgatcgatcgatcatcgatcgcgaaaaccctgccactggagaaatcctattcattatcgcctagaaattcgattgttaagcttttatctgctaaatggagtatatgactactgcatgcgtcaccaagataagcataacgtacgtgtgccgcttcggtgctgctgcgttcgcgaaaaatcattgcgttcgtttcggtgctatgctgtgtacggccattacggtgtaccgtcgccgcacatatccacccacccagcacacagacagcagcgacacaagttacaacaatatccaggtgagctgggggccatgaacctacactccctagccactctcacgccagcgccgcgacaaccacccaagtttggctagcttcccaaccctgacgtcacgtaagcttttgccaattccgccaacgcccacgcccatgcgcgcacccgtctacgcggcaccgcgcacgcgccacccccctcgacgtgtcctcacaccacctcgtccctatccatgatcgcgtcccgcccgcgcgccgcgcgcgcgcgcgcgtccttccaaacaccaacccgcgagtccttgagtcctttccgttccgattcccccgtataaatccccgcgccaccgtaccacgggctcccgcatccatcgttctcgctcacttctcacaaacacaacaaaaaacatcgtcgcagacaaaaacatcgtgcacgttggttgcgtgtcaatggcggctcgttgtccggtcggtgtggcctctgtgctgctgctgatcgtcttggtcacggtggcgtccgcggcgtctggcgcgcgatccggcggcggcggcggcgggggcatacgggagttgcggggcggcggcgcggggaggagggtggggggaaggacggaggtgagggacgtggagggggacagggaggtgcaggagctggggcgcttctccgtcgaggagcacaaccgccggcgccgcagccgggactgcggcgacgtccggctggagttcggcagggtggtcgccgcgcagcgccaggtggtgtccgggctcaagtactacctccgcgtcgccgccgccgaggagggcgccgcgggtcagaacggcggcgagccccgcgtgttcgacgccgtcgtggtggtcaagccctggctcgagtcgcgcacgctgctcacgttcgccccggccgcggactcgccgaacgagtcgtagcacgcaggcagagagaggcaaggtcacacaggacacagctgagctggtgtaagaataaaaaatgtaccaagtttcaggtgcagttgtgcaccgaacggggtactcgtattcagtagagagtgaacaaagtaagtgtacgtgtgcgtgttgcggcaatagatgttcgaaggctttttgtgtagagagacgggagagagtggcaataaagtactatacttgttctacatcttcttcgtttaatttgcatatgcttatgcttatttttttcccactcgatcgccaatcaggctcaggagctcacgttgcttaaataatgctgagaggtgatcgcgtgtagtgactagcttgaacgaacgaaatcatcaattaataaaagccctagtgctaccgattttctagttttttttttctcctcggaatggctgtcacgaaattaaattaaaaaacgaccttgtttcttactaactgagaaccagaaccttgtcttttcgcgatgcaaaaaaaacctttgcacgttaatatattagaaaaaaataactagcgcaactgtgatacaccgaggcaatcactggtcaacagaagggcataccccattacataagaaactggtttaaaccaagcaaagcttctaagctaagactaagagattaagaagttgcgataaactaagctaagttgtgtttcgctaagcatagtcttgtctggtggtcccatgcacaaaccaggcacataagaccattcacagtgcatctacgtggctttcatccctactgcgccccacgaggattttcgtctctacgtttgcaaccctcgtacctaacatgcaaaattatagacaccacttgagctatttcttccagaaatacggctgacagtatctttcacggcaaatatcccgagggactatctatacatttgtcgataaattttaaaaatttatcaaatataaatacaatataattatactgtaattacactgtaagtatagaataattacactataacttatatgtaattatactgtaactatagtataactacactgtaactttagtataactacactgtaactataataattacattgttacttatatgtaattacattgtaactataatataacttgcatgtaagtgagatgtacctttataaaacttatgtttggcactgctcacgtaaaagagggattacgaactcgcaatgtctgtttgtacgatgcgtgtggaggccatcattcatgcatgcatgttcgggtatgccctgccgctttatctctgcccttcgtctgacatctacgcgtgcatgagccgcgccagtgccggtagccagcggccgtcgaaagaaacaaatcaaaacgtcgacgcaaaagcacgaatcttgaggttcatcaagcggttcgaaaatcgacaaattctaaggaagaaatttgtcaacagatttatagcaaaatcgataccgaaataccaccccaagctaataaatctcaacatgcggcagccagccaggttttggtgaaacagtactgtataaaagcatcgcgtttcctttctcgttccccctctctttttcttccgtttccagtgcgagtacacggcaatgatcacccctttgctacttttcatatccatgcaacatgcatacaaaaagatggaacaaactccatccttttttctagtccacaaacgctagcttcgcccgcccctcgtcacgcaacgccggacaaaggccgagcttgctgttgcgcggagcagctgcagggtccacgtgatgccgcgccgtggcgccgcatgcacacacgcgcgcgtcgctacgtggtcacgcgaacacctgcactgcagtacacaccaccctacctatatcatctctcgcctctgtacatctgtgcaaaactgcgaaatccaaacatataattagctagcaagcgaaagtacaaaactatggcctccaagctgtattacgccgtcgccccgctcgtgctggtgcttctcctcctcgcgccgctctcgtccgcgcgcctcgccgccgccgccgccgccgacgacgacgggcagtggccggcgggcggcggccgcgggaggaaggtcggcgggaggacggacgtggaggacgtggaggggaacagggaggtgcaggagctcgggctcttctgcgtcgtggaacacaaccggcgaggggggtcggccacccgcggccgcgggctggtcttctccagggtcgtggcggcgcagacgcaggtggtctccgggatcaagtactacctccgcatcgctgcccaggaggccgacgacgagctggtgttcgacgccgtcgtcgtcgtcaaggcctgggtgccgtcccgcgagatggtctccttcgtgccggcggcggagctgccaggatactgaatcggctggttatccatggacgcatgccttttgatggagatggaagatgggtgtgcgtcatcatctttgaggtgatctaatgtctaattagatatgatactgatgtaagatgcatacagcatgactgcatctaccatgtttggcgtaaattttgcttgctgcagagtccaacttgtgtaagatggtagcttatgcttctcagttttctctctttctgtagcatctgtaaatcctgttcctcaatgacacctatagctctgtacaaactaaaaaagagaaattcggaggaagatatgtccctccaaactttttaaagaaaaacttgtgaacattttttaagaaaaaaatgtaaatatgttaggaattaaacacaggaccttaaaattaaaaccacacatccattaccactatcaagtgcatccagttcagtacaaactgatcgtgtcgtcagctaaaccctagcgtgagctaaggtcgatgaagccactctaaccaaaaggctcctcctggaacggtaccagataaatgttgaaggatttttgtggaaaaaactttgggtgttctaaaagagctaattaagactcaaatttgacattagcaaatcaccgtagccgctctattatcgtctgaaaattcattgcttatgattttatcgaatcccactaatccgtaattcgcccatagctaaggttaataaccgcgacgatgaaacaattgccctcagttttgcagacttggcggtatatcatcattgacggatgcgtaccttgggaagagagtaatgaagcgggcaaagaatcgatcgctcgtttcctgcctgattttggcggtatatcatcattgacggtatatgctggcattttggaccaatcatcggaccagccacgtcatcaaccacaccaaactcaccaaactgcgcgtatggttctgtagccgccgccgttaacgatgtgattcgatggtatttacctggcttatggtctggtgtgtccgtttatccgagcaccagaaacagattaccttaagattagctacttgggcacttctggtagtgaagtcatcgcactggcaggtgctaaatgactgcatggtgccactctgtccggttcattttccccctgaaacacatttcaggagatcctggcggaatgggtggagctcaaacagcagtagccttgtgcactgttcaacgtttccatggaccgtgccaatatatcttacccgtgccttccaacttatccgtgaatgacgaacaccggacagggcgggtactgaagtttgaaactgtcgagaccaacaatttcagagaagagaacgacaacctgcaaaaacagttaagcctacaagagaaccaagtttaagggcggatgcagcagagccacgggacatcatcaaaagttcagtcacagcaattcctgcagtaaggtgcgcccaggcatagcgttccagcttgcgcatgaaatctgcatagatctccaaatgtaattagtacttgtaaggaagaaagcaacaaaccatccacgacctgaactgccaccaatcttcaggtccacttatcacgatgacagaccagaccaacaacctgatcgcgcatacatgttgcagaagaaaaaaaaaagtatatatctattttgcatgcctttttttgactgtcgatcaattcaagaaatgtccaacaatccactcctaatattgataagaaagaatcaaccctctgatttacttgtctaatgttcactatgaaaagaatactctgcaaaactcagaacggggtgacaagaactggaagaaatatgatcccctagggagtcttaacacttgacgcaacagttttctatagaaagtcctacaagtatagtttctccccccaagatttctactagtttctcccccaagatttggacgcggacaactctttctcagtttttgtgcgttaagaaggtgaaaaggcttatgttacctctctctctgcagggtgtaactcatgttagctgtgtggtagaagccacatgaaacagcaagagatctgcctagttaactcatcttaataaacttacctcgtaatatttacacaaccacacgacccgctgattcttatctctcaaaatggaaattgtgcatcatcttctagcaccttaaaatgttgaggatgcctaccagagcaatgcaggttccacatatgtaaatatgccctctccagattctttacctgccatttttgtttacggaagtgaaaaagctaaccctgcaacagatatggacatggagttcaagactgaaaagttacccatcgagctgtatcaaacaaaggacaggtcatcctaacagccttgagcttgttggtaagagcttcgagtttcaatggattttctgctagagagactgccctttcttcatattcttccaggctggattagcaaagctgattaaaagaagagttcaaccataagggaaaaaacacaattggctgagatggctaacctattgactaccatctcttccccaattccagtagctagacacagtgaacctgcaaccctagttgccattttctctagtggaagagtgatcattgggagaccagcccataatatatctgtaccagtggtgtggccattgcacaacgggctgctcattcaatataattgagaaaataagagtatggcaggtaaataagaaaactgtcaagggcaataatggatggaaagtaaggttacgtgtcaagaaatagatctgctagggcactgcgtctgatgtgctcattttttgcagcaacatctgtaaatatgatttgatctgctcttactccctttgagattgcatctgccaaagctacaacgttagaagtggggagagatatagagacagaataggaaaatacgacattacatgcgcgcaatctcatctctccagctgctggaaatctcaatagccacaatgcactatttggtacacgcttcagaatattgcacctgggttgacaaaaagcaaaggaaaaaagatcaatacttccaacaaagcatgcatggtaggtattgtttcaacgaacacgtatggtcacatattataaatttaccataacaaacgcatatatagaaagaatttaccaggtgttgaatatgtctgggtccatcttgtagagttgattgaagcatgcaaaaataaatttgtcctctggcagaccatagtcagctcgcttgtgtgggcatacaggaccaagaacatctcgatttttctattttacaaatcaatttaaagttgattattaaactcataaaagaacaaccttattcaatctttggcctgttaagaatgtaggaatttcacatgaattttgcaggaataaagaatttctcaataatagtattatacaaaaagttcaaaggactcagtcctgaaccttatgtttttttatctctggttattttataactaaactaatcagatgagcgattatgtccccatattaatgcacacccatccaaaaaaaagaacccatcaacatcagaataggttggcccaaagacctcacatgtcaatgagaaagtcataggatgataagactattaaactgaaagttgaaaaagactatcaaactgaaggttgaaaaacagaggtgagcctaatgttaaaaagctgaatatatcttttgcaaacatctctggtaccatgtttttaacatacctgcttatagtcattcacaaagtaacagtggggaagatggacaagcttttctgagtatatatgtgaaaatttcagtggagaaacaaactgaaacaacaacaaatggccaatcaatttataggcagagcaacaatttgttgaaacaataaatggctaaaaatttcaatatttcacctcatcagtaaccaaataatcaatgtaatctgcaccagtggttccaggaaatcccatgtaagaaacctggattggggctggttgtaaagcgaatatttcattccgtgcaccctgaaacaagaagcaattttacgataagaaaaaaattccaagaacattaaaagttaatctcccacttgagacaacacatgatttgaaaactatacggtggcattcaaatatatcgcacacatttagcatgcataaagaaaatattacagtgcaatagtggcacaccaaaataacagctacatttctgaacatattgccatgcccaatattttataatttaaacttccctaaaagtgataaagttccatagaaaaactaaaggtaggattaataaaccacactaggataaagcagttatctatcacctaaaaaaactcagccccaaggggaaagatctcccctgaggccacaaggtattgcaactaagaagaagcatctaaaaccagggccgagaaaggtcacgaaagccggtcctcccaaaaatggggagtagccccctatgggttgggtcttaacccgtgctttgaggccactgccccatacacgagggcccaccctctgtaggtcaattcttaatccatgtttttagggaaccatcgagtgacctttttggtgcaaggccaggatttggatcctgttggtagcttcccgctgtaatacattatggcttttacaatccccaaaataagcaggtgattttataacaacagagaggatattgctaaatctgctgctgtaaaatactgattaaaatagaatgaacaaaaaaaaaaaaagaagccaagtgggggtttgcaaaagtgccatgatgagcagaaaatgaatagaattgtgatgggaagccttagtaagtccataccttagtatagccattaagattaataagaatttgtatcttatcctcattgataactttagcaatcatatcagatgacattgatgacacatcaatgaagtgctcagcttcagatcgaatacgctgcctccattctgtaccatcatcttggctcagggcataacagaaaacctgcaaccatatttataaataaccattccctcaaaatacatactctcggtgtgtataggctaacctcgatagtgtcttgattgtgcattccaaatatagaacccatcagatgagacaggggatgattgccaaaatcactactcacatacctaagaccaagttgaaaaattgatttcatcaggaagcaacaatcaagcacaatatgtagcaaagtagatatcataccctattctaagtcttgaagttctgccatcattgctgattggaacaggataggagtgtgtgaatgtaggaagcccaaaacgtgatgcaaccaaagagtaatgagctgcatatgttcgactgaaaaggggaaaagttgtaacatatggtctatgtagcatgattatcatcaaaacataccttataaaggttacagtgatcagtataggttaccaagagaagcctcacctgatttccagtgcaagagttgaatcaattggatatgctatagcatggaatggttgtacacttgggagagaggacatctggaacaaaatgaaaataagagcaatacatatcaagaaaagtattccttaggtaattcaggtaaacagtaatggaaataaaagctcgtgcctttatttgctgcctgatgattccctccacctccacgaatttctctgctcgatcatcccaatcacatacacactgcaaataggtgaatgaaaaaaaatgttaatctccataaaaactcaggtttcatgtgaatgagcatccatgttttaaaaataactagagaaaatttgcaaaactacgcatattctggtgcgattataagaaaactgcatgttccagttacatttcaccaagttacatatattccccagcacaatgtttcaacgaggaacatatttacttttatagatggaattagaggatttcggggtgatggtgtgttctacacccagacgcacccacacaacactagaggatcttttgtggttgtatattcatacacattagttgttgcatgattttttttttcaaaaattggcatgctttgaatatatatatatttaggtagctttgatctgatgtgatcgtctgaagtggcatgccaagaatctagagcagaaagacatgctgtggacgatggcaggttttcaactgggagcggatgtggatagtatctttcaatccacagtcaaattatgtgtgggcaatggcactgacaccaggttctggacagcaaattggcttggaggtggcctatcctttcaacttatgtaggccgatcaaagctgacagtggcacaggccatggtgaaccaccgatgggtacgggatctgcagggatcactgtcaaatgaagccatggttcaatttttttagttatgggatgagattcaggtgctacagctccatcatgaagctgacaccatccgttggaagctaactccagatggtcagttctcggtatcctcggcgtataatctcttcttcatggcaagagacatctgcccctttggggagttaatctggcacacaagagtccccctctagaatacgttttttcatgtggctggctgtgaaggtccgttgtttgacagcggacaatttagagaagagagggtggcctcacaccgacaactgccccctgtccgttgtttgaagattgtttgcatctgcttgtaaactgtgattacaccaacagggtatggagattgatgcaagcctggatcaatgtcgacttccctatccctggaattgatgggctcggcttggcagactggtagatgcaggcaagcctctattttcggaccggctacagggcaacctttgacagcatcttcatgatgatatgctagctcttgtaaggaaagcaatgagtgggtgttctaacaaaggtcgagaagaccagagcagctggtggaagacgtcaaagaagaaatcatggtgtggaaggcagcaagagttttcgcggcatgtaacgattagcggaccagccttggtgctgttgttgttctttgcttgttggagctgaggctctgcctcaataccggttcgacagccttctgtcgttgtaacctcaagtttgtatacttaatgatatttggtcggccggttccttcagccgacctggcaaaaaaaaaatctcatgtgatcatgcatacaattgttagcttttttattttattttgaatcttatagtatattcatttttcaccattgtgcaggcactataatagtaattataacatgattttaaacattataatctgcttgctacacaaactgaagagttactttttttggcatgccatttacttcaatgttttaccgctacaggaatcatcaaagaatgcacataataaaggaaagaaggtaagagtctatacctgtagagtgtgcaggagattgcaagtagcttcaggaaaatcttgacgtaattgtagggcctgcttgtaactgataattgatgcctccagcaagcctctgaaaataatagaaacatgttaaacatgtagcatcagaactgatgccctagaatcacacttcaccagaaaataaatgtggtagaaaatgcaattacgtgtctttgtaagcagccgccaaatttgcatgagcttcagccatagttggtctaattgtaacagcatgaaaatagtcttgaatggcttcagtgatcctgcctgcttctttaaatgtgttgcctctattgacaagacagtcagcagccattggatcaatgcggagtacttcattgaaacatgtaatggcgtgattacagtttccctttttcagtaacgaggaagagaattgtcattgtgttgttaaatggtataaacggttcacaaaagtataacatcaatataaacaaaaaggtgtatgaaacacgtattcgccgaaatcaggagcgtttggcatcacaagtacctgctgtttgtaaatcattgccaagttgttgtaaggtgcagataatccagttgtaactgtcagtgttgccatgtacagtgaagctgctatgtccatcatgttcctgcaagtactccaaaatgaaactcttgcacaatccaaaagaaatgcacaccatcaaaaactcacctttccatatatacattcccaaggtttgtcaaagcctgagggtgagaaggctgaagagcaaggcatgtctgcaacaagaaaaggcatgactcacatcaacgtaactataacaaaaaaaaagtaaaactattgaagacaaaattcagcagtttaatcttctatggtaacctggtagcaactaatagcctcttcatttctcccagcatcttttagagcatttccctatcagtggaaacacatcatataaggtcttataccaaaaggaacaacgatttagtaggcatacaagaatgaaaaaccaaccagattattatatgcttcaacataagatgaattgcaatggatggcttgtctataacttagaatagcaagatccagttgcccttgttcatggtaggcattaccaagattccctgaaaatactaaaaattaatccacatttccacaacagagccatcattcggggtcagttagtggttgctaatatgctaatctgtcttgtacttatttttcaataaattatgaaaaggcagttgccaaaataaaaacaaacaaactagagtccaactgttgactctactacacgtgatttgatatttgaaacatgataagatatccatttgaaacttatattaaaagaagtggagttaaccaaaatcacttttttaatgaaaaaacaggtcatgatacacctaaatgcctcaatcataaccaaaaaaaaaataatcgttttacaagtgtaccattcattgcagcaaacagtacctagaaattactgataagtgcataaccctcaagaacaatacctcaaaaataagcaattattcaaaaaatactgtgtcaaaatgctaaacaacaataaattatggcaacatatcaaatgtcgtaggaagcagctttggagcatgattatgggttcaatcatatttgccatactccaaccacaacaaacatctacactcaccataagctactgcattttctggctttgccctagcagcattctggaagcatacaattgcatcctgacgcattccagtaaccttaaaagtgatatttgttgtcagaaggatatttccacaatgaaaccagaatttatgatgaaatgaaaaataccttgtaaagatttcccaagttcaggtgtgcatcgtaaaatgctggattgcatttgattgcttcctgatgtttcacaaaatcttaaaagaatcagaatattgctggacctgtcattatcctaaagtatgctataataaaagaatctgcatgctgtagaacccctgatataattgattcgtttcagaaattttttgatataatgaattctgatcatgacaaaacagcattgtcaaggctccaatgacaagctatgaatgcatcaaagcatctacaacattaataaatgtcaaagtcaatgcaaaccgcataccttgtagtagagagctgctttattgaaatctccccattgcatgagaagtccagcaatattattccatgcatttgcaaaagtaggctttatgtttagagcatccaagtagtgactgtatgcctgaataaaatgcaaatcacataaatattgcaaatgaaaataatttgaccattcatcagtcatcttattactatcatcaattcaatgcagcataacaggccagcatcagtaatttttactttgaactgaattggaggatcctccactataattagaccctattctgttagttcaacagaattgttctgaactaaaatcacaacatagtgctacaaaatatgtcatttaaccagccacttatcaagatgctaggagaaattaaagctgtcatttagcaagaaaaatcagggtaacatcaggcatctgtgggcaataaaaagtgtattaggaaacatgctagattggtacaaaatagatcatgatggatagcaaaaaaaaaaagttacaaagtaaatttgatgaagagcttgtaaaaatgaaagaataactaatgatactacggacataaacaatttgatctgcgatttttttattttgctacttacttctctgtacaatccttgtgccttcaaaacatcaccaaggttacaatatgcatcagcctatagtcacaacacaatcaattaaaagttccacactgctgcaattaattgagaacatgtgattcatcagaatgcagtaaataaaagcgttggttaccagatgaggatttagtgcaagggcttgatggcagcactcagctgcctgactgagatttccttttcgagtataagcattagctaagtttgtccacgcatcagcaaaggtaggccggagctacagaagtagaatttgttagctcgcaagataaaaaaaaaatcagatagttacaatgataaaatgcatgtaccagcatattatgtgtgtcaccttagataaaaaggttaattaactcagacagtaaatctacctgtactgcatgcacataaaactgaatggcattatcaacatcgcctttctcctgcagcagacaataaagttgaaaacacgccaacacttaataaccccaacgattatggcctacacttttccaaaatgaaatggtctcaccctccaggcattcgcaatgctgttgaagcactctgggcaattcggctggattgcaacagcctcctcgttcttcgcgatgcacatgtcaaactctcgtagctaaaccaaatccccaaatcagtataacacccacgccagcaccggataaccacggcacccaaaattccgaggagaacctggtaatagacggcgccgagcagcaggaggttctccaagagcctcgggttcgccctgtacacggcattgcagtgctccagcgccgctttgtaatcccctgctctgtaactctgccgcgcgatctcgaggcgcgcgccctcgtcaactgaaacccaccaaaaccgcgacgggttaacaaccccacgacgaaaatgaaaatctcggcgcaatcgaatcacggaacagcgagatgaatctcgatcaatcatcagagaggggaagagaaggccaggggttcctgatcgacacgaacgaaacgaaccttcgagggggtcgagccggagggattcgaccaccgtgcgcagctgctgctgctggcgcggggtgagagggcgatggtggcgcaccgcgccgtgctcctccacggcggcggcgccaccgcctccgcctccgcagcgcaccgagagcatcgccggaaagcttctccgacgatcggagaaccaaaagtaaaaaaaaataaaaacctaacccgcgcgacggcgccgcgcggcctcgagctttcgcgtacgagtcggggagggggttggactctctcgggcgatatcgccttttcgccttctttttttttttcctttttttttcggatgcgtcgtcgcgttcgtggggattgggaaagcgtgtgacgcggtcagcgtgcggcgccgctgggtttggaaatcgggtgggtgagcggagcacaccggaacaccagtgctgcgcgcgacgtgcgtggccacgataggaggggacccagaccgtcggattgggtttcggtggtcgcggcgttttttggacggtcgtgattgagccgtgtgtggctgggctgggcttggggatgattcttctggtcaagtcatcgctgttgagcccatcaatggcacaacaagcccatttttagccttctctccctacagcgaggtgagtacaactgacaagtctgaaacccaaagaccatcacaaagatcgacctcttgagtccttgcgtgagaaagtacttcgtgtctgaggaactgagaggcagttgattgcacatcgtgcatgaggatccgtgaagctgtctttgatttttgttcggtttctattgtaaagttgattgtttttttagtactttccaggtcttgtttttatgcaaagtacgagtcggttgtacctcttttattgccctgtccgttctcaaacactcctaagtttttgagtatcgtatgaaactgaatctcatcatcttgactcattaatacatgcaagattacgattcggtatgtaaaaaatggcagtaacgatgtgtcgatgtttactttcgaaatttcagccccctaaatcctaaactatgtctgttgggaaaaagaaaggagtcagtactgtgtgcacaacaagaccagactagtagagaagcagcccggaggagaagtcgctgccaatggtttcacttcaccgggtcggatcaccacgaaaacgcgagcacgtacacggtacgtccaccgcgaaaggacggcacacacacacactgctcccgtccacacggcccacaaccaccaccacacacgacgccgcgcgcgcatggggtcgacgtttcaaatcaaatcagcgtcgtcgtcgtcgtcatcatcatcatcgcctcacctcgcctcgcctccaccccgaccgatatgatatgatacatcgtactgtacgtacctccccttactacgtgtccccggacctcaccgtgcaacgtcgcacctccccaccacagaacacgtacaccacccgcgcaaccaccgtgtcgcgcacgggaatctcgccggctcgatcgatcgccacccacccgctccctccccgagtccgagtcccctcgcgtcgtcgtgtgttcgtgttgcacgagagggcgggctactacggggattgtgtgccggttgggtgcgagagcgcccgcaataatgcgttcgttgcgtgcgcgcgcgcgggggcgcccacacgacacgacgaccccaacaccggcgtacgtagtgcgtggcgtccctccggccccgtcgtccgtctcccctcctcctgcccgatggcgacgcggcgcgaccgaacgagggggggacgactcgtctcacgactgctcaccaacagcgcgcgccctccgcgcgatcgcatactgtttcgtccccccgtctcgcgcgattgcttgtgtcgggcgaaacgcatggcaattgggaaaaacggaggaggcgacgaccatgatgacggcgacgatgaatgaatgatttagcgtaattaggagagggatctacatcacgccaactacgatccagtttgcgacgctcgcgtgggtgctagtgggcagacagtctagccattggggtcgccccggttactgcagcgccctgaaaccgatctgaaaccaccctgaactgaatgaacaaacctcctcctcatgtgggagtgctacttactacactgtctactaatcttgtttttatttttttgttcaggtacggagcaacttaattgtgctggagacctgtgtacgtacatccagttgttggagtggccaccttgcatggtgccctaccggcttagtggtggcaacgaacgccactgttatggtggatgtgggcatagcctcatatgtaggtctcaaactcctcaagcctcgttcgttttcgtgcgagacccagttgttctatgctgctgcacttaaattgcagtaatctcatccactgagatggatcacatggctggggtacaagtacatttcagagtctttttggtgttcattgttgcagttcaagatcatttccatgtaaatgcatagcaacaaaggttcaggattgaatgtccctgcaaagttgcacaacattttgatggcttttgatgatgctcgcataactactgaccttcgagagtaaaagttgtcagcaagcagacgcaagcatggctttatgattgattgcttgtgtgaatggatgctgcaagaatgatagtagtaccaccaagaaatctgcagtaatagttcagaattcaatgttctaaagaaaaaggaggtcagaaatcaataaatatttggggacacttaaagatttccagtaattccaggcgtgatgtgtgcagctagatctaagctcagcttttgacttctttgttgtggctgtcattgcatcacatctcccctttgtgatgcacaacgtacttttctctgaatgcgataaacaccggtgtttgctccaaagatataataataataataggaaaaactacatctcactccagttcccatccctggaagctgaaagaaggacgaacgaacggcaataagataatggccacctccttaacagtacacgcagcaccaaatctgaccatatcatgcatctcaccatgtcaaaaaaattataaaaatcatctttgtgtttgctaattgcagaggcatgatcttgcttgcaagatgcagtgcctactcctcatgacaaccacgatcttgcctgagagttgcactgtctgtccctccatgtacaaaccacgatctcactgtactgttccagtttcaccctttgccccccttttttttccatgggaccttctcatttgttgcagagcagtctctttcttgtacctcatgacattgtcaattcccatacttattgtgctgaaaaaatcagcaggagatgctgtcaggtaatcttgaattttcatctgtggtagtacaagagtaattatggtctggaactgagtaatccaagtgcatggatttgggattgggaccagtgaacactgttctaagatgttgtgacccaattagtcatgatttggagctacctgagctataaagataaacaactgctactacagaattgtttggtccaattcaagaaaacgagtgatcagaacaactccctccgctgattccgttttttggagcgtgatcacagcctggatgatttggacctcgctgaagtagattgggagctcgaattcttaacaataaaagggttgttcagagagagcagagaaagtgacatgcagaaataatagtagtatttcttttctgaacgtagctatagatgaacaggagcagaatagcaacgcagtgaatgccgttgcactgcctgtctgatgtacgcctagctagcatctctgcataaaatcaatctgataatatattggagttggattggaaggcctcctcagccttgtcctactgctgtctctatctctgggtacttatcatacagctcaaaagcagccacaaatccagtcccccagctcacaacttgattgttccttctgtccatgtccttttacatgaactatcttctgggataaacagattctaaaattcaacttgttttctgacccctcaagtactaaaccagaatttgcatacagtgaacttcagcatgaacacatctcttccgagtgaaaaaaaaaatgaagttcagcatgagcacaatgcacaaccaagaagctgaccattcttcagaggggaaaaaaaggggataatttcagcttaaggagatcgatccatggacaggaagaaggatcttaaagatatatatcagctacaaatataatgagaatacaaataatgatattacacgtcgtccctctctgcttgagagggtaaaagggtctgaatgaagcatcatatactgcacccgacttatgtacgatcttgtagcatacatatatatactacacccgactaccgtacatggtgcgtttcatttttgttcaaagaatcattacaccaagatgggaaattagaagctaaaacactgctagggcccaacattgttagggttgaatctcagagtgctgccgcggcaagctgacttctctgtatgtacaatgggcgtcagagctttggatcgaacctttatttggtcatgtcaaagctccattttcatgtggactgtttgcaacgatcctgatccatagcagtttacacatcagaattcagttaaggtgacgttaactatggcatcaggtaataggatgaggaaacttgcctaccattgtagctattggaagaggtggcgatctcctgactttgccccatatccatctgaacaacactttggagatcatcttgccagaaagcaccaacctgtaaagcattcattcctcatattcagcatcgattcattcgaacattttgtgagatcgagacattggtgtgcatttttacctgagaagccgcatcgctaaccccattgaggaaaggatggtgcgagcccattggccggcaaaatgccgggtccaatgggtgcatagaaccctggttgtccatgccgttcgtcaggccacaaccgagagggttcccttgctgaggctggttaatgtagggcagcggcgcacctgaggtctctagtggaaaatgtgagctctgtaacgggctgcatgactggtgcatctgatcagggagaaaatcggaaacacgaggtaagttgggaactgtatgattggcacaataagagaggaaacaaatgtagtaatgagatcgcataagcttgccctcacatctttagcaaggaggttaggcaaattgttgaagtccagctggggattcacagtggccaacttcatggacaaaaactgcaaaatggatgtgaaaggcaaaggttcagatggcgcacgcccgcgcttgctgcgctctaaatcggcaaaagctgcagtttcacaatcattctgcatctgtgaatttgacactggacaaatacctcgacttgccgttgcaacgactgcacatagtttatgatttcatcgagcatgacagcctttccaaccacctgaaacaagtaagcatttcccagtttccaatctgagcacaccgagcaactcaagtaacaaacaggtgggcgatgatgcaaatgatgagtgcttttcttcagttaccttgttacaacccggcacgagatcctgcagcagcttcatcctctggcttatcttctctcttctcacctgaattgatcgaacaagaggagatacacacagcatgttaatgcacagggaagatgatgatcagaagagcaatggaagctagagctgcaagaattttgtgtgtgtaccctctcggcgaggctgtggctgtccgtcgcctcgccgcgccgggcgcggacatggatgtagtccttgggcggctcggggggcttcgacgagctgtccttcccttgcttcttgccgccgccattctcgctgttgctctgcgcggccttccccttgccggaattctcctcggcggccgcattgctctcctccgtcgatttgcaacgcttgccgctggaatcctcctgcagaacgctcgagagatgaaatctttcggtccaagaatggtgcggcgcggccatggcgagcggaattcggcgcgtaccttggcggcggaggtggacatggggctgtccttgcctttgcccttcccggaggccttccgcttccgtgcattgccgtcggaagcccccttgggcggaatctcggcgccgccgggcgccggatcagacaccgacgactcgtcccgggtgttcccgagctccatctccttcgatgcgccggccgcgccggcgtcagggaggccgaattgcgccgggccggcgccgccgtagcctcctcctccgccgccgccgcgggcgtcgaagccggagagcctcgcggcgcgctcggcgaagccagggtcggcgaggaactggtcgaggtggcccatgggcatcaggttctcgaggattggcaggcccccgcctccgcctccgccgccgcccacctgcggcggcgcggcgtagtggtggaactgccccatcatggacaggttgagcttggggggcgagctgagcggcgtcccgccaccgtagtgcggctgcggcgagatcccgtggagagcgcccgtcgagttggacgccggcgaggacaccatggagctgagcgccgggtcgaggtgccctcccgccgccgcgtccatggactggtcccagttgaggttgaggaagcacgacggcgccgtcgccggcggcaactggtcgggcggcccgcagttcatctcaaagatctgccgcaattctccacgaaacccaaccaaaccacccgaattcccgagctcccaagaacgccccaatccagcaaaagaaacgcgagaggcgagcagccaccaaatcccactacgacgggggtgagggaaggcgagcggagataaggtaaaggcaggagcttttcgtgtgcgtgacaaagcaaggaaaagtgggggaacagtaaaggagtggaaaagaagcacctaaaacaaagcaaaagctttgcaagccaaaaaaaaaaaaaacagagagagaggagagagctcgcaatcgcaagcagaagcagcagcaagtagagattgggagtgtgagcctacggggagtatgtatataggaccaggatggcatgggtcaaaatggatgggctcatgggcatcatcaccccagcctttcctgccatgaaagaaggaagaagctagagagagaggcactggagatggtagatggagtagtggtggtggtggtggtggtaggggtagtggtgctgagtttacttgcacaggcaagaggtgagtgaagagaggaagaggggaaaggggaatgaattgctgccttgctgctgactttattttgtgctgcaaaacaaaaacaaattaaaaaaatatatgttacttagtatttcctccatccaataatataatagtttttttaaagatataacgctgtccagattgataatactaaaatatatgacatccgactaaaatattttatgctttaggactgaaggagcactatactgggggtatatgcttttgcactaatctggagttctggatagagtaaattgtagctactcctagcatttaaattttatatcaaaatataagagtagctactctctacatctacctactcatctcgaatgactaaaaatcatattctattttatttctataccagcttctatatcttaaccaattacaatcattcatcatctaattttattatctccttaatcaccgtaaaatactttacaattatttatattttagaacggaaaaagtaaatctattctttttttacttagcgttatggacactgatagtctgacaaacatatctaatcattgcttttttctaattatatataaaccttatcaaaagtataacttatgaaagtactcttcataataaatatattaatgctattttcatatgaatcataatatttttaatctattaatgatataataatttgaggtttgaaggcatcgtcttttaagaatggagataataataatagttgtttttttgtgttttgttttctgatactggtagtatttttctaagtgataaggaggtgaatgactgaaggtgatggtcccgaagcaaaggggtgttgttcttttgctcatgaaattgagagatcaaccaatcattaaattggggtaggggaaggggacaaaggatgcttggtagtttgggttgtatcctactacctctagcccattgccaaaacatttaaacattttaaaacccttgttgatttttaatttgggggatacaacaacagcccattggatggaaacccgtgtgatttgtttttgtgctgcgagatttgttcgaggctgattggggttttcagccccttctgttcgatgatgtctgtgcctttagcctgacggtgaaatttgtattttttgtgttactatttggtatcccacataatttcttcagctagcttttctcatttgtgccccacttcgttttgtgttctttgaatgtattcttgcactctcttcagtgaacacaatatactattctctactatcttttaaataaagcttgagtcgattcaaaaattatgttttaatcgattcaatcaggaagtaaattctaccagttcagctagacttagccgacatagttgcataaacaagcatgcaaatggcatggaatgcggacagaaagggcaagagctttatgattggcccgcgagatttgttcaactcatctgctattgtaacatataaatacgtactatactgtagtatagtactgtatactactacactgatgagagcattgaaaccactcggcagccatagcagggcagcaggcttaccagttgctgctgctgctgctgcagctgccgtagaacacaatttattactagacctgaataatgcatttgagcaactagtacaaaacaaaattcatatactaaaactatcttgatgaaaatggagtaatagcttaattacactgttatgagtacgggggcagtaataaaatctgttcttcagaagtttcagacaggtggtactccgcagtacctactggactgagatttctttcacctgccaaacaacatctatctcgagaataacgctaatgctaatcaaagattaatcatcaagctcccctttttttcgtggaacgggaatacgggaacattagcccaaatttgtccggacagtttcaaagaggacaatttgtacaaacagtagagctgcctcttgcagtatacaagccaaacagtggcgatcaatgtgtaaaaatctctgccctattgcaaatgtgtcgtaccatttctgtttctgtttgcaagaggatgtgaaaacactttagaatcacagggttggcaaggtaagctgatcccctttgccttaaaatgataaaatctttatggacaagtcatccaagaaggaaaaggccaagtcattcatgcttgcttctggaacactcatagtagtttttctttctcctttagctttaataaattaaccctacttacatctttacatccaccaccctttcttgggttaaaagcgtgggcctttttactgctgcaatctgcaagtaggatggtttttgtaggagacaatatctcagtcattagtgctactcatctttccttgcaggcggtcctcaatgcaactaatgttttgcagaagcaaggtaaatagataatatcacaatgtaaatagtaccaaatttactactgtaattaccaacaaaatgctctccctgcaaataatctgaacccaaaaaggcatcaaatttctactacgaatagtccccatatgtagttgacttcctggtattcctgatttcttggcagctgtggaaggagccgaactctagtgtttttgactccgttctctctttagttcccgttgttattgattccatccactcagaaggccgtatatggtctgccgcggacatcgccgtttttggggatttgctgagagcttagtgtggcgccaccccccctccctcttgtttgttggagtagttttttttcttttcgtagtagtccatccttttttttttcttttcgcagttggttgttggagtggttttctccctcccggcataggcttgtctggccgagtgcattgtgtaacaaaatatctattcttctaatatattgacgtgcaattcttttgcgtgtttgaaaaaaattgcattagcaatttaggctctgatcggttaagtagaaaaatgaaaaaaaaacaatttgtttgattttgctgtcatcgtttgttcatgttttatcatccgagctaaaattcaactttagagttgattttaaggttttctttattaagagtttattttttcagtatcaacttttataaactcatacgtgcaagttttgagtttatgattgtttaggcccatttaatttataaggaaaatatgaggaattcggaggattttaatcctatggaagaaatttctatgaagacattaattagaaataaagcattgaattatacacccttcgtcccataatataaaaagttttagagttggacacggttattaagaaagtaggtagaagtgaatggtggagggttgtgattggatgagtagtggaggtaggtgggaaaagtgaatggtggagggttgcgattgcttgggaaaagaatgttggtgaagaagttattatatgttgggacaaatcctaaagattaaaagttgttaaattttgggatggagggagtattacttttctttaaaacactcttatagagatgttaattagataaaagtttttaagattatctctctcgttttatttatgtgtttgtattgtggcctaatcaaacggtaattcatatgttttcttttaagtctatctcttttatttgattcatgtgtttttcctgcgacttaatcatcaaacgacacttactgtgttttgcacttatattcctattaaaattttgtgccttttgtattattcaatcatgtgtttcaaaggagccctattagtttatcttttcacaagttatcagccacaacccaatcccaaaatattttagggctcttttggaacaaagggttttttaagaaattttggaggaattcaatcttataaaaaatttctacgtggttcattgatcaaaggaatattcgtaaaaaaatcctatgaaaatcttttggtttgactcaaaacataggcctatcttataatttatgtatttttactatgctccaaccaaacaagtattcatatggtttttctgtatttttttacagcctcatcttttcacttacgcttatgcttatcgaccaaaatttgaatttttaatcttaaattgaagctgattttaaggtttttttatcgaagtttattttttagcctttgcttttacatcgctaagaaaacgtatataaaagttttattcataaattatttttcgtttgcaaatatattgtttgacttatttcgcagataaaccaaacgatgcggctcttagtccataagatttcaagtgctacgacactctaactccttttcttttctttttctatttcagtgtttttaaaagttctgcgttttaaaggaggactaaaaagcaaaatttaagccggaccctcaatttgaggccaggataacaacgacgcgactggctttaatttgactcaccctgcagctcctagaattctgaaacgtgacacgcatcgtggcaatgcacacaattttctttcatggcagcgtggcaatctgtcaggaatgaactggagaaccctactccaaaacagttcttttttaaaaaaacaagaagttgaagaaattaactccaccgtctcaaccaatgatcaacgaaaccgtggacgcgctgcaaatatttttcccgggtgctgaaggaggacgcggcgtgcgtgcgtggattcgttggagggaaaggggtggggagcaagtgagcaacgctgtggccacacctaccgggagtgtaccagcgatgagcctgcaaaattaaaattttcgttttagttagtttagtagtaggacatgaacagtttcattgcacacggtttttattataattgtcaaactccccttctgcaccgtacaaatatttttgaaatttttgggggaaaggtgatggatggtcaatggccgacttgcatgagatctctcttgatgagccttggtggccagccttgtacgagtcacactaattataacatgttatcagccaccttacttcttgaatttttctcagccggccggccagctgttggaaattgtctctttaatttcttattaagagtttatgtgcacatgttataagtgaaccttttatatctagtttttttaaaaaaaaattctattgtcatttgtagtacttctacattctaacactactggagaactgatttttcgtcgtggtatctaaaatcacaaatatctcggctagattaagaaccggtactaagaatgttttagtaccggttctaaaagtccaagtccctagaaatatttttaataccggtggcggtactaacgatgactctagggttagttaaaaaataaaacatatatatcaaagttagatgtgtgtagtaagtgggatggtaacacacgtaagtgctgaggtgagagatattgagttttaatcctacatcccacatattattttgacttggtatgcatttttagtaccggatattttaacaggtaaccggtactaaagatcaagatctctagtctcgatttgcttgtcacagttattgatctctataaccggaatcaatggggtttccaaccggtgtaaaagatgagttctctactagtgtaacttttgatatctttatcttatccgatgataaaaaaaactaatcaccttagaaaacttattgtaattattcattggaagaacacagtgtaactagagtctagccaggcccctgccccctcttttggttgtaacgacagtttgttcactggtaattggctcaaaaggtttcatgcatatatcttgggaaagctttcatatgtacacggttaggttgtggcagtttgttatattattctggtctgatcatgaaagtttctttaacctgcaaattgagcttgactatgtgtaaaaatcctcaaatggggttgagaattttgcaactggtgcagaaagtgtaatgcatggaggtttgaagaagctctagttaattatcacacggttgattactgcaaagtgcaaacaccaccaaacagttgggcacctaaatgtttctttacagatggcccagcttattctaatcacaggcctcgggatcggtgctgacggtcacatgcttgttggtgaggaaaaacataaaaatatattagtgtactactgtagtatcacaaaagaaaaccatacatacagagagacaccaaacatctccctgtgcatggaaggactgcaaccagtgaacaggccagtctctcctggcccccttcttaagctccaaataattattcattaattaactaagctactactagtactagttaaacttttcacactttctctctcattcatggctcttcattaattaactaagctaatggcattaaaactttttacttgctgtactcttctctgtctgtgtcattcatggcctttttagtttaacctttgattggagtggagacgagaccacatacaaaaattcctttgtaccattgtttggtgtgtgtgctttgtaaaagccatgcgcacaaggttgaggaccataagatcacctctctgtaaagttctctctgttgatccaaagccggcacacaaagatttgcataagccaaaatgctgagtatcctgttttcaaaggaaatgctggttgcatcattgtttttaacaaaaaataatttcattcaccttacttttccatacttgttcatcacacaatctcatcaaacatataatgcatgttaaaagtcttttttagccattctgaacacgatctatttagaatggctagaaatctcatgtctctcgatctgaaggaattgcgtctaatctctgcctacctaaccacaacacgatagttaggatacgcgtacatatgcgcgcgcacgcgcgcaagccgtgccatgatcataagttgtttccacccaaggatgatctatagctgaagtaaggtaggagcacacgttttaagccacttacagcattggtttgggaccatctctactagcagtactcctcctcttccttctccacctagctagcagaggcagaagaggagggccagcctctttacattggctatagctgcaattgcatgtactgctgctgctactcatagcctgctcctttagttgcaagcaaagagctcaaggcagcagcaggaggtagttaccatctcctcggcaatcattggaacccgaaaaggccagcagaagaaaagaaaaaaaaaaggatgagatcgagcaactgcagctgactggtgaatgctcagcttgctcattagagtgagctacaagcaacaagcagcaagtcatcaaggggagagaaaacggcaagctgcgatcctgcaaagaagaatgaaaacgaccttgcttttttagcagatggttatcttggagttgatgccagctactgccagtacaatagtagtagtgtcactgttaatcttgtgtgattagtttaagggttagttatactatatgccttgttgagatctgacctgctgactcccctccatgcttctcattttctcagtggagtgattgctactactaatttattcagagatgtatagattttttgtgtaagctggagttaagatagcttttgatgccatctttctttcctgaaaacttggctttggtctccatccttggttggcccaatgctggtttccctcacattttgcctctccctgaattaactttgctgcattgcaacccagctgtgttcctgcgtgcgatggtgatgcatccagtgctgtttggtatgccaaccaaactcctgtgctcccaaaattgtttctcctgctttaacacattgccccaatgaatttaaggagagcaaaattataggcttgtgatctagccgcaaactttattacttgctatggctagtatataagattggtcgagctatcagttaatttggttgcatgcatatgtaaccggagttgcggcgcccattgtggtgtacctgatgctactgcaacaggccaagcagatatgtgtctgaaactctgaagtaaaggctcattcattctatagctttcttctagctgggacaggcaatagagttcataaattacacttgatcgtagcatacagtagctcttggacttggcagctatagaaccctagctggagcctgaaatttgcggagagattctctcatcccgtgtcaggcgccatttgataccgtcctgtcttttgctctgcaaaaagtcaagttagtacaatcttatcgggacaattgtgccatactttggtttaattgtaattgtaactttacctcttctttctttaggcttgtgattttgccctcatctttttaaccgaaacttcaatttatccttaattgctaagtcatcttcacagtattaattttaaagacaaaaataggaataaaaacacaattgatgtataaaagcacatgcaaatttgcaataatatgtaagactatacatgtctttccactataaaaaaaactctaaaattagcactgttaagatagcttcggtttaaaaagggaggacaaaatcacaaaccctgaaaaatggaagtgaaaatcacaattgcccccatatcttattactaatactacgtcgtactcccacatcactgtatttcgttctgtaggagtatttcctaaatgtacggtcagacacagctagtacagacgtacagtgtagtagtagcttgtaccagcagaggacgacatgttggcatgggcccacctgctagtgacaccaacagtgtgcacagtgaggctcaggatacagtagattctctcagtcacaggggggctgggtgagtggaaatgcatggcagtgcaattgcatatatttgcatgcatgcaattgaaggtacagctttttggggtccaaattcacccagcaatctgaaaagcagcttggaccatatcaatctgagccagccaaattgattgactccaccaaccactccccggtcttgtcactccagcttacgaaaaactttgtctcgaaaatgtgatgcaccagaaaccttagcgaagattttactgcctccgtcggtggctgttaccacacatgaaacatgtatggctattctatctaagatgttcttcaatacaaagtttacgaacttcacaaagccccgttgccacgcataaatttcacagaattttgcatgttgttaagtttaattcccttgagattctccaaaaaatatccttcattccaacaaggccagaaagaattctagaagtcgatcagagctctgctaaatgtgttaggaaacgataggcaaataaacgataaaaaacaatacatcaatcgtagaagacacgagatttaatgtgaaaaacccttccaaagcagaagagagaaaaccaggcgccagtcagcaaatatcttcactatatcggggtaaggttacagcgccgaacggtggtatacaagaagtatatatgaaagtgaaaccctaaaaggaagttagcctccggcgacggacctttgcttcgctccgtccaaagctggcctttatacgtgtgcaaatgaatttgaatcacaactcaacaaaatgctagggttcataatgcagggcattcaagcatgcaagtgtgtatacatttgcaacttggcagagcccaaacatgaaacattctcagaaatgcgtgcatgtccagttggaagagcagaaaaaataggaccaaaatgtgggggagatgatgcaatatccatgagaaaagaaaaaaaaaagccctagtgcatggagctatatcatcattgtgtgatcttggcaacgaatacgtacgatagctgcactccactagacaacttgcttatcctgcaaacaggtgaccatcctcgtgtagtagttatcacacttaagctctctatataatattcctcaaaaattggggggaaaaccaggggcggcaccgccatggatctcttctctacatgcactatgatatgcagaaacgtcacctgcttggtgtgagtacgttgcattgcattgtcgtcgtttgcattctccatctctcgctcgttttctggtccttcacaagtcaaaaatgtcgtcgtcattggcacattatcatttctgggtatccaaggaggttactgtactaaattggttcttcagtttggatacacagtcgatcgatcagctgatgatcgatcgatcgatcgagtttcatttcagggatgagacaatgcaattatcaggatactacatgggggtgaatttcaggggttctgaaattaagcacaactagctctcaagtttggatttgactttcactgtcaatcttaacttcttcggtgatcctacttgcagcagcactactgaacatgagccataatagcacaggtgacaattagtcattcttattataaaaaaaggagtccatagtggcttgtaatttccattggaaactattaatgatgtcatccatgacccatggagtaattatcttcagcaggtgatggcttcaacgatgttcttactatttcacttcagagctagagattagcagagcagcatgacagtgtgtaaagcctgatcttttgctaacccagtgcatggattaagaaattgatcatctccagttcagaagaaaaatatatatatttctctcgttgctgccttcctctctgtgcttgtgcagtgtctcatgtggggtccaaattaagaagatcatttgtccttcctggtggctatcaaactattgcgtgcatgcttcattggcaatttggcatattctacagttttgcttggaggcaatgttggagccttctatttaactatcatatctttttgaactgtagagatgcatttcatctactagtagtatatattaaggtccatatccatctccaaaagaaaaaaaaagaaacaagttcttcacaattttcacatgaatcctgatttggagagttaatgtaccaaatactgcttgcttgtagggcaccgaacttctgaatttgtctcgaactctgaataattaggacatagaggtcattgaccgtcggatgtctgtaattttcctgcggataattttggctgtcctaggttgctgaatgctgatgatgatgatatatggtatcctaggcaaacatttttatgttctatcatgatgatgaagcgactgccaaactgctgtttcgaaattctttagttagacaatctaggatgaacacgctccaatgttggatctagacatagtttttgtcgctcaggtaatgtgaaatgtggagatggaatttataggtttctggaattctgtccccaatgtatggggcattctgcatagtagttgcaggggctgcagg

SEQ ID NO: 64916 - DNA, 623 bp, Oryza sativa
attttacttctttctcaatttgatgctgagttcctagttagtatcacatattcttctttctaagaaaaaagaaacaagtaattccttagtttcgcctatgattaaatgccgggcaaaaatattttgattatctcttaatttcatactaagttcctagttattatcccacattcttcttctttcgaacaaaaaagaaacaagtgattcctctgatttgtcaagctggccaatgcataagaaacatgctagagtgtgtgcagcattcgctattagcctgccaattacacaaaacgctatcattcaccatgaatgaaatcaacatgatatattaccacccacatcacaaaatttatctggttgtggtggaaaaaatggaacccatggtagagtcatgcatcactccccaacttccggactttacatgctaacgacaacgaaaccaacacggcccaaagcccagcatcgccgaatcgagacggcacccaacgaacacccccaaccacacgaaaccctagcacgccgccacgcgccaacggaaccaggaggaggaggaggaggtaaggggaggcaggccttaccgtcgtcgagggggatgaggcactcgtaggagatctctaactgga

SEQ ID NO: 64917 - DNA, 18944 bp, Oryza sativa
acagtttcccgttttcttccctatatgtgctcagatagcaatctatctatctatctattctattatatactaaaaatccattaaacttcctataaacactctcaagccgccacgtggtcttctacaaacgcttctaagtcgccacgtggcactctactaaattagaaaaaatctaagaaaaaaaaaacatccatcactcaatttcacttaaaatttgtggacccatcattttcaaccattggatcaattaataaaataatcccaacaaactccacctctacctccgcgtacgtacgaatctccctcctgtacgtactcacgcatactccctctgtttcataatgtaagactttctagcattgcctacatacatatagatgttaatgaatctaaaaacatacatatgtctaaattcattaatatctaaatgaatatggacaatgctagaaagtcttacattatgaaacggaggaagtacaaaactacgcatggacagttcccttttctatctcttctttttctgcatcgtcctattttatatcaaacacttctatgaataactagatagttaaatgaacagaaactttaagcaatatctcctgtttttatttttaaaattgttttaaatttataattaaactaataatttgagattaatattgctcatattttgctatataggaaaatacgtagtttggacatagaaccctttctttgcatagcaaccaaacagcaataaaacatttaaattggtagaaattatatcttgttgtgaacattttacaagtctaaattagattgatagtatcgaagcagataaaaaaaataaattcaaccatgaataaatcaatataaaagaataacttgtctacgtaccatacttctacatttttgcatgttatccaagtttgcacttatgcaatccaagtggacatgaaaattatgaaaaatacaactccctccgtcccaaaatataacaacttttagtactcatgatttgtcccgaaatataacttcttcactaagggtgtgtttagttcacaccaaaattggaagtttggttgaaattagaacaaagtgacggaaaagttggaagtttgtgtataggaaagttttgatgtgttggaaaagttggaagtttgaagaaaaattttggaactaaactcggcccaacattcacttccaaaccaatcacaaccatccaccattcagttttctcacctacctccacttctcagccaataacatctctctatttaattccacctactttcttaataaccgtgtccagctctaaaacttcttatattctgggatggagagagtaaaatatggagtatattactatatactcattattagttcacaaatattcacggctaaattagatttattatgcgaacaagtaatatggcctatcttggtgctttacatgacattagagaattatgaaaaatcatgaaaaaaattaataacatggattatatcaccatatatatatatatatatatatatatgcttaaaaattaactaggatttttgatatgggtgatccaaattatacaattttttaaatactttaaatctaacatggttataactctaaattggtcaaatgtacatcataatatattaataatgaagttttttttctttttccaaaagtttcttttcacatatgtttatatgcattgggctagggttatttttggaccggaccaccccttgatctgcctgtctatatatgacaacttcgtaataataaattaccaacaaaagtgtacttgagtctgcaacacttaaacatttataaattttgtacatctaccaattatatttatttaattgtgctcttatttcaatttaaattcatttttcaaagaacatacgaaagcatataaaaaggatggagtaaaagtaaatagaagtctgcttttaattatatgaaatagtcttattaaccatatttttttaatagaaaatatcttcaagtaatacatcctaagatatgctaaatattccaaaaagatatacacatagtacgaatgttagtttcataggaactaactcaattgttctgacataatattttcttataaattcaagccggtacggttttaagtaattttagttcataattttatatgttgcaagggtaattagaagaaattaataatcaacatacaaattaattccaaacaaattattgataaagataaatttagaatagagttaacgaatattacaagaataagtcaaccacatgtaaccattcgtaataaaaatttcaagcaacattaaataaagcgcccgcgcatttgcgcgggttgccctcctagttaatatgaaatatttttgtgcacatggtataccttatgtcttgggcatagggatgcaaaagcgaaatttgatcatatattcttcttggatacgcaaagtgaaatttcgtataatcatcttagattgaattgtaagaatagtactccctccatccaaaatataaggcacaaccacccttaacccaaagaccaagaaataattattatcatcttgtagtttggatcattctaataaatacaatgcatgcatctaatagaattagaggatgtgagagtgaaggatttaaagaattaataatttaatggagaaaatatcatagttaattgtatgcatgcatgtatgtcttatattatggaacatatatataaaaaaaaagtggttggttgtgtcttgtattatggaatggagggagtatgtgtctagtaagatttttgacgaggtggagccgtggaggtgagagcaagaatgctttatatttttattctatatgtggataacctctcgtgttagtaacacttgagtctcctcacagcttctttcaaacatagaaatttcaccgaacttgtacgtaactacattaatcgaaaagcccccacaatctctttacttcaaaatagtcaattttcgatccaaatgaattgtaaacgatcgatctcgggctgaaaaaaatcttttgtcatagtaaaaatctaacgaaactgctacacatttatttgggacaaaatttgaaacattccgatcaacttgctcctcagttccagtttagacaagcttaagattctaagaattagttggctaatagctagtttttaaatatctggagaagttgggttttccaatttctaccatctaatttattttttagattttacaattctcaaaatctgataacaatttaaatggagttgcagttgctcccaaaacaggacctcacgtcctcagctagtccctgattcttcggaaaaggggagggatatttttccctccctccactccgcttgagcgccctccgttggtccgttgcttcccgagctcagaaatcggcggttcgagcttggcgtccttcccactaagtgcaaggtcaatagagagcccactgccatctccaattttctgtccagctcaggaagagctatcctatagcttatcaactacaatagattagctgtaaaatatcagagattaatgcattgaactatttaatgcatgcatggccattttgttgcaccacacatacacaatcacatcagagctagttaaatagaggattaataatcgaaacagtgaaacagttacgatgattcacaaatcttctggcaacatgccatcaaacaaaaggaccacagaaactagataaagttctttggtctgattagacattaataagccacacgaggcaactttttagggataacaaaataacagttaataaaaacatagatataaactgagatagttcttgatatccatggaccatcatcagccatcttgatttgttgccaccagcctgtagtggagagatggagcagaatataaattatgttatcagcagaacaatcacagtacaaatgcaatattaatgccagaaatctaactacttagtgatggtcaaatttctgccaattacagtaaacttttcctaaaactagaaaattagatgtgtctcattccaataaattttcttgaaagattgtcacagccgctacactatagtaacatagattctccaatcatatttttgaactgagatgtaaaaaaagatcaataatgccgctccttctccctcctcctcccacacccacaccaccatgcgcttcccgcgacccgctccacgctgcccctcgccggagccgcagcccgagcacgagccgaccaccaagccggcaccggcgcaccgcctccgcgcggtccaccctgccagccgccgcccgggacctcctcgccgacgaccccacgccccgcgccttctccgcgctcctcaaggccgcctcctcgtccgcctccccgcctcgacggccctcctccctgggcctgggcgcgcagctccacgcgcaggccgtcgtgcgcggcttcctcggcggcgacgacagcaccatcctggcgaccgccgtgctcagcttctacgcgtcgtgccgggagcccgacctcgcgcggaaggtgttcgacggaatgccgcgcaggaacgccgtcacctggaacgcgctcatcaaggggtacgcgcaggcggggcgcagggaggaggccattctgctgttccgagacatgaagagggagggcagccatgttgctccggacaggtatacgttcccggcgttgctttctggcatcggccgagagggtggctctggccgcacgctggagctcgggggagccctgcatgcgcatgtcatcaaagcagggctggagagagaccctttcgtgggggcttccctggtttccttgtatgcggctagaaggacattggaggatgcaaaggtcgcctttgatcaagtgggttcttccgatccaatcgtctggtcatccatgatctctgcgtatgtgaactgcgaggaggaagagggtgctctgttgattttcttcaatatgttgtgccaagacattaagccaactcagtttgtctactcgaccgtgttttctgtctgtggaagaatgggaatactggagatgggcaagcaagttcatgcccacagcctgaagagcaatactgaaaaggatgccgcaatgtttaacgcgcttttgaccatgtactcggattgcggatgcattaatgacgcacagaaagtattctcttcaaatgattgcgtgaatgtaatttcttacaattcaatgatttcagctcttggacagcacggatatccgaaagaagcacttgagcatttcaggcagatgaagtttgctggtcttatgcctgacgaggtaaccttgttaaatctgatctcttctttcaaccatgctggtcttgttcatgaaggcctgcagatgttcaattccatggtggatattgaaggcataaaaccaatgtatcaacattatgcctgtgttgttgacatgctggctcgatcaggagagattggcaaagccatgaaaacaatcaatgaaatgccctttgaagctgaagcaccgttatggaggattgttcttggtgcatgcagcaagcaccgtgacattgaaactggcaagcgcattgcagagatgctgtttgagatggaaccctatgaagccacaaattatatacttcttggtaatatttatgcaaggttaggaaggtggacagaagcagaaaaggttagaagtctgatgggtgagagaggtgtttataaggatgatgcatttagctggattgagatgggtcagagaacatatagatttggtgttgatgaccgatcacaccccatctccagagagatatataggaatttagatagattaataagtactatcaaggttgcaggctatgtgcctgatatcagttttgctgcacacaatatacaaagggatagaaaggaagaatcattgtattatcactgtgaaaaattggcatttgcttttggggacttggctgctccttctggaggcactctccgcatcatgaagaaccttcgtgtttgtggtgattgtcattgtgcgtacaaatacttctcccttgttacaggaagagaaataatattgagagacaatcaaaggtttcaccatttcaacagtggtttttgttcctgtggtgattactggtaatggatcaataagctattctgcaatttcgcatcctagcaatgatttaagagctctaatgacaccatatttgtttaggtatgtgttgagctttcacgcaaaacaaaatttccattcattacataggagcacaatataccttttttttttaccatgttcaatgcatgtcacataaaaatattaatgagtagagttgtaaatgatattcatgttgttttgctactttcattcgacatgtatgttccaaatttaggaaataacaaatcagtatatatttttagatcctgtagtaaagttcttaaagattcctcaaagatatgaaattctggtacttctacccagtacctttgctctctaaccatgctgtagaatgcttattttgggtccatttggataatgggatctgaggagtgggattgagatatggaaatgaatgaagggttcggaattagcatgaaatggggtggaagaatggatgactattgtcggtgacatgggaccgggagtatcatgactagaggcttgggcagccgcggtcacccacgtggcctgaccccctcgggggggtcgggcccgagggtgacatggccaccccttcctctgtctccccgaggggtcgggccgctcccgtttcggccccgagggctggggcgccccgaccccctgtggttttggcgccacgtgtatgggttaggtgagcccggcggggctcacctaaccgcatttattgcgggttggacgagcgcgccacgccgcatttaatgcaacgcagcgcgctcgtttatccggtccgtgaccggtcgcagtgtgtgaccggtcacagaccggtcagattgcgggttaggtggcagcaggcggcctgtcacacgcctcgccccgtcccgtcggaatgatgaatgcctccaggcacttgtccctagccggagccggcgtgctaactcctggagttagcacgccagtcccggccagatacgttctaggcttcatcgcaaccattgcaaggaagtcattgtatgaagagggacagacgtgcggcatgctaaactgacacgtggtggacaagaatgaccggtctgtgactggtctgacgccggtcacgtcatcggtagacaaactgtgctcccgcgttgcatccgttttcggcgaagtggaggtaggtatgacccatcccatcggaggggtcattcggacagcggccattgcaaatctccgcccattaatgaaggaatgacagggtgatcccctgtgtcaggcgagtgacagcgctggtccacactcaagaacaagctgtgttttagcttccaagcgaaggcgcgagccaagttttggtcaagatagggtgggtccccacccaaaagaaggggtaggtagaagtgttgcatgtggtatccccttgagatataaaaggaggaccttgcccactgaaaaggggggataaaaaaaaaagatcgtagcttggaggggggagagagaagatggtagctgggatcggagagaaagaagatcgtagcttgtagaggagagaaagaagaagagggtttctagagcctggactttctggttctccggctctctgtaaatccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagctccgtcatctggcgcgccaggtaggggtcgcgtgtgtctttctgagccctcaccctctttcgtgtgcgctaagcttctcccgcttagcccaatggctgaacgggcagtggcgcacaacccctctccgagcgctagcggtgacgacggggagcagaacccgcgccgtcgagctcgtactccaccgtccccctctcgcagaggtcttgggcgggaggaggcgcttgagggggtcgaaagatccgcgacttcgccgctcgcgggtgatggagaaggacggcgagacggggagcgtcgcctcctcgtctacggcgatggcagcacgccccagggcgcgctccaggccgcaggcgcgctcctgcgtcacccgcccgtcgtccctaatccagagactccagcccgacgttggctggatgacgtggccaacttggtcatgacggcgcagcagcgcctaggcgtcggcgggcggtcctccgccaacaaggcctctggcgctgctaccgccggctcagtgtcgtcgaggcggagggtgcggcgagcggcggccgttgcccgccgttcgttcgccattccctcgacaacgcctccgacccaagaagatgtgcgcgggaggccggatgcccgcctcaatatcgagcgccggcgcaatggttgtcgtgctgcccacgcaacggagggcgcttcctcgtccagagcgccacttcggtccgggcacgggggccagtcccccgtgtccccggttggcggtgccggctgtcgagccttcgtggcgagccttcgaaacgtccgttggcccccaaggttccggcccaccatcaccgaaaaatacgacggaagcgtcaaccccgctgagtttctccagatctacacgactgggatcgaggccgcagggggtgacgacagggtcatggcgaatttcttccccatggctctgaaaggtcaggcgcggggttggctaatgaacttgccacccgcgtcggtccactcttgggaggatttgtgccagcagttcactatgaacttccagggcacatatccacgcccaggtgaagaagcggacttgcatgcggtacagcgaagggacgatgagtctcttcgctcgtacattcagcggttctgtcaagtccgcaacactataccatgcatccccgcacacgcggtgatctacgcgttcagggggggcgtgcggcacaaccgcatgctcgagaagatcgcctccaaggagccccagaccaccgcggaggtttttcagctcgcggaccgtgtggctcgcaaggaggaggcctggacctggaactcccccggttccggtgtggcagcttcggccgcccccgggtccgccgctcggccagggcggcgggacaggaggaggaagaagaggtcggcctattccgacgacgagggtcacgtcctctccgtcgagggcgcttcgcgggccacccgaaaggggaagcctgcgagcgacaaaaagaaggaggcccgcgctcccagcagggaacgcccgtctggcaaatggtgttccgtgcacaacacctccctccacgacctcgcggactgccgcgcggtcaaaagtttggccgagcggacgaggaagtgggaggaggagaggaggcaggagcgccgtgagggcaaggccccggcggctcctgccggcaaccggcgaggtgaggccaagcagaaggccaccgccgaggacgttgatgatggcgacgatgacctggggttccaggagcccggggccaccgtcgccaccgtcgatgggggagcgtgcgctcacgtttctcgccggagcctcaaggccatgaagcgagagcttctggccacggcccctacccatgaggcgacgcagcgggcgcgatggtcggaggttgcccttaccttcgaccaaaccgaccacccgccgtgcgttgcccggggaggacagatcgcgatggtggtttcccccaccgtttgcaatgtgaagttggggcacgtcctcatagacggaggcgcagccctcaacatcctttcccccgcagcctttgacgccatcaaggccccggggatggtgctccggccgtcccagccgatcatcggtgtaacgccggggcacacttggccgctaggtcatatcgacctcccggtcactttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccccggtggccccatcaccgtccacggcgacctcaaagtcgcgcttgcttgtatggagcagcgcgcggaccacctcgccgcgacgtccaagcccgcgggtggcgacgagaggctcagcacctccgtcccagccaccccgaggcaacggatggtcacgtgcgacgaggtcccagtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaagaccggtccggcagaaagtgcggcggcaggccccggaacgtcaagccttcatccgcgaggaggtggcgcgacttctggaggccggattcatccgtgaagtcattcatccggagtggctggcgaacccggtcgtcgtccccaaggcgaacggcaagcttcggatgtgcatcgactacaccgacctcaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacgatgcctttcgggttaaagaatgcaggtcctacttttcaacgtactactcgaatttctttgggtagccagttaggacgcaatgttgaggcctatgttgatgacttggttgtgaagacgcacaaccaagagaccttactctcagacctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcgctacccctatttaagctcctcaaatgctccgggccgtttacctggacggaggaggctgagcaggccttcactcagttgaaggcgtacctcagttctcccccagtcctggtcgccccggagccagatgagccgttgctactctacctggcggcaaccccgcaggtggtcagcgcggcgttggtcgtggagcgcgacgaggacaaccctcactccgcgcatccccaccctgtgtcgactcaacccgggagtgagcagggaggagaggcccccgagccgaacggtggcccaaggcccccgacggccggagctggccctccgcccacttgtccgacggtaccaggcgcccccgacccccaggaaggccccggggccactgcgggaaggccgcacctgtcgtcctctgaccccgaggttaaccctgtgtcgacccgacccgggagagagcagggaggagaagcccccgagtcggacggtggcccaaggcccccaatggcccccgaaccgaacggcggcccgaggcccccgacggccggagctggtcctccgcccgcttgtccgacggcgccaggcgcccccgacccccaggatggccccggggccactgagggaaggctgcgcctgtcgccctccgaccccgaggtcatcggcacagaagccgagtgcgcggcctctcggacgaagagcgccccgttgatgcggcccctagcgaagaggatcggccccgccgaaaggtgcagcggcccgtctaatttgttagcgaggcccttcgggacgccaagacccgataccctcaggcccagaaaatgctttacgctattctgatggcttcgaggaagttgcgccattatttccaggcgcatcgggtcacagtggttacgtcttaccccctcggccaaatcttgcataaccgagagggtactggacgagtggtgaaatggacgagagggtacttgcactttgaaccacgccacgcgatcaagagccaggccctcgccgactttgtggcagagtggaccccagctcccgagcccgtctccgtccccgaggccagctcgggccccgagcagctgcctcacaccgcctactgggtgatgcagttcgacggctccctgtctcttcagggcgccggtgcgggggtcacgttgacctcgccgagcggagacgtcctcagatacttggttcgcctcgattttcgggcgaccaataatatggcggagtacgagggactccttgcgggactcagggtggcagctggactggggatccgccgcctcatggtgttaggcgactcccagctggtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcttcgcgagcccagaccctaccgggcgcctttgaagaaaggcttgcccagccgtcagcgcgacccgaccccctaggggagacggatgcgcctgaacggcccccgaggcccgtcggagtccaggcctcgggacccgaggggagcgctcccagctcccctagatcgattgcttggattgctgagatccaggtgtacctcacagataagactctacctgagaaccgcgaagggagtgaacgcatccagcgcatctccaagcgctacgtgctggtagaagggaccctctatcggcgcgcggctaacggagtcctcctgaaatgcattcctcgggaacaaggtgtcgagcttcttgccgatatccatgaaggtgagtgcggagcccactccgcctcacgcaccttggttggcaaggcctttctccagggtttctattggccgacggccctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggtttgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggccttaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggttctcccgtctgagctcaccctgaggtcccctcgggccaccatgtattgcgaggctgatcaagatcagcttcgcagagacgacctcgactacttggaagagcgaaggcggcgcgcggccctccgagccacgcgctaccagcagagcctgcggcgctaccatcagcgccacgtccgggcccgatcactctgcgtcgacgacctcgtcctacgccacgtccaaacgcgtgccggattgagcaagctctcaccaatgtgggagggtccgtatcgagtgatcggtgtcccccggccgggctccattcggctggccacgggcgacggcacagagctgcctaacccatggaacatcgaacaccttcgtcgcttctacccctagtgggggtcgggtgtcacgtctcgggctcgggccaaccccgcaccccccctcgggcgtgcagggttggccgggggctaccacacatgcatattcttatctttttttatcttccgtatttcaataaaagcattttcgatttcctaaggactgtgtctgtgctgttgtttccttttgaagaatcttgacttgaattagctcgcttgtgctcgatcctgccctcggtggcccgggccggttaaaatcgccaaaaggggcccagaaccgagccgtgccctgggacgtggtgaactccgggggggaatcggcaaaggcccacaatcgggccatccataaccctcggtcatcacgctcccggcctggccagtctcgacatgtggatctccccaggcactagccccgacccgcgccgtttgaggctgggacctgggcacgagcccttgttcaagccaagacacagaaggaccgcggcacagaccatccttgtctcatacgcacaacaaatagaattgacacagaaatttcctctttatctaattgcagattaaattagtctatacaggaaaggggcccgaaggcctcggaagaagaagaaaaagctatttaagataggcatgggcctgggggctcattccgacgcgcccgggtcgccggcctcatcgccgctgtcgcccgcaccgccgtcaccgccctcctcgtcggagtcgagggcgaacgcgagccggggggctgtaccctcgaagctgtggacgatgtggtcggcggcgtcccggacctgcgcgcgcgcgtcgtcctcagtcccgggagggaactcgtccagcgccgcccacggggagaagtccggatccctggcctggtagcttgccagtacgagctccactgccccccgggcgaggtccctcgaggatgacttgatcgtctcctcgagctcctcggggagccgctggagagtcccggccatctcagagaggcgctgggcgaggcccccctggttggcggggtacttcgcggtccgcccgcccagaggcccgcctgccgcccagcgcggtctagacgggagtcggcgtcccgaagcatgccgggccctacctcgcctgccaagcggagggcctcgacctccccggcggacgagtccagcgcgccctgtagatcggcgatggtgtgttcggcagctgcgaggcgagcggctaggtcgccgtcgcccgcggtcgccccgccgttgtgcgccctcgcgtccagctccttcgcccgcgcctcgagctcagcggcccgctgatccagtgcggccctctcggcgcgggcgccttccagattacggcgcgcctgctcctcccgcgctgcctcgcagagggacaggctgtccgccagccgttgcgccgcggcctcggcctcctcgagagctcgctcccgctcggtgagcgcgtcctcgcggaggcggagtgcggactcctcttcggcgcaggcggcctcgtgcgccgccaacgttgcctcccggatggcaacggcggcctcgcggtccgccaggtccctctccctcgcgcgggcgtgctcttccagcgccgtggcgcgagcctcaagggcctcttcgcgccgccgggacgctgcctcattctccgccgcccgacgttcccgggtagcggcggcgtcaaggattccccgggcggtgtcgagcttcttctctagctccgccgcccggctcctgtattggaggcggaggtcgtcccgcacctcgtcgagcacagcggtggcgatgagggcagtctcccgctcctcctccacctccctggcgatctccgccaggtccctccgacgggcctcgagctctgaggtatgccggcggtgagccttgcggcccgcctccaccatggcctccactgagcgccgcccctcttcaacgcgcgtccaagccgcgtcgagctccgcccgctccgcctgcaggatctccatctgggcacttagcccgtccagcaccgtgctgttcgcggtggctaaggcctgcagtaggggctccgcgctcagtggggcagtggaaggcaaaggggagagccgcctcggtgtgggtgccgcgcggctcggtccgccgatagacgtgccggactcgggggcggcctcgccccgaggccggctcgtcctgagcgccgcccgaggggtcgggcccgagcggtgcgcccgcggcctcgtcgtgggtggcctcggaagtcgtcgtcgcttcgggcggagtcgggtcgggggctcggtgggccgcctgacgtgcgtgcgccgtctccgcctcccggacggactcctcggcccagcgcggtctggcctcctcccgagtggcttcctcagcctggcgagcccggacagcctcctgggcaccctcctcggattcccggaggcggtccgcggcttctcgccggtcagcttcccgcctccgggtctccgcggtcgccgtctcctcggcctcagaccgaccggacttggaagggcgaagggggcgcgacgggatctcgctgaaacagaagaagaaccagaaggcaaaaagaagcgggtaagtgaaaacttgccttggggatgggagaatgaatacggccgcggtgggcgcgggaacgaacctgcagggaggtcggctaaacgaccaccttgggggagagatgaggtttccccggcatggttccgtctcccccatcttgcggagccgcttcttctttcgccccccctcgggctgcgacatcggcgcggcaccctccgggcgcctgctgctggcgcgcaccgccccgccccctcggggaggagatggggaaggggtaccctcctgcttcctcttcccccgggcgtcggcagggcggctgccccccggacccccgtcgcggggcccagaagcacgaccccctcccggggtagattgttcccccctgcggctcccgcctgcgccttcgtggcctcgaggagcccgctcctccgacgccccgaccgcctgcatgatggacaggatgctggcgcgatctggatcgctgcagagggggaggacaccttggggaataagggatgcctccacggagctgagattcagcacccgttggaccaccatcctcaggtcctcagggacccaatcccatttgtgcccctgatgggtcctcatgtagtcctcggacccggtgtactcccaggcgccccgggcgcgccgctggagcggcgcaatccggcgacgaaggtagtcgccgtacaccatggcccccgtcagcccctgggatcgcagacccgccaggcggtcaagaacggcgtcgtagccgtctcccagatctactggcgcccgccagctggaggcctgcgccgggggctggctcggaagtcggaggcgcacttcatcggcgaggggggtgtagaaccagtcgctcttccaatcgtcccacttcttgcggaggacgcagggaatgtagcggttcagcaccggcccccgcggctggaagtagcagccaccgactaccgacggcggcgacaccggctgtacggtgaagaaccaccggaacagccgaagagatgggcgcaccccgataaacatctcgcacaggtgcgcgaagatggccaacgtcattaccgcgttgggggtgaggtgcgccatctggagatcataaaactccagaacatccatgaagaaagaagagaatggcgggaccagtcctgccattgcgaaagagagaaagaagacggaccgctccgggtagtgtggcgccgggcgtccctcacccagcgcgaccacctcccggccggtggcagattccggcatgaatcggcgcggcagcccggcctgcctctcgctcacaatgcgggaaggcggcagcacgctaccgtcgagcggtgcggagccccgtgccataacaccggcggaggaggagcttgagaacgagtgagtgcggcaagggtagggcacaggaaacgaggagttagggcgtaagcggcgaaggcaagggggataatggcgagaggaaggaagcaaatatcttcctcggcgtctttatacccttgccaacgctatgcccggttcctcgcttcccgcgcccactatctcgccccctcgtttctcgcgcccacacctccactaatcccactcgctcgtttgcggcgcacgaggcggatgtgcggccgtggcagtcgagatgggacatatcgtgcgcgcgttaactacgctcgccgaccaaagcgccatcatcatatctccaggcgaaacgaaccggctcgtcccgattcgcgtgctactcgagtaatgtagcggtcttgaagagaccgctcattatagacagtcggttttccgttgccgatgtgcgcgatttgcgactgctgggttcctgcccgcctgtagagaccggccccacctgtcaccaggcctaaggagtggcgtcacgcccgagcgtttccctcgaggggggcgatcgccctggcataacgccgggggctactgtcggtgacatgggaccgggagtatcatgactagaggcttgggcagccgcggtcacccacgtggcctgaccccctcgggggggtcgggcccgagggtgacatggccaccccttcctctgtctccccgaggggtcgggccgctcccgtttcggccccgagggctggggcgccccgaccccctgtggttttggcgccacgtgtatgggttaggtgagcacggcggggctcacctaaccgcatttattgcgggttggacgagcgcgccacgccgcatttaatgcaacgcagcgcgctcgtttatccggtccgtgaccggtcgcagtgtgtgaccggtcacagaccggtcagattgcgggttaggtggcagcaggcggcctgtcacacgcctcgccccgt

SEQ ID NO: 64918 - DNA, 4750 bp, Oryza sativa
tcttattttatttatcattcccaggggaatttttcaagcgatcaacgtgataggctacaatggtgcagtcggggtgagtttatactgtgacagcatttctcgattatgagatgggaacagaaaacaatagtgcaatttgcacatttcaaaatctaaaaataatttaatttaagcaattgctaacatcttcaagccatatctaaaagaaatctcaagctttaatactagcacccacaatttatacgcataaatgtggtcttacggtaggaagtttaaatatggtccatggagttatgctaacctaaatctattgaccatttgttgaacgagcacaatcgcgggtgagtgcttgcgggatgtgtgtgagtgtaagagtgttgatgtaccatgtgtggatggacatttttctcataatggaaggaaaaaatattatgatgttttcagactggaacaagtttttcaatatatatatgaaatgttagctacaatgaggtacctggagagttcagagagtagttgtatcaccttaatgtaattaacttagattaataaatcgttaattatctaaagaaaacaacttttggcaactcctcaagttagtaccataaaatcgttctttcaaatacagtttcacttgctatatttattttgatagaaattgttagccccgtcggttgccctaaaaagaataagccaatgcgaaactttgaattttcaaacttaagttgattttaacatattttcattgtaatttatttttcaacattaactgttaagtcgctaagaacacatatataaacaatttacacataaattattttatatcgctaataagccgttacaacttatagttagcttttggacaaccaacgaggccatacataatactcttttattacaagattagtcctcagtttacataacaagatttataaaaaaataagcttaattttttttatggatcggggcagtgtttcatacctgggtccttattatacttcagatactagttgtacgactgaagggatacaattgtgttagttgcactagttccctctttcaatgctttcataattacatgaactatttccgtctttcagatattattcttcatgggtttcgccatgttcgtccttgagacgttgctgagcatatgggtcatgcaggtaagcgcacacacacgcattaattaactttgcctacatatataaacccagtgatataacttccttcaagacagaatgttaatcatgggaaaacctctgcttctacttgcagaaagtatattggtatttccgcgggaaagggaaggaggccgagatgaggcctgatgctgcagcaggcggctcacggttctgacgacatagcaaccctgaacctgaagctgcagctaaggatagacaagatcaagcttgaaattgttgtgaagttgtaagtggatttgttggattgttgtggacttgtggttgatggaagtgcaagaactgatgatgtacttatagatcagaattgtttcacttgtcactcacatagatattttgtttgctcaacttactttccttgtctgatagtctgaaactacagttcctagaaaagaaagtagaagcccaatctgtgccttgttcagatgctagctagtagtagctgctacagagaaaatctttcggcaagcatatactactccatccaaaaaaaaaaacatttctagcaacgaactatatccaggttcataggtaagatagtttttttttagggagggggtatgttgttgcatcacgcatatatatactttctgtctttcttgacatcatgtcgcaatccaatggaaagaacagatacggggaaggccgttctcgcaaaatttcagctatgaactcgcgaaatcttgcaacatggatgaaattttgcgaatatctagtaaagtgtgtaatgtagaaacgtacgcggtcgctgtcagggtgggtaagggggcggcaaagtgagagaaaaacattaggccgagtctgagtcgttgcaaggctgaggtgtttgacggcaacaaaaaaagtaaacacgacgggctgagcctgagcctgccaaatccacgcggagtccgctaaaatttttccactggttctagatgatcgccatcgatgatgcaacgaccaactgcttcctctgcggaatagctgaataaattcagagttcaggtccatctaggctgctgctgctgctcttcgtctttgctgacctcggcacaggcagagagagaagccaagaaaagggaaaagagaggaagaagagagggaagaggagaagggagacgcgcggtgatcggaggttgatccatggctggcaggtcgagatacgacaaccccttcgaggagggcggcggcgacgaggtcaaccctttcgcggtaagctcgccggcgagctcgccatgtttttttgtttccccgtcagaaaatattcagacccatcttccgttcctccttgattcctcgagttgctttacttgtatatatagatatgctttacttgtagcaaaattgattcggtgatcatgtctgcttcgaatttagttgcacccataaaaacagctcggcaaaacaaaccaaaaaaagaaaaaggagagagagaatatggttttatgagaaaaaaaaatagcaggaacacaagtgacaaaaaaaaaattgtttgtaccttgactggtatgtgcagagctgcctttgatttaggtcctgtctgggatttttaaggaactacggatgatctaaaagtgattctgtgtcctcttcatgtgttgcaattttgcaactagggactttatttccggattcgactgtggcttgctagttgcttgcgaaccctgtttcttgtgtcatgggagttttatcatttttttagataatatgggagttttttttaacatatatacaatcaactgcatgttgagctcacttcatatattaaggtttgtaattctaattcattttttaaaaattttacttttactggagagaagtgcatctgtccaaaaatgtagagttcctttgaattgagtgaaaatttgctcaaattcagcaaaaatattttcagaatttaaaaattttatgaaagttatttttggtttttcatcacctccaaaatcaattttgcatttcgaaatgtaaaaccctgtatatatttaataactctcacagcagaaacatatgtttgtgcaaatggcaagttaatttttttttcttgcaattcagtatttctgctttgatattaggcggaacgctgtttacaaaattaaaaaaagggactacaaacaaataattcttcaggcaccaatcgcaataatcttactgatttatcttgctcaatgctcatctatcaggataaagcttctaaaggaggatcagcaggtcaatccagctattccggaggcgcattctatacaacagtgagtttgcactacacagaattttacttacagaaattataaaacgatttatttgctggttgatcatctgtacgttgacgcaatcatcttgatgcagcaatacgccctagtgctccaccggccacccacctttcgcctcttcctcctgagccagctgacttctacaatgacttctcgaccccggtggatattccaatggacactagcaaggttactacactactctgaatgatgtgatgaaatgttatttgacatgattcccaaaagtaatttacctgcgtgttaaatatgcataatataggatatgaaaacaagggagaaggaacttcttgcaaaggaagccgagctaaacaggcgagagaaggtaacctgaacatgatgcagaacagtgttagctgcatgtacttccttgaatttcaattctttccaactatgttggcaaagttgttgtgccaagatggatttgattatgtgtaacatgctgattgtcgcttacgctgtataggaaatcaaaaggagagaggaggctgcagcacgaggtagagcttctgttttgttgtcatcatttttttctttcttgttgccctttgccttcatccctgtagatttgcactgctgatcttactagttttgcagctggtattgtgttggaagacaaaaactggcctccatttttccccatcatccataatgatattggcaatgagatacctgtccacctgcaaagaacacagtatgtcgcatttgcgtcactcttaggtacgtgtttctttgatttgtcaatcctccaatttgctatgatcacaacagcaggaaaaagaaaacagatcataccaaaattattgtttcgtactgtactactaaaatgtacctgagttcattgaaaaaggatttcgtacacaatatacaagagctcatttcctcttttctgttttgtaggattggtcctgtgcttgttttggaacatcatctgtgttacggctgcttggattaaaggggaaggtgtgcagataaaagtccctttttttctgaaatatcattttgtgaaactacactatacaatttgaggtgttgtacgcactcaactgtatataattagaacttatttatatttactccttgtttcttaatgcaggtcccaagatctggtttcttgctgtcatctatttcattcttggatgcccaggtgcctactatctgtggtaccgaccactttaccgtgccatgaggtaaatgaaatattactacttgtcacacattataatttgcattttttgggatcattttttgtgaggttttctgttgtttagttcgaactaa

SEQ ID NO: 64919 - DNA, 9355 bp, Oryza sativa
ttggtcaagatagggtgggtccccacccaaaaaaaggggtaggtagaagtgttgcatgtggtatccccttgagatataaaaggaggaccttgcccactgaaaaggggggatcaaaaaaaaaagatcgtagcttggagggggtagagagaagatggtagctgggatcggagagaaagaagatcgtagcttgtagaggagagaaagaagaagagggtttctagagcctggactttctggttctccggctctctataaatccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccctaagctccgtcaactatgattaaaagttactccttcatggattggaaattatttccatttcccattatccaaacaaggcctttaggttaatgatgttgggatcccacattgtttgtttgctcattatctatgcatttcctttcgctgtcaatagtaactagtcagtacttggtctatttggtcttttctcccccttttcaaaactttataaggggaagatgctaatcactcatggttttatttattcatcaaccatatgcttgatgcagtccccataaacatttctaaggtgacttgaatcattcctttcccatgcccttctaacagaaaataaccttctcatacaatattcaactgtttagtttatagtaactgtaacgtgccactgatctaaatggtccagaacccaagcagcacgaggccgcaccacaagggcaggggtaggagaaggggactaggataatagattaatttgcttctttcttcattccttcaaatgactgccgtacctctctttatatagggccggctcctaacatccttatatctaacaatgcctaccaactaactgccgcccataacagtaacacgataacccagactgcaaagtaaacaatatttaagacatttttaagttgacgtggaagataatttacaggctcacacaattatcagatgtatcatctggtgattaagttcctggaaactatcttctgcacagatgttgcgggcaaatctggaagcgggaaaaaaaaaggaaagtttgctatatacacaatgttagataaaattggttattgtttttcatgcatcattacacaggtatgaatcatctgtgcaaaaacaataacgcatgcgtgacatttggccatagaagactatgcacatgttaatcaacagacaacacaatcttgaagtatttttcaagcattgcatcctttgagaagtcagtgaagtaccccttttcaacctcaagtccttgctctgctgctatctgttccacctgctgctgaacctgatcggcactgacatgatctggatccaggaagcatgcaatctctgtgcagtcatcaccatgggaaagggcaagcgcttgcactgtcgggagtcctccaccacgaccagtcacccttcgggtgatccttcttatggttgggatatccttcgatagtaccggcacattatagttcaggggtaaaggtgcagcaccgatcattatggcacctctttcacgagaaacatgatctgggccctcatctggcttcaccggcagaatatcagggagtacctgacccatccattggatgcccatgtaatttggctggaagtagcccagttcacgccgtactgcagtcacaggtttgccagtggggtgtgctgctccatacaagaatactgggactgcatacagggagaatgaatgaatgatcagaagtttttgatactacatctgttatttaagtaaagtagttgaaaatttaacgaaccttgtaagaagttgccaatgtcagaggccacagtcttagccagttgagcagcatcttccattgtggcttgattcaaggggtggaaggacatgtcatcaatgactccaatccttgggtgagttccagtgtgcgtttcaaggtttatggttgaaaacgctttctcaatcatctccaacaatactcgcctcattgggctaaatttcacttcaccagttgagttctcgttgatgatataagacgcaagcgtgtaacggacacggttgtagtggtcatcttcgaacttgctgagcaaaacaacctcagggtctttctggccaatgcgagtgattgcatcaacaaccttggcattctggctttcagaaatgtagagcttgcagcagatcacctttgatttcaacatgctgagctttgcctttgccttttgcaagaggtggacaagaaggtgaggatggaatatttgcaaggtttcgttactgtacagttcaaatccaagtggagtataggcatccaatgcctacttgcataattgatcggtaatctgaccagaaactggctggttttacctgatttctttcagagcttcgaaaaaacagtaagtcatggcttttctcacatatttataaaaattatattgtgtttaaaaagcataatcctttgttggatcaacaggtattgaaaaaatgttgtttgcttatagcccctgcactggattgtttttacttagatgtatttcgtgttaccaacgttactcagaccagatatcaagaaagaaaatgtcatgaatgtctcagaagattttctttttttaactgaactatgaggttgatatagattgaaatatgggattttccacattgattgttctagcatttatccaagaagatagattttatcatcagggagtcaggactgtggagattaggttctggaaacataccttgtctgtgtgcttttgctcctccatgccttcttcagctctccctctccttccctccctcttcctctgtgtgcgtctgcggagtggtggagtggacctatgccttctctctctctctctctctctctctctctctctctctctctctctctggttctatgtgtgcagctgacccagctgttcctctgagaagcggtggagctatgccttcttatagaggtaagcgtcatgacaattacttgaaagaaagccttttgtccttttatttcttgttttcctctgagtaaataagtgccaaaccatgaaaaaagaaatgcagcatgtgctcatcagctttatgactcatcagtcccctgcatcttgtcccaggcggcaacttaaaagagttaaggtcagttccacttcagcatccccaccactccaaaccattactttgaagcacatggtaatatcttatttgcctcttaaaccgtgtcatccattaaatcccttggttcatcatccattaatctttgtattcttgtctcttgctctctggctcaaacctccctctttttttcattattcatgaaatcttgtctgttaccatctagtggccagtacaatgtcattgtccgcattgcagcacacagttttggtgaaaaccaaaataaatatctagaagagaggataattggtccgtgcatctcagatcatttcgattttgctgcatatgaaaatatcttgtggaatcaggctgcgacgcccagcttttgtacactagtctagcaatcaattcccatacagtgacatgtaagtgaaactagttggatcagtgtgtacatccatgcccatcctgcattctactcagattggaaggatagtgactcagagcaacccacaccccccctattattgcttgccaacattactaatagttgaattgttttcctctttcaggtcatggatgcatcttgcttgtcatcttatcaaaaagatcataatctggaaggctctgaactgaagtagttagttacaaaggtacgttacttagcctagactagctgtgtgcatcacaaaagcgtgaaggtgaagatgagtcgatgagatggaagttgtgattaacgaaagcaaaccacttgcacgaggctctgattgaaaatctgatctgtattaggcggtgcagtgacatgcatacgctactaatccgtttcgctccctttgtggataggactgacattgcagctagtggctgtgcgcgcgtacgtggggatcacgtgcatttgcattataaaaggcattgagatctggcacggaaggagcggtcgttttccacgttgccgcgtgctacactgattggagctcgtgattaatctgagacttgatacgattgtctggattaatgggtttacgttacttgaactggattattctatagtctatatgcaacgagagaggtggtttgtgtgttcactcaaattaatgagtcagctcatgtgaacttgcttttcacattaacaagcgacccgacgttgagaactgcgttttatttcacatcagtgtgctaagctgttattgttcatcatcttggcaatttgccattgacttgtttggttggttgcttaataggggcctaagcagaactttattccacttcccatcaaactattcggattgccattgatggaaaaactagtcactgcaactaaatatggagtagttatctattccttctgtttctttttaacttttttcttcattaaacttttttttaattttaatcaaacttgtagataaatttagtaccatgtataacaacaaaattagtagaactaacttttattaaaactaacttttaatatatttgattatgtctttgttttgtgttaaaaatgttgctatatattttataagcttaattaaacttcaaaaaattaattaggaaaaagttaaataatatataatatgaaagtagggagtacgtataaaataccctcaagtgagtccttaccgtatgtactgtagaaacactatatagcattaatctgtaagtgtggcgttgatcaagggtatcttcgttcctgccgcacctcaacatgagtagggcgcacgaaaaacggagcaatttattagcgcataattaattaagtattagcttttaaataaaaatagattaatatgattttttaaagtaactttcgtatacaaactgttttaaaaaaacacactatttaacggtttgaaaaacgtgcgagtggaaaacgagaggggagacttggaaccggctggaacaaacacagccatagcacaaagttatcctctattcctcgagatttacaccgtgtttagataaagtttttcttcaaacttccaacttttccatcacatcaaaattttccaatacacataaacttcaaacttttccatcacatcattccaatttcaaccaaacttccaatttcggcataaactaaacacagcccaaagtaggtcctctatttaaaactaacaaattgatcttgtatacacgtggctcgtcttaatgtacgcgcagaagtggcaactaagtgccaatattgaattttgagggtccaggactggaaccgtgtttaacaatatcagaatatccaaagcatgatcgatatggagtactgtattatactacatctttggctaatagtagtgaggcgtaccgcgtatgtatgtcccgtttttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccggggccgatccccagctgacgtggcagctacctcagcgccagccggactggcgctgaggtgggacttggccgcaaccccaaggcccagaccagcaagccttctggatggcttgcgggctgggacctcagcgccagccataatggcgctgacggtgggaaactcagcgccagccaacctggcgctgaggtggcacttggccgtttcggccgtggcccagcccagcaagccgtctggatggcttgcgggctaggacctcagcgccatccataatggcgctgaccgtgggacactcggtgggacttggccgtttcggccgtggcccagcccagcaagccttctggatggcttgcgggctgggacctcagcgccagccaaaatggcgctgaccgtgggacactcagcgccagcccacctggcgctgaggtgggacttggccgtttcggccgtggcccagcccagcaagccttctggatggcttgcgggctaggacctcagcgccagccataatggcgctgaccgtgggacactcagcgccagcccacctggcgctgaggtaggacttggccgtttcggccgtggcccagcccagcaagccttctggatggctgggctgggacctaagcgccaggtgcactggcgctgagtttggacatgtcagcgccattctgcatggcgctgacgtcccagccctgctaaactttagcaaaactttgcacacaacacaggcaaacatcaaatgacagaaatttacaggcagtaatatatccagagaaccatacaaaatatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtatgtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgtagcaacaaaaataaaacacattgaagcacagttagtactatatagtaagaaaccatcttcatctgtcatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaacagcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgcagggtgtctatcagaaattatacacacttctctattaggaccgatcaacttgtttctcaacatgttgatgaaccactcccagttgtatgtattctccttctctaccagagcaaaagccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcatggacttctcgggatgagcctcaacacggaaatgcatggtagggttctttgctttgatggcacgcatcagtgtaggcaaccgaacatacgcctcgtcccaatctccccaaatgac

SEQ ID NO: 64920 - DNA, 620 bp, Oryza sativa
agtcgtcgcggcttcgccgcagatccctgtcgacttgctcctttttctgttctgatgttaggttatttcaggaaggttgctttcgtagttcagttaactctcctttcttaaggatggctcttttgcttggatatgtaatggggtttattccctagatctgttcctgcttaataaagttgatgtgttttcaaaaaaaaaaaaataataaatctagggactattgcggtttgcttgggaatggcaaagtatgaatatataaacttattactataaaatcaaaagaaaatgatttataagattttatacaaccttacatacaagtagtagtaaccaggaagaaaaataggagaacatcaaggggtaatatttttcaatacagtcattttgccttcacagttcatgtaatattccccctggcctttgattttccatttaccattgatgagtaatggtaataaaaacgcatagaccagactgcattttgccaaatcttactttgaatttgcaggaacctaggcactcacagttcagagagtttctgagctttgactttgtgttaatgaattgctgtttttcctatatttgaaaagggagctgctatataccggtatcccgttggg

SEQ ID NO: 64921 - DNA, 686 bp, Oryza sativa
attttctaataagccaaataagccattttgggccaaatgggcaaccgatgagagccttcttatctcgatttagaggatgaattgatcccattatccaaaaaaaaaaagcttcacaagtatatatctccctccgtctcgtatcctaaaataactatgttttgggatggaggaagtatatccgtacacaaggcttaagcttcatgttcagtaaactgatcagtgcaagaaaacttcagaaagtgtgacatacattagtgccactggtgtgcacaaggaagaagaaatgatttgctactgttggagaagacctaagatctcaccatgatggcctgagctacttgtagaagtagaagtatactaaagcctttatgacctttgcattggccatctagtcggtctagtaataaaggtttggccatggtcggtgggcaaaggcaagtgcttgcacatcctgcatcattgttagatttactcctgttgtcagatggacatgcatcccctctcactccccatgatcatcatcacatcagatgatcagatcggattcagagctagcccaatcttcagggagacctgatatggccaagctagtcaaacagccaaagcatagtactccctccatccacaaatataaggatttcgttcacaagaacaatatttttttggtcatgcacgtcgattgccct

SEQ ID NO: 64922 - DNA, 692 bp, Oryza sativa
aatttttctaaaatcaaggtctacatgttaaaaatatccacatgtactgtttatgcttgtttttgtactgttttgttgatttttgtttaattgctttagtttccgacgttccggaggagagcgtttccgttgaggaaggctccgaagcgtttgcggaagcccaaggcaagtcacacagatcccaaacaactctttgagcatgttgaacccgtttaaagctattattttatttcaactatgcattgttttcgaatgtcatcgggtggtgaaccttcccaattaattaacggccgaagatgatcttattttcctatgggttataatttgattagcatgaaccttatatgttggattggttcagctaaatgctatatgtaagtttgcttagccgtgcttagaaacaatagctaactaaagggattaattataaactatgttacattattattttaattatggttacattaatggtagctcacgatggttgatcgtgtgaggttaattaattgataattaaaacctggttaaggtgggttgtgagcatatggtattgatggttgtgctcatgacaattaaggaccggttcgcgagctactgttgtgaaacttttaccgtgccaaccacaagccagcgtgggcaacggctttaccttttgtatagcatgattcattatggggtgccagactgagaag

SEQ ID NO: 64923 - DNA, 4212 bp, Oryza sativa
  unsure (1)..(4212): unsure at all n locations
cttgcttgtcaaaaaaactcattaacatttatttcttttcaaaaacacataacaatcactgaagcatggtaatggcgcactcaaattagaacacgaatgcacttcaagagagctgatttgaaactgaagaacaacagtggtggttcagacgatcagacagggattgagatccatctaacgtgaaatcagactaacggggatcttaggatctacatatcaataatcacgtcaggagtaatttcacgttagaggatctttttttatcagacagagcctgcagaacggaagagaacagcatgcccaagcaaacaaaacaactgtagaaagcgaagtgagcgtatctcaattattcagattttctgtggtgaaactaattcatccgggttcaagtcttaaacttaacacgagtgctcgcatttattgctaattatttcaactgtagaaaaaaacaattaaaaaaagaaacacaaggatgggttttgtggcaagtgaagcatgcactcatgaagttgcagtaaccgcacgacagaactccgatactcatcaggctagtacaacagcgactgcactcaaattattgcgatcctgttccaaacgcaacgcacactcccgtcccgtggaaaaaaaagaagagacgctgtaagcagcccacagagccaatgggcaactcgtggaataatcactggaatggatataggaggatgagaggagcagtagcagcagctgatgctgctgctcaagaaggtcaaaagaacaaagcttcacgcaccaaaccagaaccaattcaagggaaggcgtgcatttttcaaatcgaccgatcctatgtagagtcagtttcttcctttttgttctgctccaggaacaagtcagcaatttccagctatactagaaattatggcaaaaggagttgtatcaagttggctcactttgtactataagggactgaacaatgcttttttgacctgctaacccacagggatgtgaagcacacaccactacaccaccagtcaagattcagaaacagccagcacaggttgaaagcatgcacttctctgccttgcaaggaagccatctttgttctggtcaggaaagaacgattcaaaaatatctgtaaactttacttgttaaattgtaactcccatcgataactagcttgatttcttttggatcacacacacttgctaattgctatcgctgaatcaaaacaagtaactaggataccacgaacagaatcagcgcaaacatgtcactagtatgtaatttgaaaagaacctcccagttcccacattcatatttctacattccacgttaacaacaaagatggtggtatgacagcaatcaaattaaccaaatccccagtttaaaagagcaaaccatgtatacggttttgcacagaatatgccaagtaaaatgatcgcagttgttcatgtaaatgacagaattgaagcatgccaatgttaacataacaggggaaagatgttatttgaatagaggcctgagtctaatacacatgagcggtaacttgagacaagtttgtcccttcttgttccataaatatttatgtttcataaattccatgttcatgggcatccctgatgattgctcacaagcagcaaaaaaagaatggttttttacttccaaacagcacgaaaacagaaatattttaatatcaagtgactaggatgttttccagtgaactactccagttcaattcatgcgatatttgacagttcttcaatcaacactgctattactcctaatgcgaagatcaccacatgcaccagcacatatatgcaagtcacttgacaagtaacggaagaagcttttattaaaaaaaaagttttaccaattagttaattatcacagaatttagaattactgagagttacccatccaaaataagtttgcatgcagtcacgcaaaaaagaccccaagcctttcaaaagattatgatataaaaagggcagtggtacaccactatgttttttcactatagggcatttctaataaaagcttagtaataacncaggatagagaatgatattccattagtggtttactaaaaaggaatcaatgaaatgaatccgtcagagtttctgcggatcatcagtgatacgacaaacttatgagaaacaactaaactaaaacaataccaagcaaggtcagctctcagcccagacatgtttatacaaacaaaagtcacaactaggatgaaacatatcgttgttgctagtaaaaaacttcatgaaagacaagcacatcatgaagcaagtaaagttgataaaagaaaattataccagcaaacataaggcatggtgttcataattgatgaatatctttgttgcagccacatatgaatcgagtattgcttaacaggttgttcatcaatagtgaaaagccttctgaaagctgttcctagattattaatataacactgttttgcatagtctcgtatctttcaaatcacgagcagttgatccaaatgcaaatgttgaaatggattagcgaggaaaacagaagtattagaagaactcagggggttacatgactgctgccactcagcagatgcccagttgaatctgaaactggacagaaggcagaaatcgctacggagcatcaggactgaagcaattgaacaggctgcctttgtgcataccatccttcataaataatccaccatattgaatctttattcagtggattcaacagcccatcacagcacaattatacacgaagttcccagatggccgcctggcaatcaaattccacacaggcggccgctcatccggggtccatgaattaagctcaatcgtaccaccaatagaagtccttgggccgccgatgacaatcaaccgatcaccacatgctcggaaagcaaggccccacccattcattgacacagaccgttcaggcaacttaccaagagtgatccatttattgttttgcttgtcatacttcttcacatccttttcactataatcagcagcataaagctcattgttaacaacagcaataagtggaggagcaccagtcactccgttgagaccctcagacatgttttcgatcaccctccaagatcgcctcttcaggtcatattcctcaccgcatgtcaacaccttgttgttgctggcaacaccaccaaccacatagaacttgccatccatgaacaccccggagcacatcttccttgcccgattcatgctgggaaggggtgtccaagaatgtgtctccgagtcgtacatttctgcagagctcaatatcctgccagaagaatcagtgcccccagcaacatatgcctttgccccaacacttgttgacccaaacaagcaccgtggtgagatcatcggatcagcccgtgtccatgaattggttagaatgctatatctgaacacaatgtgtgccatcgcaaacacaagaagttcagtgcccacagcaagtgattccttgtcagaacacatgaagcattcatctggtggcatcttgggcacttggatccagcgctcgcgatatgggtcgtaagcgtcccactcgaggacgttacaggagaagtagacccagtgctctgccaccccactctggcgacgcaggcggtagatctccccgttgcgcacgagcgaccggaagtccttgttcagggaggccaccgagccatagtctgaccgtgacagccggaggaggcaattgatggtaaggtcacggccaatcgcaccaatgaggctgctcccgttgccatgctcctctccgccgccagaggcggcaacatggcgactggagccatggccctcagatatgtccggcgtgtgcggctgcggcgatggcggcttgctgcgcttcccgccgccgaagtcaacctcgtccatgtcctcggcttccgcatcctccggcgccgggcgcttgccgttgagcacctcgtgggagaggtacgcccactgggactccggctcgcaggagctcggcagggagcgcgagatgaggcaggagttgccttccagcatcatgccttctccctcgctcccgatttattcctctttcctcctgctcttctgagatttttgatacaaaaaaaaataaggaaagatctttcgctccctctctaatctccttgccgtgatctgcaggaatcgaatttataaaaggaggaaaaaaagggtaagcgaggatgaaatcgaccggtacaaatggatcaagaaccggaagaaaccgctgagatct

SEQ ID NO: 64924 - DNA, 7969 bp, Oryza sativa
tcttttcattcattagatggatgttaagacagctttcttaaacggagagctggaggaggagatctatatggatcaaccagacgggtatgtattaaaaggtcagaagggaatggtatgtaaactgttgaaatccttgtatggcctcaagcaagcacctaagcaatggcatgagaagtttgacaccacgcttacatctacaggctttgttgtgaacgaagctgacaaatgtgtgtactatcgctgtggtggggagaaagagtgatcttgtgcttatatgtcgatgacatattgatctttgggaccagccttaatgtgattgaggaggtcaaggactatttgtacaagagttttgaaatgaaggatttgggagaggctaatgttattcttaacatcaaactacaaagaggagatgagggtgggattacacttgtgcaatctcactatgtggacaaggttttgagtcgctttggatatagtgactgtaagccagctcctactccttgtgatcctagcgtgctattaaggaaaaaccgaagaatagtaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatggaattcactataccgggtattcaaaagtactagaagggtatattgactcaaactggatatctgatgctgatgagataaaagtcacaagtggatatgtgttcacacttggaggtggtgttgtttcctggaagtcttgcaagcagaccatcttaacaaggtcaacaatggaagcagaacttacagcactagatactgcgacagttgaggccgagtggcttcgtgaactcctgatggatttgccggtggttgaaaaaccagtgcgcgccagctatcctaatgaactatgataatcaaacggtgattattaaagtaaacagttcaaaggacaacatgaagtcatctaggcatatcaagagaagactgaaatctgtcagaaagcaaaaaaacttcggagtgatagcattggactatgtccaaacggctagaaatctggcagatcagtttaccaaggggctaccacgtaatgtgatagacagtgcatcaagggaaatgggcttgatacccacctaaggttgcacaatagtggaaacctgtccattgtgatcggagatcctgtgaatttggatggcgaaacaaactattgtgtgactgagagaagagacccttgaaaagggctcattttcatgatgtgctgcttcttttctttcctgcatggtaggatggctcatgccttaatgtgatccgagtggcttttccaagcagagctattgacttgcagaacatctcagaaggaacacacctatatgagttcgactgtagtcacagtctatgaggtttgggcgatctcaagatactcatgaaaggcctggagtttgacttatatgctccaaacagaggggatgcgaacggcagcccagtaccagtcaaggttctgagtgaaacctgatcacacaaaactgacaattcaaggcacagtccattgttcagttgtggtctgatgtagctcatttcctaggtggaagttcaactcaacagtctccaccaaaaccctggtatatcaaacagccacaacattgagaacatttcttatgagccttgaaatttggtggggattgttagaataattgggctaggcccaacttatcctattaaatctcaaaggcccataataagtgttaaggataataatactatctcaggatttaagtgaggaatatctcaacctaaatagggagttattggaggctccctgttgactggttgaggtgggggtcggaatgctacacgcgcgcgcgtgcgcgccgggctgaggccgagggcgtgggcgtgggcgagggcgaggcgaggcgtggctggctggcggcggcgtgcgtgcgtcacgtcgctattcttttgcagccactaacccacgttcccacgactctcttcacaacagcgcgtccacgttcccacgactgcctctctctcctgatagataaggaggccgcgagtccgatctattctgatcgcttgcttctttcccggtgttagttcctcctcctccgcgcctgtactgttctcgcttcctcgcttctgatctcttgcacgcacgagagattggaagtagcagtgcctccgaaaccacaccttcgcctgagatctacaccgggtaagcgggtgatcaggtttttggggagtacctcccgcacgactgctcgccatgtctggagttgccgccaccgctgctggaggagatggcggaggtggtgcgccgccgggagctggagccggaggtggtgcgctaggagctggagccgatggcgcgaacaacaacatcaatggaggcaattctgcctcacagtctagcggaggtccattctcggggtatatccttctcctgttcctgtttccactgttagcgctttactgctatgtgcgctatgttcctgttcctgatattcatgatgcctctagcatgttattgcgttattgtaatgttcctgttcttgacattcatgatgcgtatagtatgctactggttatattaagatcaccatacactgcttatgtcatgattattgctttaaagttttggattaaaatatgccgattcatgaccatatttccaacaattacaaccaccttccagccagaattcatttagaacctcagaccaggctttattggctaagctatgactaacctggttctgagcgtgatggatcttcctgacagagatttccctgtccccgtcaatgagcctccttatctccctgactaggtgcgcagaggccgacaggtctttttctcttgattgcagcatctgtgtcagcgttaaccaatctgtttccacttcaaaagggagcatagtccagtgaagcgctaatgcaattccttccacgcaggcaaggatctctgcctcaagcgccccattacagcgctccataaatctgcaggcagaaaagaccatggccccattgtcatctctcaggatcataccgattccccccgctcttccactggatcaaaagagccatcgatatttagcttcatctcgatctcctttttggtttctcccagtgtggtgcaggggccttcggagcttggtgacaaaccgaattactctctccgtcccaaaatatatatagcaaactttgtagtggatgggacacatcctagtacaacgaatctgaacaggggtacgtaatctctatgtaatccatccttagcttgatcgtcaagttctccattaattaacatctaagatgtccactttaaatgtgaacacaaatacgatcaaattcccagatttaagtaattatatatatatatatatataattctcaccgatatcaaaatatgttttagataagagggagttcagtttttgttgtagcttgcttacttgcggtgtgtgtaaattgtaatcggtcagctcttggctctgcgtaattggttgttgagtatgcgtgacctctccatttgatggttttgggcagcgacgatgcttcttaatttacacggcaatatatgatcaatgattacttcgtaaaggcagaggtgttggcggagtaatctgtgtcaacagctctaaatataagatagaaaaatacaatttattgcccctttttatctagtcggtataaaaatgagtaaacctcgctgaaaactattaaaaaaatatctttcacctatttaatagcgatattgacccgtatagatgataattctactttttctagagagttgttaacagtgaaatttggtaagcccctaagagagttatcacgtcgccaatagtcggattactgttatattcggttaaggaaattaatctgttaaagaaagcttatctaggagtcaccgagttcaagtaagatgcgacatgacagtttatctattaattaggcacaatttgttagtttcttttatctttagaaacgtgtgtttagtgtcctataaggactttatgctttccttttatcttttaggaaagtttctttcttgtcctacaaggactagtatgtccccatgggtataaatatgtacatccgggatcattgtaaactatctcttgatcaatactactctcggcgcatcgccaccctctattctgagggtttttacttatcaaccagtggaattaggcacctgacgcggggctgcatcggttcaaatcgatctccggcgaaggggtaagttctacgttccgccggcccaggcaattgtctcgtctatgtcggtgtcgttcaatgctgcatcagtgcattcaacctcttggatgctcctgtttggatgatatatttgtctgcctatttatcatatgtcttcgttaatctagtcttagtatctcaatttagctttattggttgtctctcgctttagggtttctgctggtatcggctaaattgttttactatattagattacttaaggcatctaccaccctgaaaaatcagtcaacggcttgattgtctagatattatgtttcttttcatacttagtgctgcatcagttaagtttatctgctaagtcatgtttagaaccataatacctagcctgctttttttactgccaataagggtttcatcggggtttcagccgacgagttatctagatgttgcttcggcttacaaggattgcatacaagttggatttagccgatggcaacaaagatttcattgtttaatataatcttgtggattttatgaatcggacctccagccgatgcatgctttaaccttcggatcagtgcttattctatcatatcattattaggcgattggtttctattggattatattgttgttatattttaccatcattagctgattgtctttatatcattatatacattggatatatagccggttgtttaaaaccctattgctatcagctggtatcggcatcggttagaattatcccatcggcttgtcagccgatcggctcattgatctgctatttttgtatcttgttagttgtaggatcaaactgactggcacgcctacacctcaccaacctttggtcctgcactggagctaagtagatctcccaggccagtgtgtgtttttcgcatcagcaagagtaaggaacaaagtagaaacagtgcacccgcatagccaatggcagcttgggggagctatggctcatggataggaaagattgacctttgttgtcgaaagacgcaacaattttccttaattaaaacactaaagtataatattgaatttcgaaactctgttcttacagcctaccccttcggaaattctttggtacttgattaattgctttgacggggaaatggggaccccccattcccatttcattgacaccgccgcccgccggatctgcactccaaaacactactagaaaaacattttcatagtcggccaaaacatggcttgaacattttttgacatacggctagtcgtgactatcgacgatccttaaatcatagtatatgaccatcaatacctacatataatagaataaaatatggtattcaactgagtggtagggtttattactaatcatttccactagcgttggtatatatttggatgcatgcaacaaacaactaaagttgagagggaataaacaagaagaaagaggagaaccaaacacatatccaaactaaaggtagttttggacccaaaagcccaattaaacacctccaaatgggcccaaccaccatgcccatggactaagggcctcaaaattagtgtccatgagggaaaacagggtcaacggagccatctcgggttcggccgaacctatttgtaggccgttgattgccaccttccacgtggacgctcctaatttcatcccaacgacggttggatggtagtttggtcatttcccatagctgtaaccatcatttggagcctataaaaggaggagctcactctcattcatcacacacaactttgagctgaattataagatgctctattgtatcttttgtatattagaatataggtacagagtgagtggaagctctcgaggaatgcccggaagtttggtgctttcttggacttctacctcgacgagtgtagctttgtaggaggaattcaggaggagtaccggagctcggtacactctgctatgggttcggagaaactttacttagtataagtgagatatatttccatctttgcgtgttcattgtttagtattcgttctaagtgctctattactaggactctggataaagaaggaagttcatgtgtaagtattagagtagtaattaagaacttaggcgtggtgtctaggtcagaaattacctatatttgttgtgtatcccatggatttgttagaggtagtaatcctccacgttaggatatatcatagagctatagccgaaaccacactggcagaacagcaggggtcggcgcccgaaacaacagataggaaattacctttaacttagcttagataattaaaatacatagaaagtcatctttagcctaactagcctacctatagttgttgtccttggatagtcttagctttagatagattacacaggtgtattcgatatccttttggggtcacccgaaggtgaagtgctacaacagtatttcgtgcgcttgcagatttatttgtggttgcaagaattaccaaaagcgacgactaaaagcgacgactgtaatttaagacgtaaagtgatatgcctaagaaaatgtttttagtgtctaaaaagaaatcctgcagattccaaaatatccccctacggtatatccaaattcccctaatccccttgacactcataatccattcacaaacttatcacaatcctcaaaatccattcaataaattcatcacaaaaagagatcaaagagtaaaatcacaggctagcaagtggatccgtgcttccgaggccggtgggtggtggatcaatgctcctgaggttagctagcctgactcgaagccgttggcagatccgcatgcttggggggtggggtgggggtgggtgtggaaaggcagcagtatctgtgcggaagggaagggggtgccggatccgcccctcgcgccgttgtcggcggtagggtgcctctcacccgagcctgcctccaccagagcccgagcccgctgttgcctcattgggtgaggaggtacttgcagcaaatctgcacccgtcaaggtcccccttgccagatctgccgcctccaacgagctccccgccgcctaatccactgccatggagcatcctgctgttggagtctgccagtcaaactctgttttatctagttagaccagtcatttgtaggcggtcacatcaggcctgtataggtgatcggactagacactaacgtagaggttactttccaaatttggcttaagcttgatattatcttgtccaagtgtcaaatttgctcatccacacgaagatgtagggagtgggtagcgggaaatggaggatggcttaggatggtctattctcgttctgttcctcctcccctctgtccctttaaaaccttctcctctctccctctctgatagatctaggaggaagaggagtaaggtcggtggtgtggacgcctctagattcagcctacgcaaggtcggggacggctagatccatcaaccatgaaactagggattcgtcaaccatgaaaccggtggcaacataagtcccatgatttttctcacctttttcttatctctctccactctataccttctcctttcatagatccaagcagaagatagaggagatctgcacgacaacggtctcgagtaggcggtagcagtctagggcggaatcttgctaagtagtgtcaaagagacattgggtgcataactgggtcgcgattcggttggacttgg

SEQ ID NO: 64925 - DNA, 1386 bp, Oryza sativa
ccgagaaaaatccccaccaccacaccacccaatctgcccccctccctctctctctctcctcctatcgatgagcgaggaggaaggaaggaaggatttatacctgtacagatagatggctctatctactgctgcccgcttctaatgcttctgcccctgctgctggctgcccctctctcctcctcacaccctctctctctctctcctctcttgtagtgcgctctgctctcctctcccctctcgtgtacttggggaattgggattctctcctctcttgcctttctttttttttctctctctctgtcttgccctttttattcctccattttttttcttctccttctctctgctgctgctgctctccgtctgttttggctcgttgaaattagaaaccgggcagggcctcagaaatagaaaaggcaagcggccaccggccagggccagctcacctgaagcttaggtggattctgtgcagcctccgctggctgtacagacacggcgtatgcgtctccatccatcgcctcccctcctttcttttcatctgcctgccttgctgattggcatggcagccccaatttcttgtattatgaaaaatgtttccttttttcttttcttgtctgtgtataagttcatttacacaaaatttatggaaagtgtacttataccggtgtgtaagtttgaccaaataaatgtagtgtttgtgtgaaaaaatggtttggaaaagatagtcgtcaattatgggttgcatggtttttttttctataaagttagtcgctttttaatggcttatagtagttttaaaggtgtatagatcctgtgaacctatctgtcccttaattctcatgactcaacctagtttaccctttctttttttgtctatacgctattttacattgcacctatatccggtagcatgtgtcagcagaatgtgccttcttcatcttgtctaagcctctagttgtttttgtcgtaccctcatgtatttttacttaccaataatcaatccatcgtgctattgctccgtgcagagagtatggtgtcatcgttgccgatcaaatgagaaaacaacaatgtaacaatatgcattgatacgaatttgtagataacaagccaaaatatcaatggctggagcgagtgtgtttgttcggaccacacctaaatctaactcctagtattggatgtagaatagatgcacacacacgtgtatggtgcagcatgatttagttacgtgttatcacccgtacgtatgtgaaagagtatacatttctatatcaatcaaaagctaggaaattgatgttcttttaagaaatcttaagataaccgccggatggaaattccatggaaaagactaaagaggagcacattttctatagatttttcttaatttgt

SEQ ID NO: 64926 - DNA, 721 bp, Oryza sativa
cggctcgggggccgatctggtcctccagtcccgtggaccggtggtgaaccacccgcgtggtcccggtccatggtggaccggcccccttaacctgcttccgagtgggcccgtgtgccggcgcccttcccctctcttcctagccactgaccagtgggacccgcctgtcggcgccgccccccctgagacgtcagccctggaaattatggcgcaataaattatataagggctttctgttatagtaataaacacagtgaatcttctaaaattcatatgtaattcatccgagctccgtttaagcccattcaagtcgcagtaaatcaagaaaaatgtgtaaaaaaaaaaaattttccccccccccaaaatttttttaaaaaacaaaaaaattggtttttgttctctgtttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttgggggtaccgagctcgaattcgccc

SEQ ID NO: 64927 - DNA, 4264 bp, Oryza sativa
cgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagtcctcaccatgaagaaaactgcagcggaaaataaaatctagcgaagcttcagctccactcccacaggcagcacaactgggatctaagccaaaggtcttctccttctggatcctttttcttcaactgaggtttgatgattattgcaagaatgagcatatgacatactcaacaagccacacagtatatatgcaagtgcataagaataccaaaggatggcataatatatggttcatttgtgaaagcagcatttagcaaagagttgagaatttgtaaaacagtagagtaattaatcatcaatattaatcagcactgaacagcacacccatgctgcataggcccaaccaaacctgaacaaccaaccctggtcgtacagatcaaacctccaaaccaggaattatccattccaaaccaggagtcaaattaattatcacattattatcattaatgagtagtgtgagactaatcacgaaaaatattgttagacccgcccataaccgcgggcacggctattcgaatagttttactctgaccagagatgtaccactgtacccacaagacacgattccacacatgttgccatgccctgaagtaccaccacggcactgcaaagggggaaatcgtgacagtactctttgcacaacacaactcaccacagcgcaccattcctggatcataatcaccccataaaaaaccagaggcatggactccccagtgacccccacggacttctcgccgcttcacagtctggcacaccataatgaatcatgctatacaaaagataaagccgttgcccacgctagcttgtggttggtacgattaatgtctcacaatagtagctcgcgaaccggtccttaattgtcatgagcacgaccttcaaaaccatgttctcacaacccaccattaatcatattttaattatcaattaattatcataacacgattgaccatcgtgagctaccattaaatataaccataaataataatgtagtatatataattcatcccattaatgagctaatgtttctaagcatggctaagcaattatatatatatagcatttagctgaaccaaaccaatatataaggttctagctaatcgaattataacccataggaaaataaagtcatcttcgaccattaattaattgggaaaggctcaccacccgatgacattcaaaaataatgcataagttgaaataaaacaatagctttaaacgggttcaacatgctcaaagggttgtttgggaactgtgtgacttgcctttgaaacaagcgtcttcaattcgtctttaggaacttctccaacgaacgaacgatcctccgaaacaacggaaaacaaaacctagaacgcaaaacgagaaaaaaacactaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctagggccaaacaacagattggattagattagattaaatccctagggataaactacaccggtaaacgacatgggagagaggagagctcaccggagaagacgacgacgacgaccaagacgacgacggcaaggggtgacggctagcggcagtggcgactagggcagcggcggctagggtgttggaggaggcggctaaacaggaggaggaggaggctaggggtggctgcaacacaaaaaaaaaggaaacaggaggggagaggacggcttatataggggaagattgaataggattaggtgggccaagggaggcccggcagagggggagagggagggactcggaggggagagggcagaggaggagcatggctgggagaggggggaggcgcacggctgggaggaggccgagagggggaggggaaaaagatacgggaggaggggttgcctagaaaggaaaggtgcgggaaacagatgtggtgccgttttgggaaaggaagaggaaacggaaccagaaagagaataggactcggctcgtcatacaaaacgaaatcgtggcggcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctgttgaagataacgttggtgcgaatgatcttggtcagaagttgcgtgacgtaaaggaggacggcaaaagtgaaaaggaggtgcagaaacttgagcgcatatcagtggaccacaaaatgtcgttgtacccaggatgcgatccggggcacaaaaagttgggtaccacgctaggcacaaaattagagcgtatgttaacggaccacaaaacgtcactgtaccacgctggaattctcgcaatggaataccaaaattggtgtgagtgacaaggcatttggcgagttattgaaactcataaagaacattcttcctgaaagaaacgaattgcacgaaacaacgtacgaagctaagaaggtagtctgccctctatgactagaagtatagaagaaacatgcatgttcgaacgattgtattctctatcgcggtgaggagtacgagaacctagaagaatgcccgttttgtaaagcactatgatacaagattagacaagatgatccaggtgatgtcgacggacagccttcgaagaagagagttgctgctaaggtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgag

SEQ ID NO: 64928 - DNA, 3143 bp, Oryza sativa
  unsure (1)..(3143): unsure at all n locations
tggtttaggaatgccttgctagcttatgcttgcgcggacggctgtcagtgcagatgttttgcaggttgcaattgcgtacttgtgttaggcttagatgattgcgctccttgttcggatgggtggagactggagaggcgaaggattttctggggatgatgcgaaggattttctgtttgtgaaatgctggtctaaatcaatgcgtatggctatccaagtgttaatatgcaaaaaaaaaaaagtaatcaggaaaaaataatatgccattgtggttttgttttttagaatacacaaggagtgcatatttgtattaagaggaataaaagttatttacaggagaaagaaaaacaagaaggggacgggatacagatggaaggaccgaaaaaaacactaaactaaacctattctcacaggattattgagcgacctagaggaagtaaggggttggacattcaacgccataatggggcttcggtggccattgccttcacaagctccggccacgatctttaactctgggaatgatgcatagtttgatcttaaactatataaaggctgtaatgcatagtttgatcttaactttccatcgttttcgttaatgaaagcgggagagatgcggcctctctttatcaaaaaataaataaataaataaaggttgtaatgcatattactgcatacatgatccattatgtaaagttcatggttgtttaagaaacctatttataagttataccatcaggtgtactgcgctnttagatgtaatgataagggtggggagtgaaggatacaggaaagcttcagactaacttcctttttcattagtaagagtgttgtgcctccagttagttgttccacgcacgtatctgatatcccacgtatttatttgatcattgaactccctgtcctcctcatactgcaacaaggattatcatttaactggaaatatagcatttgtactgttaagctataacggggactggtatacttttctatacaaatggaacttagatattctctcaagtcctatctagtaactagatccgtatatttaaaatctagaattatttttggctcttctaaatgatgaaaaagttaagcttcgaggcccatttgaaccttttgatttatgcaaaggcagttgctatctgtcttaatattggaaggatttccttgtggtgctttagatgctgcactatcaatttagttctatgctgattaataagctttaggtagacctaatttgagaaatatctattaatcttcaatctgcaatggtcttattgcattcgaaacttgttagttttgtttttgagggggaagggtaggagctctaccaatttcattaaggaggatagaaaagatacatgatcacctctcaaagggtccatcgaaacttgttagcgacctggaaatgaataaatactcctttgtcatcgttcagcaatgctgttgaacataaaagtcttgatacaggaaacatctttcccataaacaatgtaaagcttcattcactaattacccaatcattgggtatgaagcttctctgatttatgtttcgattttgtcacgggattttaccaggttctgtgtaaagttgattttgtttgcatgtcagcatccttcagtccaccatctactcataggttgcaactgttttccctgattgtttttcccgttttactgatgacaaatgtcttgcctacagagtccctttataaagtactacacttatgagtaccctgttggtagcatcttttctcttaccactgtctaattgtctataataaaaaacttcaatttttttgcacgttagtttcattgcacttttattagaggatacatgagatggtagaagcattttcttgttaaaattcttgccaattgccattattttgagtttccattacatggttacaattctcaatcagtaatcgcgcatcgggctgaaattttatgagacatcacatattgtgctacttttagtctatttacctagtaagaatcaacttaacaagatgaggctataagggtacctagctttgattgtttatgtgttcccttccctagcacgaaattctttgcaaaaccttaaattgctatgacagctttgttaaaattttaatgtagcaacgaagtgttgggtcttttgtgtctcgtcatatatttgttgaaaatctgagtttgtgctcatgttgttggagaaactatgttgtgttttataccctaaaagtccaaaaacccagggtagtttagtgcgagaagtatgttacagaagtcaattgtagtttatgtggtcaggtaacttgttgctattattaccatgaaaatagttattaacttcatttgacaatgctgattaaccattgcctgccgcttcctagatgaaacaatttgattggatgaaacatataaacaacaacatttagacgtgatatgcactcagcatgcatgaaatgttgtctgaagcttttggtgtcgacaagacgacaagtatacctccatgctttcccttaatctccactccctttccttgaattcccttcctgaagctatctcaacacattcaactcctattcagctttgctggaaacctatgtatttgctttcttgtctcacaaacactaaggcatgattatttactgcagagtgaagaaatttacaagcagtcaccttgctgccttgtaacactcgttactcttttttttctcatcattgacgcttggtcctgaatggcttcctccataagatggttactaatagctttggtctcaaataatttattttaacaactgtttaccaaccgtccaccctagtataatctagctttcaatgatgagcatgttggggttctgcagcaagatctggattcttttctttgttaattgaaataggtttattgtattccttgggctattggcaccaagaacgttgtcagaactttaattttaatattcatcagcaagtagccttggatttcccaaaagtggctgtatatttctcaaatgtgttgaactgaagacagctgaccttcagtatctccagatcagatgattcctcttgtgtcagagtaatacctgtcaattcctctgattaagatctcccgtagttatatggagagtggaagcttctttcactacagtatcgac

SEQ ID NO: 64929 - DNA, 5110 bp, Oryza sativa
tgcgtatgcccaagcacgcaagtggttaatgtcatgtggtatagtgcatctctttagtaaagtatcaggcgttgacatgaacacctgacggagcaagtagctagtctccttattctgtaaaaacgactcgactgacgagccgtggacttcatcttcatgtgcaagctgtgcattttatgtaatttgtggccgggcacgttttgtcaagtgcatgcctagttagatcaacgctagtcaactggcactgggtatctaaaaaaatacacaactggatgatcataaattacacctgaagttcaaatggggtcgcagagaaaggccaaacttcattgtctcgcaaaacatctcttctatgttatgttcagttctaagcaattctcttttgaaggaaagttccaagttccaagtaggctcactacttaaaaaaaaacatttttagaattaggtgggcaggccgccctaacaaaacggccgcaaaaaatgtagccatttccacatgcaggtgtgctaaccaagcaattgtgcaaatgttttccacgggtgaccagcttaaccaaactgcttgcagccttatggggctatctgcgcaggcgaaccacttaaacgtccacatgtgaaaacatgtatatttctataggtgatcactttaggctagtgaaatgcagaaaattcagttttatgagtggtcggtgaacagacatatctcttttgtcatgttgcacagacagttgcccttatggacaacatgtatagtcaatttttttagactttttttatttttaaattttattaatagactattccaaaaggtatttctgaaaactgaaccttttggccacatcagccgagtggctggcgtgtccaaacaatattgtgtgtggcgtgacagagttatttggctagtctggcgtggccaaaagattcagatttgaaaatactttttcgaatggtctattaataaaattaaaaaaaataaataagtctaaaaaaaattgtacagtccgagggggcatcaacgaaagtttgattttttttttcttatataatgcttataaatgattgggccaattcaattttaacttaaagtgatttgaagaagtttggggacacgatcttaccgcggtgtcaataactagagtaatgaacacaacccaaattaaaagaaaaaaaaactcccggaccagtaggctgagtttaaggagaaggggataaagaagattgggaagatacataaaacgaggtgagctactagtgcatgattaattgagtattaattattttaaatttcaaagatatattaatacgattttttaaagcaactttcctataatttttttttttgcaaaaaacacaccatttaggagtttgggaagcgtgcgcgtggaaatcgaaacaaacaaactcactttcacctctcctagaatgcagcaaaagcacaacttcaaaacatcatgtagcagtagagtatatgttcaatttaatttggaattacaatgcaagttttccggtaaaccattttaagcactcgagtggacgcccacctattttttgcatatcaattcaatggttatgaaaaaattttcaaattttttttgataagatagattaaatatgaaatatatcacttcacaaacatacaagtttaaatttaaattctacaagttttttagaaaataacaaatttaattatgagtatatacgtatactagttagagtttagtttgtcatttttattacaacttgtagaaattaaacttgcatatttgttgagtggtatatcacatatgaaactatgttgtaaattattttaaaaaactttttaataactatttagtcaatatgtaagaaacaggtagacataaacaacaagaagattaaattaggccctgtttagattccaacttttctcttcgaacttttagcgttttttagatcaaaggcttcacacctggctttactgagataaagcgtaacaaggtaacttctaacttttccgtcacatcgaactttaatacacacaaacttacagcctttttatcacatcgtttcaatttcaaactttcaattttaacgtggaactaaacacaaccttaatctccaagttttccaaccatcaggaggctctggctacatcatcatagtcatagatggaaaccagaaacaagctggaaacttcttcggtcaaacaggcgctaagctatacagtatattgcttatatgcaattgacgtgacgctcctactgtttggtcaaacaattaaatagatacatagttgcatgatgcatacttctttgcttggcaaaccgtaacaagtgtgaccacgtaaaatacgtacacggtcattgctagctgttctcgtgtgctgatttttttttccctttagaaacgaagcctgtgttaatctcatcacttgaagcattgcactataaataggctgtgttgatagaactcttcctgcaaattctcaacgtgaacgtacgcagtacgctctagcctctagcataacacacacattgacacacatagcacaagctgacagcaatccactgaacgattagcaacgtagtacacatacatacacgacatgaaaccgtcgcttcttctccttgctctgctcgccacgttcgtcgttgccattgccaatgccgatgactacaccactgccgcgccagcgccaagcccagaggcagaggcaagcccgccgtctccaccgacggaggccagcccgccgccgcttgcgccgccaccgtcggttacaagctctccaccaccgccggcggccggccctctgatgcctccgccaccgccaccgccgtcggtcacaagctctccaccaccaccaccactaccaccaccaccaccaccaccggcggccagccctccgcctccgccaccatcaccgccaccgccgtcgccggttaagagctctccaccgccaccgccggcgtggtcgcccgtgacgaacgtgaacgactacacgatccagcaggtggggaagttcgcggtgcagagctactgcctcaacactggggcgaagctggtgtacgtgaacgtggtgagcgggcagacgcagccgtgcagcggcggcggtagcaactaccagctggtgatcaacgtcgccgccggcgtgaggacggcgcagtacagcgtgttcgtctggggcatcctcgggacaaccacctggaagctctggtcgttcacgcccaagaactgatcgatcgatcatggcagctaggcacacgttgagtgtggccgtacgtaaacgtgcgcgtcaaactcaacaatgtgttggctgggctacgtcgtacttagagagatatgatgactgggtgtttgtattttgccttggttgttcatttgctggagtctggagtctctgtacgttttttgttcagcgtggagttgttcgtgtttacccgtaccctgcaatgctgcaacgattgggtggcaattttgttcatcgtctcaacggcgattgatgctgttttttgcgcgttcgttaaaaaagaggcgttttttttactgacgatcgatcattcgatcgagcgtgactgcgtgactgcgtgaggccgcgagtcgtgagtcgattcgagtttttaggcctcgtttggcatgggctaaatccggcccagcccatacatctgtcgtacgggaggcctgggcacttggatgggccggacttgagggccatcaaacgaggccttgagacaaacccaagtttggcgtgggcggagatgcggatcggcgtgaccttgcgcagtttcgcgggtccgttggatcgatggaatagcgcgatgttcggtgtgtacgggtatgttagacagagatccaacttctaaacttagttcagtaagtagtttagtctggattagaattgtagagcaatctaaatctagctttacctctctaatttattttgtaagagctcgttacctaacgggccgttctcattttaggtaaagctgtgataaacaagccttatacatactccactagattcatgggatcggggtgtgtgtctcatcacacacacatggctccaatagcgcagcagtgttcctatacacgaccacattcacacacaaaagatctatatatctcaatcaacctcatgcaaaggaaaacatcttactactactattatgttttctagaacttagcagtaggtcccctccgttttagtttataagacgttttaactttggttaaagtcaaactgtttcaagtttaactgagcttatagataaatatattaatatttataatactaaattagtttcattaaatcaataattgaatatattttcatctacctccgttttaggttataagattttctagtattgccagtattcatatagatgttaatgaatctaggcacacatatatgtctagattcattaatatatatatatatatgtaggcaacgctagaaagtcttataatataaaacgaaggaagtaataaatttgtcttgggttgaaaatgttactacttttttctataaacttggttaaacttttttaccaaagtcaaaatatcttataacctgaaacggagggagtaatagagccagtggtgtatccagaaataaataacagtgggtctgagtaaacagtcccctcctcccatttatatatgctaaaaattttagtggagttttcgtggggctctcataatcttcacgctgataatgggggctcgagacccgccaccccatactggatccgtccctgagtagagctgcttggtaggctgaaaactgcggctacgactgccactaggacgcagccttgtgtgtgtggcactattggtgctggctgcagcgcatcagcagaacaatctgttgaacaaccccagtactatgttagatctgtctgacttgctgagttgggcatgtttaactcgctgctcggtcaccgcggttcggtacttggcaatggcaaattggcaatgtatatataagcatccaattaatgcgagtacgtcgggtggtgcatcaaattttatcttgggctccaacttgtgcgtttgagtcttcgccgtcggcccttacccgcgtgcggacaaatgccggaccggactgtgcgtgtcaacgggcgttaatcca

SEQ ID NO: 64930 - DNA, 1707 bp, Oryza sativa
ctatgatacaagattagacaagatgatccaggtgatgtcgacggacagccttcgaagaagagagttgctgctaaagtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgagtactaaagaccattggttgaagttctgaaactgcgtgaaagaaataaggtgtcctcgtgcgggatgagttcaaacagaagcaatttaacctacgagcgttgctgttcgttaccattaacaacctatctggacagtcaaacaagggatataaggcttgcaccctgttgacggaaaacacagtggcctaggggatctgcctaactttagtgcaggtctaagacttgtatcgagtgtgctaagggcgtgtcagcttgtttcatcctgcaaccagcaaggaaaaaagaaacaaggtgagttagcggatagccgatcggccgataggctgatgacgtatcgttgatggtctcagccgatatggttagaccaaattggctatagactgagtagatcaaagaatataaaaccctacatatcgtctgcttagtttgataaaatagatttcagacgatatcatgagaatagccgatggaacaatttttagagaaagataggtaaataaagataatatactagctaatactctagtgcaaacttatataaacaaatcaatctatagcaatctatatttagactaattgggcactttctatgagctctcacgttaatcagaaatatctaactgttgattaggtagatagttttatcgtggccatcgatctaggctggataaaattattacggcttggagttgattgttaccgccgagataataacagataattaactaccataattagcgtgatgtgcggcatatatgcagcatagcacggcatattctgccgctagcaggcacgttgagcgttccatccccagcagcaatcaacgtgtactgcatcaaaatcacagtgcctttcatggatcgatgaaagcatgcatagattggcagggctattgctcacgtatgatattcctcatcactcgcatcccatacagcttgaagccatcctgatgcatgcagcgcacatgaaatttgtacaaaacaaatatgcacgcttttttccatctcatccttttttttatttcttttaattcttatgccatttcatccatgctcgagctcttaattaattatttgtagtgatgcaaaacaatgaaaatctaacaaatctgcagctttgtgtgcatgctattgattcactaaattgtactccctccgtcccaaaataaatgtagttttgcactagtcacattcaacgtttgaccgttcgtcttatttgaaatttttttatgattagtatttttattgctattagatgataaaacatgaatag

SEQ ID NO: 64931 - DNA, 7456 bp, Oryza sativa
tggtgataagagtgaatgataatatcaagtgatgcatcaggtgatagttgataccacattattaaaccaaggtaccgtttccagtcaattgatgaatctaccaacgcgccttgtacattaccagaaagcaactcatatatctttaacctgtcttcctgaatataatcaaaatccagaccatttgttttccatagatccagttgctgagaaaggtcagaacgatttagcattgacccacctgcctggcttagcaaaattgccagtcgaacatcacccctaaaggcagcaacttctgtggctgtgtctaattgccgaccagtcaaaagcagaataatatgttccagatacctggcatcatttaaggagcccgcctctccttgaacccgatgacaaacactgtcctgtaaccaattgctaaagtctgctcttctaaccaaagggagtgcttcaaggtctatggcaacagtaccttctttcttatctaaaatcatcccctcctggtcctcatcaccagtaggctctaactggttaccagttgctctttctgagaacaagacccgaataagctcccaaactgtaacctggtgcattaacagcacacgagaagacatagataaatcactgacttcaagctgcctttcaatgatgtcaatataagatctgcaaatatctggcaacacaaagcgacttgccacaaccttctgaagcttcaatttaaacaagtcagactcagtctccagatattcatgatgaagcctcctatggagatccagcgggtctgagaagcacagatcagtcagctcctccttaattttgttcttctcatcacgtacaactttgtcgcctgcaactttctctatgtgaataacagaagatagaccagttccgggtctattgacaagactgccagaatgtacaaggatgccatttggtccccaaccaacacgaaatgacctgcccataaataaagcagcatccacaacacaattggaatatacgttcccagccacaggagtttcctgatcagatggcaacttaaagccatcaccttggtcattctcactggaaatcccttgttttgcccagacataagaataccatgagaagatgggccatgttctgaagaatttacactgtattccagcagagcctgtggttctctcctaccaattacaccaggtctcctgctgactttcagagaagaaccatgcaaaggagagagagaccttagcctcaaacctttagcacttgagttcggtgaatccacattcatcttctcactgctgaagtatctctgatcagatgggaatccatcctccatatcttcatcaccttcctcattggagaacatcgtcatccgcatttcatgcatctttgcagggtcaagcccaagatgagcaggcaacgaacgtgaaagctccagctcatgaccatttgcaggtgggtctcttacttccgcaataggctgccgaacaaccacttcatccatcacaacatcctcttcttcctcgtccacaagacggaatcgactaaaatgatcaacctcgaacttccacctgccgctcgagtggttgaacgaaacgaacctagcgccttgctttctcgtttgacacttaagcaactccccaagagcgctaggctctggaagcacgctcaaattcagcatcaacgtcacttctgctggcttattaagaccttgccctaaaggcggcttgctagcctcatccttgtaaacctccacagagtgcctaccgaacttaacgatcccattcaggtccatccccctcacatcagtgtcaccggggaagtgaattcgcccatacccgaccctcccgacgacgaaatccgggaccctgctgcagtagccagggtcagccgcctccctctccaccagctcatcgatcgacggcttggtgaagtaatcgccatggcggagcacggggaacaccgggtcggaagacatggcaggccaatgaggcaaccgagacagaatcagcaagccctagcgccgccggacttcatagcttcatgcgcagccaagcccttcgctccaccaaaccactccagattcagattcttctcctcacttgggaaaccaactgctgcaaacaaaatcccccaacaaactgcagggggttcgagaggaggagagattcggattagatttgaacaaggggaatgaactgcgggtggatctccgcgcggagactgcgcagggggtcgggaggggaggagggctacgggaggagagcggttaccttcgagggcgaggaggttcgccggcggggaggacccgccgcagccgccgcgagggggaagaggaggaggcggcggcttgagcggagcggagcggcggccggcgaggaggaggagaggggggagctcgcactaaacccttcgcgaggatttctggggcatccgaattatcgtgaccgttggattgagtgatggagcatcatcctgccgttcatttcccactccagcatctcttcttacgctttcccaagtgatccgaaccaggggccaaagtgaaaagtatcagacctgtagtaccaacgggagcggtccaaataagtaataagggggtaaagcgaaaatttatggatcattgctaatggtagcgatcataatcacttaaccaggggctaaagtaaaaaaattacggagcttgatagtgtactgctttgatagcagtccaaataaaaggactaacgtgaaaaatgttgtggatcgcgtgttacaaatgcgatttagaaatggactagtttgagaacttccatgctgggggaattagcggctcaactcggcagcgccggcgagaaggtcagtctagatttattattacggttattattagtctttttgataaatttattttataaatagacctctaaaatattccatgaatataccatttttctcaacaccaaagcttattggcaccttggcgtcaatgacacttctaccgacactcttcctaccatggtagctaagttactgatgtaaataaggtttgtgtcaaagagactaacactgaaggcttatttgtaaaaggattcgaaaaaaggtttaaattttctccaacaaaagcatcggcatctttagcatcaaaggacctatatttattataaaaatattttataaataggtccttacacctctacatcttggctgctaggggagcaagggtgtcggcacccgcgcgttggcaccgatacgttggacctcgggggctagaaaattgtccattttcctagaataatttttctatggtctattgtaaaacaagttttcaaaaaaggtccacgtaaaaaatctaggtaggccgggcgttcgccaacgatccatttggcagacagcggcccatgcggaatcaagtcttggactcgggttgggagaactccagcgaggtaagaatattatgaaatgttcatcgttttcagaaatgtttaagacacattcgactgcagtctgcaaaaccatatcttggtgcacagcaagcatatatcttggtgcacaacaagcatacatttattagtttttcttttggatacacatgttgcccctaaggccaacactgcttacaatcacccatggccttctcactgttgcagaactgccacttttacaatgggaaagccacacctacatggtcctttccttccatcttattcttgggatttccacacctacatggttctgccaccgttacacaacacatcaactggaactggaagcatgtacatggaaagagttggctgggctaccggtagcatcatgacatgaatcttcttgcgttgaggatggcagacggctttggtattcagggtgcagctctcagagccctgacattgcatagtccatggcatccaccaggtaatctgcatgaaagtagaatttcctttagttactctatgggcaatgcagtaatggcaaagttttgtttgagacagttcatacgaacctgcatcatcccttgtaaagcacattggtggttttatcctgaagacattaccatgcagaccaccttttccaactaaaatgttgagatctggattacaaggatgaagaggcaaagtgttaacagggctttattagtataaactaataatgatgcgatcatggaaaagagaaaaggaataaggaaagcacccttgagtttctcaaacaataaattggtctcggccttggcaggtgtcttctccttcctatcggtaacaagctccaccccaagcatcaatcccctccctctaacatctccaatgactgacaacagaaagaccaaatgatgggattagacagattaatcaataataaatagttgagtgaaaatgttactcagatgaaaggcatcatcaactaaagcaacaatgttgaatcaagcagaatgtaaactggcgatgttgttatacaaatataaccaaagattgtagattttactttcatgcttttgctggagctcttttagacgattcaccaaatgagatccaacatcagcacaatgtgcctggcgtttctccttgtcaagaaccttgagcacagcaagtccaccaacggagcaaacagggtttccaccaaatgtgttaaattggattttttgcgccagcacatttgcaatctcgggtgttgttacaactgcccccaatggtagaccatttccaattccctacaaacaaaaaaaaaacatcagcaataaataatggcaacaaaattaaacctttgaggcttatttttccaaggtccattcaaatgtatgtgtgttgggtgaagacctttgccattgttacaatgtcaggaataacatcttgcgtctgaaatccccaatagtgacttccagttcgaccaaatccactctggacttcatcagctatacaaacaccaccagccttccggacagtgtcataagctaactttaaatatccaggagctagttcaactgcacctcccacgccctacattcatgttcatgtatcaacaagatcgccatatcagtaagttctttcagataaaaagctgaggaaagctacaatctttcgattatgtaaaaagtatcatataaaaaatcatacttggaaagtttcagcaatgaaacccgcaacccttccggaggtaccataatttatttgttcttcgacttccttggcataagctacagcatcagaaccgaaagttccacggtaaggatcagggttcatgacatgatgtatttcgccctgcaaatgttgggataagattttgcttcattttcatagataaagactagtttgctactacctccatttcaggttataagactttctagcattgcccacattcatatagatgttaatgaatctaggcacacatatatgtctagattcattaacatatatatgaatatggacaatgttagaaagtcttataatatgaaacggaggaagtactttgctatgtatagatagacagttcaaagtaaaaatcaatttgcgcaaatataaccggtggtttaaaatcagcattatgaagaacaaataaaagagggcatagatcgaaggaagttagctattcttgggtaacacaatgaactcggtaagtgtacagctgataaccatgcttattttgttatagacgtgtaacaccacctaaataaacttttttctctttaaatggatgtgtatagctcctgccattttactgcttcaaaaaaatataataacaacttaaagttaattcttttccagaaaaaataaatgaagttagcttaggtgctgtttgcttcgagagttttcttccacgatctgatcacgctattacttgtttgcttcgagtacaatgggatcaggtaccttgggaaacaatacggacctaatacaaactcattacctaccgcctgatatcaagcgttttctgaaaacattacagcgtaagtgatcttccgctcgaattcaaacaaagcatggtatcacttgctctgtttccattcacggtgtgatatttacatttgccttaccaagtttcaaccaaacagcaccttagatgacttgatgaaaaagagtaggaattgcacttatgcttcactattacttgtcggtactgtgataggaccattctcagctacagaccatcttaagctagagtgcattaattgaattgtagcagtagtactggtattattaacagaacacaaacctgagggattgggtacttccacgtctgcaaacccgtcaatcctattgttccagcactaccaccatgataagcatttctcaatgcaatcatattgagattcccactgtacagccgagccatcagcatcgccagttcattcgcttcagtcccagaattcacaaaatacaccacctgcaggcatcctcagatatgaaacaattatttccatgcaaatcaatgagttgttttacaatttacatcatgatcgacttcaaagtatctttgaccttgagatttcctggcatcttggacgcgagcgcttctgcaaactcgacgatgggttgattcaaatatatggtggtcgtgtgctggagcagcttggtctgctccaccacagcgttcacgatatccggatggcaatggccgcatgaaactgtcacgatgcctccgaagcaatcgaggtatctcttcccattctcatcgtacagatactgcatcttcccttccacaatgttcagctgtaaaatggacaaaaaaaaatgcattccattttaaaatgaaaaacagaaacacatgcctttcgccatgattcttactagtataacagttttttttttttttacgaaagagcatgtagcctagtgattgtagtgatttgagtagtacccaaggccctgagttcaaatttccatataaacaaatttcatatagggttgttttgcggggctaagttctatatttcaatagccgtatatatccagttgaatatagaggtttggtaaaaaataccctctctaaaaaaaagaacagattattttttagggcgtttaaacacattagtttattggtgaataaaaaaaaaagggggaatagatacgatcgaatcagggtttgtaccggcttctggtagtagtagaacacagacgatccaagaaactgcttcctcttcgcgaggatctcatcgccgctccacccggcgtacggcctgggccggtgctcgaacggcggcatcaccggcggcgaccgcgccggaaccttctccgccggcgccgcctccgacgacgacaccagcctccgcaacgcctcccccggaccccaccgtctcccggcgccgccggtggctccgcggcggagcagcagcgacgacgacgacaccgccatggatcaaatcacgcacggaccgattcttccaccaaaacaacaacagctcgcgatcgagagttggagccgtgcggattactgcggaattataatggattctgctactgtaggtcgggttggtgagattgagattggatgagaaggagac

SEQ ID NO: 64932 - DNA, 4782 bp, Oryza sativa
  unsure (1)..(4782): unsure at all n locations
agtagttcttgaagtaattttcaatcgaaactactcctttggatctccggtactttggagtacttcaggcaactttggagcttcacgtacagaatgcaggggttggttggccatgaatcattatcgtaaaatctcattctcatagtcagctggtttttttccctcttatgtttcacttctaccccaagggaattacagagtgatccaaggattaatccttttttttgaacgcttccaaggattaatcttgagtcaaatacaagtaattagatactacaggtaaaggagaggtaaacctgcgcactggaagccggattaaaccagggaacatatcttatgtgtataagtttgagcaattctacggtacttgaggagttaccatgagatatcaaaatttcagtgtaaaatttggtacctcatagtacctagataccaagagataccaaatttacaatagaaaaaatggtacctcctcaagaaccataaaattcgtataagttttgcatgcacacttcgtgcacattaagtagcaaatcttacgaaaatttctaaaaaaaaagacatttacttctaataatattacacattctgcaaagtcttatattcaaattcattatattttagccgtagaaaaaaaggaaaaataatttttcattttcttaaaaaaaataaaaaaaatcattttttatggctaaaatataatgaatttgaatataagatttcacacaaaagtgtaatatttttgaaagtttgtgtattttttttaaaaaaatctgtagtatttgtacgaagtgtgcacgaaaagtgtagtatttgtacgaagtgtgcacgaaaagtatgtgtgcatatgatatcttccattcaaccaaagcatgtgttcgacggcaaggtgccaaatttctgtactgccagtagctccggacgcgcatgcttgtcacctcagttgcataagctgttgccctgtcacgagatgcaacagttagctcggtcgttagctgttcaggcgctgttgggcttcgaggctgccgatgccgtgccaaagattgcagagttcgttagttaatcgatcgtccggcaagggcgcaaggcggcaacacgtccgcacgtcgtttcattttctccgaaaagtgagtgaggccacctcccggcccgtcccatcaccaaaacaaacaaaaattttggttgccgtgtttagttctaaaatattttttcaaacttttaacttttctatcgtatcaaaattttcctacacacataaatttctaactttttcgtcacatcgttccaatttcaaccaaacttttaattttgacgtgaactaaacacagtactgtacttccgaaacttttttaagcacaatttgattgccatttaaattccaatcaaaatttagtgtataattgatttgggataaaaagggtagaaagataccccaaggtagcgaggtccggctagaagccggcgacgaccatctccaggcacacgcgctgcagcaactttatcttgaagttggcggtgaaggaaaggaggtagaggtcccagagcaggtcgccgttggcattgcggcagccaaggcaccgagaccgctgactacttctgcttctactgcggtgacggagaagccattggggcgggcctaacgggaggggggggcatggagcctcagctgaacaactcccccaaatttcgttcaaagcaaactactattaagcccaaaagagaagctttcagatctaccagagaagctgagtttgaggcaaagaaaaaaaaggaacaacgaggaagaggatgctcgtacctgtgctcaccgacaacgaggcggtgggaacaacgtgcaaggacggtggcgctggtggctcgcgggaagcgggtgacgaagacctcggcgttgctcgacgcgggcagagatgaggaacttgtggggagtcgagacagagtcgaggcagagttgcctatggcagaggagagagggatacagaggtgagtgagtatgggagtggggattaattgatcccgtggcaacggaatcccgtgggttagtttttatgcacttaaatagtttaaaaaaattaagaagaagtattaatatccaatatatcattccacaaacaaacaacttaaaatttgatttctacaaataaaaacaaattaaactagagccagttaaagtatacccactcccatacacatacccgtcctggcctgtgtccaccgtgcgtgctgtgctacgagatccggccgtacgcacatctacccaacgatgcattctggccgggccaggctccctccccccctcggcgcgggccatgtcgtccgccggccgcggcaggcagcagcgcgcgggccagccgcggcgccggtgcgaggggactagatccgacaccgattagatgcccatgcccatgtccattgctcctcgccgcccacctcggtccgcccccggcaaccaacctggggcaacccaagccccggccgcgcgcgcatgcgtcgctcgctcacgcccgccgtacgccgacccacgcacgcgtcacggtcacgccgctcgttctcgtctctctctcggctgccgacttgcttggctcgtatacacgggccgtgtgtgtgccccaaagaacagcgcgtcgtactcgtacgacgtcctgcccatgtctcgcgctgccggggcagacggcagagacgaaggactgcacgacgcagcctgtcaaaaaaactcaaaaaggactcgtatcgtaagtacccctccgttccaaaataaatacattttcactgttcatgtgtaatgttaatggttcgtcttctttgaactgttactagataataaaatatgaatatgactatgttttttaaaaaatcataaaattttcaaataagacggatggtcaaatattggacacggatacccactactacatttattttagaacggaggtagtacgtgaaagatccctttctgatgatgcctgactgcatcaacccactgtacgacgaataatcttcatcagacttctgaagcagcatcgcgtaacaaaaaaaacgtaaatattaggaaatgacataatatcaaataattagaaagggtaaaactttaaacccaaatggtctagcataccatcttataaagctagaaaaaaaaacccttgagcgtttctcagcattgcctaaccatcttatcacgaagctgggactcggtacgtagttgttggttgttgccgcttcgctcggatcgaacagcgagcggctggggccttgcggcagcgaggccggccaggcccctaccaccaccactgccgttggcccagcgctgctgtcccggcaagcggatcgccggggaaccatcgatcgccatcacggatcagttgccaaaccgccggtgcagtgagcgggtagcggcaaaaaagtgaccaaactacagcgagctttcactggaacaccagggccacaccgtgcaacgcatgcaaactgcaaacagcgagactggccccccggcccccggatctgagcgcttcttactgccacgctcgattggtatcatcaaccgtgcatatatatatccactccgttgtgtcatacattcgtaggtgcaatcaaaaaattgtgagatgtacttaatagtgcagtattaatagatgtgtagtttcaatcctaaagtgttatgttcaatcccaacacatgtataatttcttcttaaaaaaatatttagagggatgtctctcagatttcgctatgtggataagttattatcggctgctccttggcttattagttgcgactaaaatttgaattttagcacttattttttaagtagatttttgaaaaaaaaatcatattatattttctagctttatttaaattataaataatattatatataaaaagttttacctataaattattttaaatgttttgttaatatttctacagcttctcacttcacctatcagacactataggtatgtttggctacctcagaggctatcaaacaactgcccacgttttaagttgagatacaatgcaaacgcacatatttatcttgcgtatttacattaacaaattctaacaaacactgatatttcgcacagttcacgaatttaatttgggcccttgttagcacagcaggggtcgttttcgctgcaccttgtaactagcagggggtagctcgtcgatcccctgcatctgttgacctgaaagagacgagacaggcgaagcacgtttctagggcgccccggacacacctccttgtaacgtgggcaccgtcctgccccttgctacctgctgcaaagcccttcacgtcgcagacagaaagtttgtttcctcctcaaatcgctcctaaactatatccatcccttgttaatccagcaggcacacatttctgacggattctagttcccagctctgctttccatagccccttccagggttttggaactcatcaatagaaacacacacacacacctctttgaagtcttgatgactgaccgggctaacaaagccggttgctttcttgatctccgtcttctcaggcccaaaacttattttcggattagaatggttttttatatttaaactgtgcacgttctccagcacagttcttggactgtgcgtgcgtgagccatttcctaagtgtgcggtttaacttttattttagtatctgccaaggtcttgataaatgcgagagttaatcctgatgatccattangataatcgccatgctggatggaggattttggatgtatctgtacagtacagcccctgagattttgactatatgtacatatatatcct

SEQ ID NO: 64933 - DNA, 686 bp, Oryza sativa
gggcgaattcgagctcggtacccctcatcgagcccgtgggacgatgattcagatcgcatcttaacagcaacctcggtattgtcttctaaacagccgtaatagacatttccaaagcctgcatgcccaattaaacatttgaagctatcagtgaacttcgctagttcctcatatgtgaatcgacgattctcaggtttttgtagatggtcccaatgatttgtccaatgtcctggaggacttatctgttctggtaccgtgggagaatcatctgtagaaactggtggagaaagaacatgtttagcagtattaaatgcagatattaaacaatgtgtttttcaaatgcccaaagggaaattttttaaattttttaaggggttttaaaaattttttacacacaatggggctttcttttggctctccagatcaaatatgctacaacaagcatggcgactacaagcactggagccgctacataaacagctaaggtagctgctctgtttcttgaggacgaagttattggttttttgcacatatctccgtagactcgtagctggaattacataaaacaataagtccatggttttaaattggtatgctcgccaaataaaaatctacaccaaaattaaagcacatcaatggggggaattaaaagtgatattagcagagtaattcccattaggaaggggcaa

SEQ ID NO: 64934 - DNA, 700 bp, Oryza sativa
  unsure (1)..(700): unsure at all n locations
atatagtttcataatttaatttatatgagttaaaccactgtaaataatattagttttgtaaatgatcaatccatgtcgtcaacaaactattggatagaatcgatattgatatcatcatcaaggacttcgtatctaaaaatatccgaaaaattttaagctaacaggttacaatgtttttatatattataatttatagacgcaatttcaatgttatcggcaatagcttgttgctgtgaaaactctggatcgaccctgtttagagctatggataaagattactccgccaacacctctgcctttacgaaagtaatcaattttttcccaaattttccaaaaatttttttggggggcccccccccccggggtgtaaattaagatgtatcgtcgctgcacaaaaccatcaaatggagaggtcacgcatactcaacaaccaattacgcatatccatcaggcaagagctgaccgattacacacacccaagtaagcaagctacaacaaaagataaactcactcttactaaaacatattttgatatccatgagaattatatatatagtacttaaatctgggactttggtcttgtgttcacatgtaaactggacatcttagatgttaattaacaaagagctngatgatcaagctaaggatggattacacaaagatgatgcctgattatctatacttattttggagttcacca

SEQ ID NO: 64935 - DNA, 669 bp, Oryza sativa
  unsure (1)..(669): unsure at all n locations
aacactgaactcttgtctcttgtgctttagagaagtggcaaagtccgaccaagaaggtggcaatttggcaataatgccacccgccacaaacttgtccggcaactaacagttgttgttctcaagttccttagctagcatctgaatctcatgagcttgttctactacagaacggtcatcgaccatcttgtagtcatagaactgctccatgacatacagctcactgccggcgttagaaactccgaacttggcctcaagtgcatcccacatgtccttcccagaaaggggccaattttggttttgggcccaaaaattttgggggttttttaaaacccccacgtccactatattgtcagcgagtacactgatcaatgctccacggaacagacaatccgatgcctcgaacttagcctcttcctcaggagaaagaggtggttcacttcatttgccacgtgaaacatagaagcactgcatcgctgtcaaccacatagtgcacgggctttncatctcttatagttagaaccatcaaaagcatgtggtttcagtgcagcagcaaagccaactaccgaaaatgacctatcaggtttttggattgttggaaatatggtcaagaatcggcatattttaatccaaaatgttaaagcaatatcatggcataagcagtgtaggttg

SEQ ID NO: 64936 - DNA, 1580 bp, Oryza sativa
gtcacatgagcaaatcaagcgattagatcacgagatatcagagacaagagagtgacactgttcatgtagtggcatatcagtttgctgaatattctctcctgtcatgaaattaataaaaaaacaacatgagctaggagctatagtgccattgatttggcaccatcagacgcctctaatcaagcctagcacaatccatatgtactgaaattttgtcagcttaaatatactaatgaactgaccagatgtctgctagtctagtactccattttgcattttcaacagcttggagatcttgtagcaattgacactttgcagggccccatgtctgtgactttccatggtctaatttaatttgtgaagccccagggccgagccaaaaactttgaccctctaggtattagggcctagtacatttgatcccaataacctgcttaatcaatcaacctctcttttatagaacgtgttgccccttttcggagtcctaagccacgttgcaattttactattgccgacttcgtctccttcgatatccctgctcactttacaattttacatcgatctgttcttggatgcatcgaagaactcgagctgtgtacttccactacgttatgtgcgcacgtacgcgcgcacgagaggttttaattttttaaaaaaaaaattttgcagattgctttggccttagtagcagtttgtcggtttgatcattaattaccgtgcaaatatatttccaagttgtctgaatttttctattgccagaaacgaaaaacagatcaacaacatcaaattaattaattgttcacaaagtagtgtggtgtttaattatccgaattggttgtgcgtactcgttaagattgtcctttggatcaaaggcaaaaggcaatgcaatcaatccacaaaacaagtaaacaaacacctctagatgcatctctgaagcttatcaaagcagcttaagtacagtagtagtacgtctacaagctaaattaagtagctaatctagctactaataactctactagcagctaatagaaatccacatatatcgatctctattagccctggtccagtacataccaaacaagacaaccctttttcttctcctaaacaatgcaggggccttcggtgattacctgagaaacaaacacttttcccttttcaggagagatcgaagaaagaaccaaagaagagcaaaaaattcttgtcgtctccctcctcaatcgctagctagcaagctcgtcctccatcaatcgtcgtcgtcgctgcagctactgatagagctaggatcgatcaccggagaaggctccggatgatctcggcctgcgggctgttgttgtccatcgtcgacatgagctccgacagccggtcggacaggtcgtccacctcccggtgcaggctcttgatgtagctgcacgtctccttgagcagcttcgacgccgacgactgcatcatccaatatatttctcgtcaagatcacaaccaaaattaccaaaccgaatgtctgaataatcctagtatcctgtcagactctgctagctatagctagctaatctgcattgacgaatcgtgctgcgtgtagtgtacta

SEQ ID NO: 64937 - DNA, 751 bp, Oryza sativa
cctgcagcccctactacagtagtactgctagtcaaaggtgacaagatcactgctcatttagatctcatctacactgcagagttgggacttgggaggaaaggaggaatgcttggacgatgcatggcaattgtcagctgcctcctctgtgggggctggctatggttggcctgcaaatcgaccaatctttgatgtagcgtgatcttgcggggatcaaacgaaacgaccaatttgatggcggtgtgcagcgtggtggtccttggtttccccggtgctggatctttcgtttctagcttctacttgatctttacaactagctacgaagatgacatctgtggagccctctcctactcggaggtagaagaagattcgtgtcaatttcctgtattttcgggctttaacgccaccctctcagatctgaattctgacgattcgtgtcaaatggaagtcctttatgtgagaagaagatttgttcaggacatgcctttgattctgtttgaaaaaaaaataagtttcagttttccacgtgagttgaaaaaatgttgacgttctttcaaacgaggacagagaatccaacttttcgacgagtttgttccggaaatcggaaccgattagcggtttctgctcccaatttgtttcgacgagtttaactgaactgaacccaatttatccgtggaagcagctactacccccgtcccaaaacaagtgcagccatagttttcagcgcccaactttgaccattcattttatttga

SEQ ID NO: 64938 - DNA, 579 bp, Oryza sativa
gaaattgtacagctgaagctacagatacggccttctgcacctctgtaaaagcggaacattggcaatacatgaacattgagcctgcggcacatctccttttgttcattggagttgaccataagaaactgcagttccggatgcatgccagccaattgacataccttttgggacattatgcaaaaaggtgttataactattcaaagtatgaaatgctcttttttcgttaatttatgtttgagaaaattgtttaataccatgcatgtgttcttttaccttagggtgtagggccttgcaagctccacaactaggggaaaagaagtgcaccacggtgagcttatcgctggccaacaggagctgcttgtcaaaatcgtcttgggattcaatgtttttcatgttgcaggatttcatgttcttttcccaccatttagtcttcattggggtgtgaacagcctaacaccacgacaatatatctcattgacatctcttttgtgcttgagcatgtattgtcaatgcatatttgagttttgttatttgtgaatttcgaaagagaccaacaatttcattttctgtgcagatttt

SEQ ID NO: 64939 - DNA, 1817 bp, Oryza sativa
ctctcaatgtcgaatgacagctagctagcttcgtgatcatataagttgatgcatttattctctctgtaatattgtaattcaggtcaaattaataactaatcaaaattcaaacaggtttttgaaggaaacgatgccagcacacgtagcacgtttcatgcaggaaaacattttcttctagagactgcaagaaaacagtttcttagaccgtgtgcatgcagaaaaatttcgggacttcggtacatgccaaaaaaattcatgcattattcgatttctggtcgttgatgaaccgggatcgatattggcatgtgtatattcagctatgctacatatagccgcttaatttcgtcaaaactcagtaaatttgtagaaaacataacaatattttcagaactaaacaaacgtattatttaaatatatttaatgctagatttaatcaaactaagttagatttttggatttttagatttgctaaattttttctaaatttgattaaacttaataatgtttgactagagaaaaagtgacagcgacttgcgatatgaaacgcatggagtagtattgttgtgttaatagttgaccgatactcaaattaattaagcagttaaatattaattatagttatgaacagagtgagtatatgtatattagtacgagcttccatgttgaagttctttctgtaaaagtgatgatcacgattttcttgtcgttctaagtcaaatagtgtcctaaatctgtcctaatcaaatatttttagatttgaccatcatttttttagaaatttgtgtagtttaaaatatgaattataaattataaaaatatttggtgaatctaaaaatataaatcttattatgttaaacagttgatatactatactacaactagggtacgatatagctaaaatacatctaacgtagttaactttttactgcgagagaaatcatcgtactatagcactaaaacttttactatgactactaggtaatgaaaaggtgcaggaatgaatgttcgggggtgatttttctggcattaaagattttactatgctacctcataataaaaaggtatgggaagagatatttcagcatgatatagggcttgttcggctggccgatacagccgctgcacgtagccgtagctgctgcagctgtagacacaacacattgtttgtgttggctgcacaacagtgaagttgagtaaagccgaatagagccataactcgtggtaacaattttactgtgtgaggagcgtgtcgacgtttgatgtcgcgattccggtatttacatagtatggggatcgttgggactagggtatatgcgagactgaggtaaaagagatggagacagagatttttatacaggttcgggcccctgaattgtcaggtaataaccctacatcctgttggctgaagccggtattgctcttattcaccataatcacaccagtacaatatttggggtagcctatctaactgttgttgacatggcggtctgaaggtctgactcgtagtcgacaacaaggtagtcttcctcctcgagttcgtgcccggcgagatcagagatagcgctttcgtctctcctgacagtatccggagacaccgtaggggactagccttacttatccctgaagtcgatatccagcgtcttgtcttggcatatgttggcttgtatgttgatcttgtgtcttgatctattgtttcgtgtcttctatggtggatgtgtcccctctcctcctaggggtcttgtatttatacccataggtgtccccttgtccaagtagaactagggaaaccaatatggatacaatccgagtagtacttg

SEQ ID NO: 64940 - DNA, 14183 bp, Oryza sativa
cttctttttgaatctattctcaggatttgttctcaattttgagtatgcagggcatgcttctcgaagatggcagaggagctgtgcgagctactaatgaactcccccggcgagggcttgacgccagatctctacatgggctgctttcagacgatgcttaacgctcctgtgcccgacgaccacaggtcatcctacctgcaagaggcggtctctgttttcaccgacatactttgcagggactgatgcatgattgcttgaagatccatggcattctatgatatctgcagaattgttggaagtttccctgatctatctattgggttttaacctattggttattctgatcatacacgggatctgggtgcacaagaagctcccggctgccaagtcgcaagtcagtaatacagtgaagagctccaaaagttcgtcccttgcccgagtgcagtgaggaaatgtagatcagctattgatggtgcagataactgccatgctcatcaaactcctgaagaatgtataagctgtgtgctaagctgtaccaatcaactttcagatgtgagctgtacccgtcatctttgttcgtttttgtactgtaatactgttacaacggaaagcagcaaatcgtgtacggtgtatgttgtgctgaagagctcgacgaagataaagcatccagctgggcccaattctcggcaatacatgcacgattccacccttccatggacgtgggagcaagctgcatatttctcttcttcagtcgaggtactttttcacagcttatgatgaggttatcccgaaaatactgtggtgtactttttcagagcttatgggattattccgaaaatactgaggttttacggagctgtaggcctgtaacaattgcaaggggatatttttttttctcatcacacggaaaatgcacaaagcaacaaccccacacttgcacactcgtaaattggactgtgtcagtgtggcaaagatttgagagcttaggtagaatatttcttctgtcgtgcacgcgatgtcgcgatgaaatgaaaaatcacaatgttggagtgagccaaaactgcttttgcagaaccatgtgaagctgtggtttgtctgaggagaaacatccagagtgcccaaaaccgtggacagctaacgtgggttccttgtattcttctgttttattttcccctgcttaatttttggttttctcatatatatgtaccttttattccgttatattgagcggcgttcctggttttgtaggacccctgatttcgttttctcatcgtgcttttcgtcccgtaatcattcacgcgcatgaatagcagggagacagcaacgtttcccactcgcaacatcgcaaaccatactgtatcttcactcaattattctgcaactgaaaccattattaaacgagaaaattttgattaaacatactaatgcgtctgattctgaacgcaacgatttgactccaaacttcgtccttgttgccggccggtggtgcagtagtgtgagccgcatcaagcgtaggcgactttcacgttagttgcatatacaaacgaccacttgtctcagagtttttgtagtcggctgcacatggaaatgatagcgctatacccttacacccagttgcctaagtaaaataaaaacttgggtgaaaactcgcaatcacaaatctcgtagtacaattgtacaaatcagcaggatgagggacgtacaattaacctgtctgcctcaccgaggcctgcaccactcaaacgcgcacgggaagcacaagcaggagcagagcacgatgtggtgtgtactggtgtgtgcctccatcaacggctcaacgctgggcaaagagagagaaaggaaagatatactactgctgccacgacatgtaacatgtgactgttcacggtcattttcatcccaaagactatgcgattgtgcgatggtaacgtgcgattgtgcgaacgattaaaaaaaaaaacttatctcaaccccatgaggccatggccctgtgttagcttttaattcagttggttattttttttcaaggggttaggggcttctcctaccactcgatatcaaaaactataaaaaaatattagtgtgtgtttatcggtagatgctggatatgtataatgtataccattttcattattaaaaaaaactctcttacaacttcgtgtccaatcacccaacaactcataactccgtagtgatcattgtgacaattttgaaagaaagaaaagaaaaaaaataaataggttattgaccaaattattatagtgaattatctacattatatatatatattaaatgtatcgataaatgtattaacttatgattgattaagttttaattattataaacttgaaaaatagattaatatgatattttagaataactttcgtataaaaagttttcgcacgaaacacaccatttagtagtttgaaaagtgtgccacgaaaatcttaatctccatctaactcttgttggagaaaagaacataacctacagcagcagtagtatttcactcgtcctaaaataaaataaatcttatgtctagtactacctccgttccatcccaatataagtacagtgtaggttccgtgtttagatagtccgtcttatttaaaaaaaaatattatttttttcttattacatgataaaacataaatgatactttatgtgagactattctttttaaatttttcataaattatttaaataagacgaatgatgaaacgttgagtgcggaaaaccacgacggcgcgtatattgggacaggatgtagtactactcaggcaccaacaggaggggaaaaaaaaaagaatccatttgctacagaacgtttcgcacgcaggaatgaaccatgaccgtggtgtcggtccaggaggccactgacccacccgccaacggaattgaaaagcgctagaacaaccaacgtgaacgtacggccgcacccagagccgcgtccgcaaaaacaggcaaagcgcacccagtaaacaaggaaaacccaacagcgacccatccactgatccattccaaagccacgagcccatcgacttatccgcacccatcacccagcctcctctccacgcaaacgcaacccaacccaaacccccctataaaatcccttctcccacacacagaatttcacaagccacccacagacacgtactacgacaccgagtttgagctttgagctttgaggagtgtgtctgagagtttggtcatggcggacatcgcgttgctggtgacggaggagttcgagaggaagctcaagaggggggcgccgggcgaggagggcgcggcggcggagtccaggaggaacttcggcgccgtcatcaaggtgtgcagctcgtgggtcgacgccgccgccgccgccgccgccgccggggtgacggtcaacgtcgcgctgctcaacgtcgaccccaagtccgggcccgccgtcgccgccatggacggcgccttctccgcctagtcgcttcacagttttttcttttttgttcttcttcttttttactcaaaaaaaaagataagttaattaggaggaggaactagtctattatgtatctctcctcctttgatacagctcggtcaccgtgttgatgtaaatatagccgcttaatttttgtcttttgatttgaaacaagctcatcattcatccattcgttttggtttctctgaatttgtcgatttgccatgtgttcgatcgaacccacaggaggactttgaccaaaatatccatattttttttcccgtcgcggtctcgcgcaagtggcaggatggaagagctgacaaaattctctttttttttcctttttgagaggaagggcgcacacattagtagtagtagaggctatcaagcaaacggcccagttacaagttcaatggacaagtggcccaaaccacaagcatcgtagcagtagaatcagcttgatttcctttccatttggttagattatgatgaagaaaacgaaaacaagaggaactccactctctgtggatatcaacgctttctccggttgtttgatcacatggccgatatctcggtgacaacctgggctttgtcggcctcgaactgctgatcctctgcaagaacagagcaagtgtcttagcaaaccggttttgatttatgatttatgattttatcatggaaagaagtgatcacaaaaggtacactttacctttttctattgtgaaatctgccaagaacctgaggattttgctcttgtttgtcaccagtatacccacgatctcaggtggcttcttcggattgcaagtgaacagctgaatgtacatgcaagaagatgttcagtattcgttttgcaaactgacgaatttttcgtgcgttaacacgaattgtaccttgaaaacgcgaaaagcctcaacttgaatggccctgctttgctcctggtaatgacaacacatcatatcatattaaaataaactcatattagctacgagattactgaacaaaggaaaattaaggaaccaagatgcgacagtactgttgtatttcaattttttttgaaagttgtatttcattttttaacaacaaaaagaacatagacggccttaaatatagattgagattaggacacaaaaatggtatatgagatatgagatcttacccttaaaaggttcattagtattatgaggttatcctttgagctaacatagcgcaccattgctgttgtgtttgacttatccagaagaatgtctcctagtagctgaaaaacatatcatgtgcatatcacaaatcatcaaaattcgagtcaatcatcatgtaaaatttaggtgaaatatacagctaacgcaagaaaaaatgtgtacctgagtggcttgccttcgaatgatatagttggatgatgacagcaattttgagttaaattccggaaaaaactgtcacatgaattgcaattatatgtcaatggaggtttgtcaaaggtcaaaaatagaagttgatgaatactaacatctccgttactagcaatgagaaatcttacccaatcgtaattatttgaaaagaactcagcagcacttgatctatgccttgtgaggagttcctgttaaaagttaaattgagcacaattgccattatcaacaccaaaagacatttgttcagacaacacactatgatgattgctcatattctgttaaaatcgtttacgagtcccaacaaaggcagaagggagcataaacaaacatgatctagaaaaggatgagtctctcctttggaataatcgtcattcatcaaggagaagattaaaagtacaagatggacgacataatcaccttaaaggtcttgaaggcatcagatgctatgttgaagtctggatattgtatataatcaaaaaatttcttcatatgctgagactctaatacatacctgcaaaattatgaagtttattaattgaagatcatgagaaagtgagtggtaactggtaaccatataaataattcgccaagcaaacaatgatatattggataaagaaagaagaaacatgatattaacggtgatgctttgtcctgtgaaatttacttgctatattatatatattttttaataaaatgtatatatttttttcataattaattaaaaatagtaatgtaaatcatggtcttgttaccttgcagcgacttggtgccgtatgcagtcccttagaattgcactataatgtattgcaatgtccatgttgtcatacctgtacacaggttgtgtaaatgtaaagaatgaagatcatataactgttttatgggttgaatgtgaagaatgaagtccataacatttatgtcctagggaaaaaaacatatcatagaaatgcatggttaaggaagaactaactgactacttacccagacattagaacatccaaaagatcctggttttcttccaaataatcagaggcaaccatcctataatctaccttttgcctagcaaattcgcagtaacttgagtgacatccttctgagtctgagtaaaaacgaaagaaaaaccctcttaaattataagaagttttaaattatatgtgttggtgcagataagcttcttgaggataaagtgggtcatggtcctatatgggtttcccttatctagagaatttcttaaacaataacttagattaaacaaaatgcagcatctaaattcttgaaaaatatcaaatatatatggatccctttgacatacttccaggtccatgtatggaaggcaaacaactagtagatgaagactattggtattctccttgaagaactccttcgtcaactgcgagcaagcttcatcgactgggtctgcctcgccatttccataaaggatggatttcatctccccgatgcttttggctagatctaccatctacatgttagttcaagtgcgtatttagtcacaaatgcataagatccccctatatatgatgatatgaatgattaaacgtataaattgtagtgtctaaccttaacacaattttggacaaacacaacttccccctacatatgtttattgttttgttgttatactaagttcctgctcattttgatgaaagcagagcgactaatataatcatgcctagttattctagtcaaatcttctgtttaattggcaacaggctcagctgttaattgattctacaataataaggtggtgttttaatccaaggacttaactttagtccctatatttagacactaatttagagtattaaatatagattacttataaaactaattacataaatgaaagctaattcacgagacaagatttttaagcctaattaatctataattagagaatatttactgtagcatcacataggctaatcatggattaattaggctcaatagattcgtctcgcgaattagtaagattatggatatgttttattaatagtctacgtttaatatttataattagtgtccaaacatcctatgtgatagggactaaaaagttttagtcccatctaaataggtctaatacaatctctggtttgaaattaatgtggctttcgaatatgcgcagacaaaattaaacactttaatcaataatatgttaaaaagggggttcaaaataatatgttaaagtagtttctcttttttcctacctgcagtttttttttctccttcccctggcataggcctatctggttgattgtgctgtgtaacaaaaactcttctaccttctaatatattgacgtgtaattttttttatacgttcgcgaaaaaaaagttgaaaaacatcgatgtatcgtgtgaaagcgacattggtaaattgtcatataaaaaacttccatatcgttaaaattggaaaacgttttcacgtttgtgttttctatttttttagaagtgtatttttttacctggcctctacatccaactggatatatgcaacctttaaacttttgcgttttcagatcaggctttaatttaggacatatctcgtcatctctcggttgaaacggaacggaacgagcgaacgatacatgaaaaatgtgtatcacccaccttgtgttcgcgtttgacgtcgcgcttgtcaccgcacgcgtcgtggttctcggcgaggaaggcgaggagctcccgcgcgtgccgcaccacctccacggggcccctcgccttcgaccggaacaggctccccgccccgtccgccgccgcgccgccgccggtcacgcacggccacaggcaccccgccattaattcacgcgaacgcggtcgagctcgctcgcccagcagccggtgctaggcgccgtacgtcggcagtgacgacgacgacgacccagattatcacctcctgcggcgctacaatggtgatcggtatggtggccggccttcttcctcgcacgtacgccgccgccgatgcgccggcgccggcggccgcgtgctcggccgttcgtgtgtgcgtgcgctgggtggcgagatcgcggggagatgaggaatttgccgaattggatggggagcgacgggcgcggagcgggcagcgagctcacgttgcgcgcctcctaaagttttaccgattcggcgctatttttggatccaaaccggccgcgattctgattcgatggatcaaaaccggggtcacgcgagattttcgtgtggctgggccggatcagtatgagttgggctcgtccacgttgtcgtgtccttctcggttctcctctcgcccgccggcccaattatgttcttccgctgtgctatctagtacgagttgagagaagaaaaaccgtacatatcttcttcgaattgggcaaagaaagagaacaccaatattcacgatgtgtacacatttgcgtaatgatcgaccttattatagttcaacgaaaatgagatttcctaccctctttcgtacttaatatagcaatgcagtattgaatatgatatatattaagtactacaaagttaggctcccatcggatggcctattcagccaaagaaaaagccaaaatttgaattttcaaacttaattttgatattgattttgagatattttcaacgtagtttttttttcagcattgacttttaagtcaccgagaacacatatataaaaattttactaacaaattcatttttattctctaataagccgttttggcttattacgaaaaaagccaaacgatgaggccctcaccgtattatagaatgaagggagtagctgatataagaaacaaatgacattttattctaccagagcgaaattgagaagggattgagacacacatcatcactacgatcgcttgggagtgaaggagcggaaccaccagtgggtcgtcgtcccggggatgccccacacgtcggcgtcgtacagcgtcgtcttccagttcgggccgccatacacggtgaccaccagccggtagttgtagccgccgttgtacggctgcgtctggccgctcaccacgttcacgtaccgcagaaaatacagacgtgtgatctgcctatagatccacagggcgaactgccccgcctgctggatgctcttgtcgttcacgttcgccaccgccgtccaccccgcggccgccgctggcggcgccggcggcagcgagcttgctagcgcgacgtcggcgttgttggtgatggcaaccaaggtgacagaaatgacgacagctataatgctaagacgggacgactgcctcatgtcgcgagtacgtatatacctagagcgggtagtgctaattgtgagggtacgagatgattaggacgtgttggagttgagagctagtttgtgtggtgacctagtatttatagtggtgtacgatcgtgccttgtctcagacgtacagctagaacatacacggttattaattagtagcgttgacaaattttagctttaattaattagacaacaatcatactttaatttgttcgcctgtactaaatgtaaatgcaaatgcaaatccttttaatactatctccgtcccaaaaaaaattgcatttctagctccaaagctttgtccaaaaaaattgtatttgtagccatgtgtggcccagcaaattgattgatctagataagattcctaatacgagcagcaaatttttggtgccaaatccatttggctctaaagcatgtaatttgggctgctaatgcatgtaattaagtatgctaattatatgggttaattctctcaaacttccttttaatcatttgtatatatgaaatgtgtgcatgcagtgggttcattaaataaggccattatggtcatttttcaatcctactgttttatactaaattagctggaaatgtaatttttatgggacggagggagtattaaattggtgtttggtggttttgttgaaggtttcaaacaactgatcgagcgtaccgcgcgcgaatacggtcaatatgtcagttaggatcactgcgagcactttggttcgaacatgcctaacgatttccagagcgcagacgactttattaggtataatttgatttaatttcttaagacgcgattctgcatttatgctccagttatagcccggtggtgcttaacttatctccttagtcgggatctaatcacatgctaattgattaagccctaactagaaagaaacccgcaggaaatttacaagtccatgtgtgcatgtgtacaacatctacaactaaccgacatctacagctagctattgaagttcatggccttgtgatcgaggcccgtttgttccacatttccacttccaaagtccacagcgggcctgagggcaggcccaagctggaccccagctggacatacagatcaaatctagacacggctagttatctacgaggaagcagcttgacaagccacggcagaagaggatggattcagtggtaataatcttatcttggaaaattttggaagaacagaatgggcatatttttcaggcagtggcactttgttcccgcggcgtccctgtgctagctgcgtctgtaacactttgctctcttatctaataaaatcgattggtgaccagcttcaccgaaaaaaagaagggggaaattaaaggacaaaacacaataacataacgttaacgaatttttgtttcagtacttcaaacgttcatatgcgtgatgtgctcaatgcaaacgagaatttaacaactagcactagaatatacatgaaattaacatgcacatacacagtgctctaagcctctcttaaaacaatagtctgatatgcaggggtttgcacgcacacattacacatacatgacacacatcgatcgcgatcactggattcagttggctgctagagtgaaggacaagagcttccagttggtggtgccgaggatgccccacatgagggcgtcgtagcgcgccgtggtggcgcccgggccggccacggtgaccacaggcggtagttgtagccgccgttgcacggctgcgtctggccgctcaccacgttcacgaaccgcaggtacgtcttgttcgtgctcagcccgtagatgcgcaccgccgactgccccacctgctggatgctcttgtcgttcacgttcgccaccgccgtccacgccgccggcggcggcgccgcggcggcggccgtgacgctgccgccatctgctttggcaacggcaagcaacgcagcggtgaatatgacagaaaggactacggtgctaagggatgacggcctcatgtcgtgcctttgtatgtgtatgcagcttatgcttaattatggctgcctactaatgctctattgcacttgtgacagtgagattgtgagcttaattgtgcagtactgcagtggcatatttatagtggagtgactgaacaaactactccagctaattaacgtagcagcggtatggccagcaagatgcaattgcagagaaaacaagaggttaagattgactttattagacccagtacatacgagttcatattgttaattagcgcactcgtagctgactgctcatttcgttgttaattataatacacgtactacgtacatatgcaaaacgttcaaatcaagtttcaaacaattaccgcgtacggtcaatactgtcagttaaaaacttgcatttacacggcccaacatcgtgcctaacatgtatacatttaattactaggactaagctaaggtacgccggtgatttatatttattttcgagcagaaaggtgacgagctgatctcccgagttcagacttcagttcaagccatacttgggccgtgtttagtttccttcaaactttcaaaaaatcccttcacctcaaatatttggagtattaaatatagacgaaaaattcaattggacagcttgcatgtaaattacgagacgaatcttttgagcctaattacgctaggatttgacaatgtggtgctacagtaaatatttactaacgatgtattaattagacttaataaattcgtctcgcagtttataggtagaatctgtaatttgttttattattagtctatttttaatattttaaatgtgtgtctgtatacgttaaaattttttttaggaactaaacactgaattttttcccccacccctaaaccgaaaaccccccaagacagtagccagtgcatttcaactagtcagacaggattaagctagttaatcctagttactcctccgtttcaaataattggtatttctcacttcctcctaagtttaaaacattacatttatatatttgaccattaattactataaattcatatggtttaacatggatgcactaaaatgcacttaacatgctcagtaacttgaacacgctctgtcagaattatggatactacatatctcataatagttgactaaatctcggtaggacccaccacataccatgtcctatatggaagcaaccttcagatatggagagagttccggataaggaaagacgactagagttctacatggaaacgacaagtactactcggattgtatccatattggtttacctagttctacttgacaaggggacacctttgggtataaataaaagaccccctaggagaagaggggacacatccaccatagaagacacggaacaatagatcaagacacaagatcaacatataagccaacatacgccaagacaagacgccggatatcgacttcagggataagcacggctagtctcctacggtgtctccggttactgtcaggagagacgaaagcgctatctctgatctcgctgggcatgaactcgaggaggaagactaccttgttgtcgactacgagtcagacctttagaccgccatgtcgacaacagttagataggctaccccaaatattgtactggtgtgattatggtgaataagagcaataccggcttcggccaataggatgtagggttattacctgacaattcaggggcccgaacctgtataaaaatccctgtctccatctcttttacctcagtctcgcatataccctagtcccaacgatccccatactatgcaaataccggaatcacgacatcaaacgtcgacagtggcgtgccaggtaggggcattttggtgcttcaggatttcgacgagatgggttcaagagggattctccaacaataagctactcgatgactttggctgtggggagatccaacctgtccaagtacatcttccgactagatcggaaccatcatcgtcatcgacaacttggtctatcgagatcatccaagcttcaagatacgcgacgtaccaaaggatgtcagatcatatgacgtcaaacgagtacgcaataaggtaattggtagattggtttttcaaattgatctactaatttcgtagatacatccggcatgtatctacaaaggtacgcaatattttatatgcaatttatcgtatctattcagatcatacagcattgtcagatcaataatttattatgtttacccagagcatgttttttatacaatatctgttgcgcaggtgtccccgatgttatatcgactacgatctaacgctgggagctcgctctgtcttcttctgtataaatcatgcttgtttacagtctacataatgtctgacattttctgctcgttatatcctgataatgctagaagatccatgcagttttttgagtacatactcgatattctctgctatatgtctcgtcttctagaaaatatttttcaggaacaattgagcactcgagtaggttgtggtcaagtacaccgcattatcgagaacggtctcgacaaatgtagagtcgtcgcgcccaacctaccaacgaaggccgacgacctatctcatagcaccggccatggctggactactactcgagaaaaggtcattaacggataattctcgcgaacgtcatcgacttgatcacccgacatgattgtgaacggacatccggatatgctataagttgggtgcgtgagtcatgctggccacatgagacgcacatgtaataaaccaactctagcacccccattggtgttcgagagataattctacacgttcgctggtcctcgaaccagtacgtagcaatctctcgcaccgcaacctccattggtgttcgagagataattctacacattcgctggtcctcgaaccagtacgtagcaatctctcacaccgcaacttccattggtgttcgagagatgattctacacgttcgctagtcctcgaaccagtacgtagcaatctctcgcaccgcaacctcagatggttgaggtacgactacatcaataacgcagcggtcctcacaccacgacttcaaatgatcgagagacacctactcattggttctcaaccagtcaattgtagcgatctctcgtacatttacttctagtgg

SEQ ID NO: 64941 - DNA, 638 bp, Oryza sativa
  unsure (1)..(638): unsure at all n locations
ggtacgtcaacactagggttccattgctccaatgtcggcctancggtgtcgtccaaaacctttaacggccgtggtcgggtggctntactttgtggcctgcgtcgaagactaagctgttccggaagtcagcgtcacaggcgccacaacccttcgcggtggctcggactctctagccgccgacgcttctcctgctggtggctatggctcagctgctcccggacccagcgactcgatgtcgggttctgaaggcaacaacagtcgccatttgcaaggtttgtccctcggatttgcttgcctccatcctccgttcttcttgattgtctcaatctgcctcatgccctcatcacctctcttggatctgtcattttgtacctgtcttgtttgtcatgcttggaaatttactagtaattttaaactaatctatgcattctattctcgttcaggtccaatataatactcacaaggaaacaatatgggaaagacgatctagcgatgtcttcaacttcacttccacaggtagctcaactagattataaaccaaaggtcttctccttcagagtacttctccaactgtggtttgatgattaaaggtgagcatatgaaatactccgcaagccacataacaaatatgcagatgc

SEQ ID NO: 64942 - DNA, 569 bp, Oryza sativa
cacatgtacttgtcgtttcttcttatcctacttctcctctgcggctttcataaaacttaatatgccatctctatactccttgtactgacgcctcaagccagtcgtgtacatccaactccgatctatcgctgaacaatggggaaaaaaccacccccccaaaaaaaaaaaaaattttaaatttttaagggtttaacatctcataacataagtactactaaattaataggaaatatttagtagccttttacttacttttatgattttcctgtttttgtttgcaaaaaaaattacaaaaattcgcccccttcaacctcccaccaaaatagtgaacagtgggataaactacagtcaatggactgctggagtatatatagtgtgcaaagtatatctcaatcgggccaaaaaaatgtcatctctaacgggcgcacactaatctctaacgggcacaaatagaagcccgacacctataagagtcatcggtgacgggcattaaggccatctcaatcgggccttctttggagcccgtcaccgatgacactcatctgtgacgggctcagtatttgggcccg

SEQ ID NO: 64943 - DNA, 3654 bp, Oryza sativa
ataggaatatgcaccccgacgagtacatctacaacggcaaaaatttaggcccgattgagatgacttcgttctaacggcccacgttgtctaggcatgtgatgagccatcacagatgagaggatctgtactagtggacgggagatgctccaggtttcatttgtcccgatcttcatctaatttcatcttttagatcgtgaccagatatttggtatttgagaacacgtacgtaaatttgttttccaatcaagtttagtttttttatgccaccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacagctggttacagatctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatgggactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaatttgaataaagaatcaaattgcactcccatgactacgcatggtagttgaataattgaaaccggaatcaaagaaccaaattaaaaccatattgcacattcatggcaaacagggaacttgaattatttacccagaaccagaatccggaatattgaaacaagaataacatcgtaaacatatgataaacaagaaaagcaaaatagtgtgaacaaaaatatgaatataagcggtcacatgtcacatagaaatatatcggaaataaatagatagagcaaacaatccatcaatcacacacttagttcgtcatgcacttgcctccaatgaagggttggtatcatgcacgatctgaaaaaccaccacctaatcacaaacaaaacctcagcaaacacattcaacatgcatataaaacaatgaaaaaggtgaacctactgccctatcccatcaaaacgcaataacaaggaacgccgcttgcactataaacaatattgttgcttcaaacatttatatcttgaaatatgaaaaggctattaccgcaaacaaatacattttggaaatctacagaacaaggcctacaactcttatgtggaaatcatatttttattatgccattaaaatggtctaatttgcgcttgaaagcaggcttcacaatctgtctagaaattcagactatccgcactaaaacaatcataactggagttctacttgcccaatcagggtgtactttaccaatatggaaagctaagaaaaacctctacaactttgtctataggcgtcttggctgattccactgtttatcccatccaaaaatggttcaatctactactatccagattatgacataaaaacaacagttatactcaaaaattcgtatcatctaaaccacttgagataaaatcgcgccctttggtcagaagatagatataaatattatctacagcttcctagttatacactttcgcagaaaatatcattttgatctccgaaactttgaaaaaccgaaacactgtaaatctgccaacgtgcagaacagccaattcgaaccacaacaaacaaaactccttctctaaccttccttatccacgaaataaaccactaaaaccaccctagaacaattgatatgacaagggaaaaagcctcacctatggtttctttagagaacttgtgaggagacaataggggagactatgatctaacccctccttttactcctctcctcctcctcgttgcgtttttctattttgctttttatccaagttatgaaggcggagatctagggagagcaatttgttgtagaggggagagatgcgaacataggaggtgggagtcggttcccctctctctaagttttagggaaaaactaatgggttgggtttatgggccttctcatgttggcacacttctaaagatatttttcttttatttatttctgttaacttctttattttaacaagtcaacccaaactaaaaaaactaaatatattttaatacggggtattacaatttcttttttagtttgattgaaataatgaatatgttgctgatttttttggtgttgaattatatcttttatcataagtgcatggttaaggtaatcatgtcaataaattagaaaaatcccagacacaactataaaaaaaggtatttaatcttagttttgaaacaaagatatatattggtatattttctgtatacacagttgaaaactaccctctccatcccaaaatacaacttctagcatttaaaaattcaaccaaaaataaataacaactttacttttaaaaaaatatgacaacttctctactaatttttttctcaatcaattataacctttccccaatttaattctacctacttccttcatatttgtgtcataccctaaaatttattatattttgtgaccgatagtaataattaattttccctatgtcttttttttgtgtgtgtgtgtgtatatatatatatccatatgactactgtgtgcagtctgcaatttattgttatttgtacatgccgttacagttttatcatcataccaatttttctgacaaacaacacctagcaaaatattgtgccacagtagcaaaaaacacaacgccctaaaaactacaaaatttggatgatcgagactctaggataaaattgtggcacagtagcaaaaaactcaactccttaaaaactacaaaattcagatgatcgag

SEQ ID NO: 64944 - DNA, 1254 bp, Oryza sativa
  unsure (1)..(1254): unsure at all n locations
gggcgaattcgagctcggtacccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacaagncctttgggggggtttttttaaaccccccaaaaggggggaaaattttttccctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatggaactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaat

SEQ ID NO: 64945 - DNA, 596 bp, Oryza sativa
cgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctctggtgtgtggcaaagcttcgacgagataaaggaaacctgccccgacggaagggaggtatcgaaagcccgttgtagaatatgtaggcaaattttatctgctcgttcttctggtggtacaggtcacctcaagcgccatgcggagtcgtgtgccaagaagcaaggaatacaacttcggcagcagcaacttatgggaaacccagacggt

SEQ ID NO: 64946 - DNA, 1715 bp, Oryza sativa
atgctctattgccaattatgtgtatatgtactttctagttccatattgtacttgctgagtattttgatacttttatgttttatttggttttaggtgcgcattgagaccgacatgcttgggctggaagtagcacccatatatacacctttatctgcacactatcaatctatattgcctaggtccataatgacacttaaactatatcatggttcggtcttgtaataatcttttagatgtattttagtttcttttcatggattataaggatggatcgcactgtgggaatgatattattattagtttaacccataattgcctgttgtggaagtccgtatttacaagggaaactatcgaaattcttaatgaatttaggacttagtggtttctataccatagtgtgtagcattctaggtatgagaatacctggcatgttacagagaccgacaacaatagcctgtgttctgcggtgccctgctcgaaatgaatcaggaggtagtccgtgttgcgctcaccccaagcgcggtgtgtggcggagcatcggcggctcggcgccagcatggcccttgcgctgctgtggcgaagagtgcgggaacgacatggagccacagggcctaagcgcatgggccctccttgaacccccccttcccccctagagggctacctcatcggcggcagctgcggttgcagcgtcaaaggtgtatgcgagccggacttgggctgtgttcttccacccattttcccaacccagctctctcgttttctgcgcacacgcttttcaaactgctaaactgtgtgatttatgaaaaaactttctacatgaaagttgttttaaaaaatcttattaatccatttttcaaaaaaaaaatagttgatacttagttaattatgtaataaaacgagctttgttttgcatgccggggagccatggtaggcaggggaaagtcatacttttgttattgtttgtctctgcatttcctttggatattataaaataatctcgcaggcctccagtagctaattaccagttttttcggtgtcctacaacaaatacacgttcttgctgtgtccccggccaattacacgttttttagatgtcgcttagcaaattttaacctaaataaaagaaaatactaaaatttctcaccaaaaatcaaaatatcccagcttatcttttataaaactggtagacccattacttataccccgttagacatctaacgactttctatcaactttttctcagcttgtatataggagctatttaaccatacattttgatattgaagcttttatcaataaatgatcattttaggagataaacaataatctcaagatgatcatagcatctaaattatatatataatatatgaagtcacgtggctagttgaacagcatactgattgattgtactgagcgtgttggttgcaccaaggaatcttaagtatgaaacaagcatgatgtggcctcagcaatatataagccaattacagatatgaattaaaagactataggggatccattttttttttgtaaaacttgctacagtacatcgtgaatttgtgacacataacatagaacaatctagaaacatataattattacatgatgctctagtttagtggtaatttgcaaagcaaatactaccacatctattttaatttttcttacttaattggagcgagataatttataattgatgcctttaccccatgcca

SEQ ID NO: 64947 - DNA, 1389 bp, Oryza sativa
  unsure (1)..(1389): unsure at all n locations
agccagaaatgaccttggaattcccgtgctactgtcctgttttttcttttctggtcacgagttgatacagacatgggattagctccttgggtgacctaccatctatcatcggtccttcacaagctacctatccgtttcatcacaaggtaggatggaaccttaccatggtttgtcatatgcgtccaatcgaaccagagctaccttagttgcaatgatccgtcgaaacaatccaaatcagttatacctatgcccgctaaatttttttggcagcataccctttaccagttcactaagcaatgtccgtcgtgtgtctgttccgaacctgtctagaggaaacctcgatgaaatttgtccatattgttttcagtccacttctttaggtgggatactgtgaggtgggtatgtcggcagggctgaaagggtggacttaatcaacactaactgacttgttttgttaagcaaccttcctttccacgttggtagtctagctgcaaaccagtctataagcggttggacatccaacttacgaattttcctgatgtgtagaggaagtcggaggtaggagcttggaaaagtttttttgttgggctgggaacggggagagaatatcctgcagattggggtcgttgcacctgattgcatatactttgctcttttccagattcgtggtcatcgttgtagcacgtccgaaattttgtagaatggcatgtaccgcttggagttcctatttgtccggtcttgtgaacaccaccccatcatctgcgcataaggctatgttgaaccatgtgttcttccgtgcaagggctgtagaatacatgtttgttgggcggcggattaaagcttttgcagcgggtctatcgcaaggatgagtaacatgggagagagagggtcgcgttgacgtaaaccccggtcatgttgaaagccggtccctgccctgccatttaggatcaccttggatgacgtgcttgctataatggaggtgacccaatttatccacctggccaaaaaaaaaaaaaaccccccccccaaaaaaaagggaaatttccctttncctcaaagcggtcgagaagatatggccagttgacagaatcaaaagattttgctttatcaagcttgaggaggatcgctagaattttggatgaatgaagttcttttaccatgttattgacaacaggaaagttgtcctttatgtttctcctcttaatgaaggcactctgatttttggataccaattgttgtagtttcggtgtcaatcaatttgctaggagtttagagaacattttgccgaaagcatgaatgaagcttattggcctgaaatcccccactctgcaagcattatgctttttttggcaatagggcaatatagggggtaccgagctcgaattcgcc

SEQ ID NO: 64948 - DNA, 4858 bp, Oryza sativa
caaaatcaacttccatacaagttcaccttccgaaaatgccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcttataaggagggacttggatcgatccatgacaagccatccgataagaccacaatgcttcggccaaacgagtatgccactgccgaggataatcagaaatctttcttttaattaatttgatcaagctcttgttagatgcctcggcctgcccattagcttgtgcataatatggtgaagaattcaacaatttgatacccatgctataggcaaactaaacaaattcatcggacacaaaaattgaaccttgatcagttgtaatggtttgaggaataccaaatcgatagattatatgttcttgaacaaattgtatagcatccccagaatcaaccttcttcgaaggaatcgcttctacccacttgctaaaataatcagtcgccaccaatataaacttatgccctttactcaatggtggattaatcatgccgattatatcaattccccaacctctaaatggccatggcttaatgatgggattcatagccgacgccgatgccctctggatcgccccaaatttcttacaatcttgacatcccttgtaatttttgaaacaatccttcagcatcgtcggccaaaaatactctgcacgtcaaagcaaccacttcatcttatgagccgattgatgagtaccacaaattccttcatgaacttctccgatggcaaccttagcctgatcagcactcacacacttaagtaacaccccatcaatcgtccgataatagagctcatcatccaataaagtatacttcaacgctttatatcttaatctccgagaagccgactgagatggattctgtaaatattgatgcacatcatatctccaatcatcggctgttattgcagcaacttcaaccttaacatctttgatcatcggcttataccctgatgccccttgggccaaatcattagcttcaatattctgctctcgagatacatgcctcaaggtaaccagccaaaattccatcattagttcttggcacttctcattataaaccattaatgtatcatttttgcactcatattctcctgccaattgactgattactagcaaagaatcccccataatttcgatagcatcggcttcaacttccttgagtaactgcaaccctttaagaactgcctcatattcagcttgattattggtcgcataaggtttaatagtgtaagcaaactcaaaacatgccccacgaggggaaattataactaagccgataccacaaccatgagtatatactgatccatcaaagaaaaaagtccatggcacgatctcaattgagccgattaaatcatcacgatgatcaacaatgaaatcggctatagcttgccctttgatcgccttcggtgactcataccgaagatcgaactcagttaaggaaaatatccactttccaacccttcctttcaaaattggagccgataacatgtatttaacaacatcggctttgcatatgacagtgcattcgttggacaatagataatgccttaaccttgtacatgaaaaatataagcacaagcacaacttctccacaggggaatatctagtctctgcatccaagagccgacgactcaagtagaatacaactctatctttcccttcgagctcctgaatcatgaccgagccgattgacttctcaccggccgacagatataacctaaaaggtatccccttctgtgggggaatcaaaactagaggagagctaagatattccttaatactgtccaacgctttctgttgctctgccccccaagtaaactgttgatcggctttcaacctcaataatggtgtaaaaggctctaacattccagacaaattaaaaataaaccttctcacaaaatttatcttgccgatcatctcctgcaactctgtcttgttctttggagactgaatcttcttgattgcattaacactcctttgagttatctcaattcccctctcatgaacaagaaatcccaaaaactggccagccgatacgccgaaagcacactttgttgggttcattttcaagccatatttcctggttctctcaaaaaccttcctcagatcagctatatggtcctctatctttttagacttaacaaccacatcatcaatgtagaccccaaccaaccagcagatcagatcatgatatatataattcatggctctttgatatgtagccccagcatttttcaaaccaaaagacattacaacccagtcaaataagccaattgtaccaggacacataaaagctatcttatgaatatcttcttcggccataaagatctgattgtaccctgcattaccatccataaaactcaaaatcttgtgtcctgaggcagcatcaaccagttgatcggctactggctttggatattcatcctttggggtagctttgttcaaatctctgaaatcaatgcataccctcaccttgctgtttttcttgataacaggaactatactagaaacccactcggtatatcggcaaggacgaataaaaccagcatcatataaacgtttaatctcagctttgacaggttcgagcatatcggctttgcatcttctcggaggttgttggtgtggcctgacccctggtttgataggtagccgatgttcaacaatcgatcggctgagtccgggcatctcataatactcccaagcgaagcaatctctgaattcctttaatagctctatcaacttggttctgaattccgaagataaattcttactaataaatgtcggccttggtcgatcaactggacctatatcaatctcttccaaatcatcggccgacatgaaaccctgtccttgtttgtcatcgagattttctactgtgtccttggtgtagacatttgaaccctccacgacgccctcaaaataataggttgggttctccatctacaattggttgtatatcaaaatcggacacttttagaaaatctccatcccaaacttttccagataaacaatcaagaccatccatctcccaaagagctaaatctgcactggcaacattgactgacctgtcggctggcacaatttcaatcttgtcgccttgccactgaatcaagcattgatgcatggttgaaggaatacaacaattggcatgaatccaatccattccaagcaacaagctgtaggaacccttcccatcgatgacaaagaacgttgtaggtatagttttactgccgacggttagttccacattcaaaactcctttggtttctgatggattgccaccaaaatccttgagcaccatgtttgtcttgatgagatcttcagtgtttctgcccaacttcctgaatgtagcataaggcatagaattcactgcagccccaccatcgaccatcatcttggacatcggcttcccattgacctagccatttatatacaatggtttaagatgccgattctctgttccttccggcttttcgaagactgcttgctctggtgacaaaatcaatttagccggttcttcttcaacttcgtcaacatgggcttgcttgaccccaaattcagtaggcaacgtgaaaaccatgttaaccgatgtagttacaaaacttttccctttagccaatctctttgcttcatcggctacaggagcttgattcttaacgcgccactcctgcttcggctttgttttttcagtcgatgattgatttcttgctcaacctcctaaaatcattctctgttcctcaacctctgaacacttctcttttgattctttgtaaagataccagaaggacaccattgattctgcatgtcttcattgtcctcttggttataatcttggttcaccgggcccaacctttgatgaacaggaactcttgtttgctttagccgattgcttctattacacgatcggcttgaactttctacaacattaccgcacccaggacagtcctcgatagatggcagcctcttgcccaattcttcagccgatgggattgtatgaccagcaggaagttgaatctgtttctctcggagtaacaaatcaaaaatcttatcagccttggtaatatcaaagtcatacctctccacttttccagaattctttacccattggcatggtataacctttttgcttctcacccattctatctcagagtcatcatcatcatcatcatccgatccatatatgtaaggacagacatgattaacctttttaaagttcttcctgacttctgcaaacctctgttcatgcaaggttaccttctgtccaagatgtgacaggctatcaaagtcttgagacgagaatttctccttgatcggagcaatcataccctgaaaagccaaatcggctaactgggcatcaattaaactcaagctgtagcacttgctcctcatctctctaaatctctgaatatactcatgcacaggctcatcatatctctgcttgatcgctgttaaatcggacaatttcaactcatgaatctcactgtagaaatagctatgaaaatgcttctccaaatcggcccaactgttgattgatccacatggcaaagaagaaagccaagtgaaagccgatccagacaatgacaaccggaacaacctaaccctcaaagatccatgataaaaatcggctaacgcgttcataagttgacatactatcctggcctgagaatattgaaaa

SEQ ID NO: 64949 - DNA, 1045 bp, Oryza sativa
ctgggtactgatggtgcagctgcagacggaagtggtacagacattcatgaagaaggagatgaagaagagcatgacatgtttgtcccatctccattgggcggtgaaatggttgatgtggaccctgatatgctgcaagatatgttacgtgacgttgatgacccagctatgaacgagagagattccatgaagttcagcaggttggttagtgactcggagactcctcctatacgtaggatgcaagccaaaacacaccaaattatcagcaacattagacctaatgaagttgaaggctagtaatggatgatcaaacaagagttttacagaacttttgggaatactgaaggacatgcttctcagaagaacacattgcccgagacgacatatgaagcaaaacagtttctgtgtcccctagggttagaggtccggagaattcacgcatgtccaaacgattgcatattgtaccacaagcaatacgcggacttagatgcttgtcgtgtctgcaaggattctcgatacaagcgaaagaagagcgcgggcgagggaaagaagtcaaagtggggtggtccagcgaaggttgtgtggtatctaccaatcattgatcgtttcaagagaatatttgccaaccccaatgaagcaaagttagtacgttggcatgccacagagagaaggaatgacggtttgctaagagaccctgcggattcgattcaatggaggaatatcgatcgaaagcacaaagactttgctgccgaccccagaaacatgatgatatgtttgtgtacggatggcatgaatcctttcggagacatgagcagttctcacagcacttggccagttctcattgcgaactttaacctccagccatggttgtgcttcaaaagaaaatatattatgttgtgcttgttaatccaaggtccgagacaacccggcaatgacatcaatttgttcttggagcctgttatcgatgaccttgagattctgtggaaagtgggtgtggaaacttgggatgcatatggtcaggagaacttcacactacgagttctattgt

SEQ ID NO: 64950 - DNA, 994 bp, Oryza sativa
ggcatgaggcagattgagacaatcaagaagaacggaggatggaggcaagcaaatccgagggacaaaccttgcaaatggcgactgttgttgcctccagaacccgacatcgagtcgctgggtccgggagcagctgagccatagccaccagcaggagaagcgtcgccgcctagagagtccgagccaccgcgaaggttggtggcgccgttgacgctgactccgggaacagctaagtcttcgacgcaggcaacaaagtagagccaccgacgacggcgttgaagggttttggacgacacggttaggcggacatgggagcaatggaaccctagtgttgacgtacaaaggaagctggcatatatcagatatatagcttgcatcataacttattttgttttataatcgcttctgttactgaattgttattcaattctttttgcgtgctacaaggcaagatgacacttgggggcaaacctccctcatagcctcctaggttgatggggtgaccacctacggtgcatgtctcgtggcattactccacatattttttttcgtggcaccccaaacgctcccacatatttggtcggcagtcgcagcggtgggagcagaatcttggactgccgtgagacggcgatgaggcgtaggccagaagaagcaagactccggtgggctcgtcaacatcagcaggagcttgccgttgttgatgcagtccaagcaatgcttcccctgcatctccctgaaatgcttttccatctaagcttcggtcggacatgtggacaaaagtttgggcttgactatggtgtccatggcctgcataagccaaagctatgccaaaagccgccgcagcgatcactcttcaccttggggcttctagtgggcgcgcaagcgccagctgctcaactcgcgctgcgcaaatcccacccccgtaatcagcatttatttacaataatcagtactattatttaaaaaaatacataatgaggtttgtaaaatcaacaca

SEQ ID NO: 64951 - DNA, 2654 bp, Oryza sativa
taggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttatacctatcatttccgtatttaccgtattcttgcggaaattaccgtttcttataatatggtaattaccgtattctaaatatgtcgatattataggacatgtctatacttgacccacagcttatagattgaatgactcttcaataaatctctaacttttgtacatggctaaaatgaagttaatttataatttatatagtataagcttgaatttatgtatatatataacatacttatgtaaagttaaatatatgtttttatagtttaatgtttccgtatttgttaccggtttccgatctgtaccgacatgtttccgtccgtattgttccgtttccggttttccgatatttccgatatcgttttcgtttccgactttaccttttccgagaaaaatatggttacggaaatggttgaggctgttttccgatcgtttccgaccgttttcatccctaatcaagacgtctagtccaagaacaaatgctggaatatctctgctgtaaaacaatattgatggagggagactcacaagtggctagctgaacagtaccataaccattttcagtcagatgactgatgacatcaccgaccgtgctttcacaagacactttcttcaggttaataagtggcaatccattcgtctagctcctcccttttgacacggtcacacttaatggtgctacgtacctatgtgatgtacttataacatgtccactggagtccagggtcctacaaatttggtctacaaccgacatggccagacatgattggacccaatccagacattgatgttgcatcattaggactactttgataggcaattaggcatgttggtacatgttcagacgcctccaaaatcctcagtttgatggtacaactcgacgcctgaagttatccgagactatcaattgattaagacattgtttgtggagctcgagattataatatgcagctagtgattactaagtcatctacttcttctatcctaaaatataataatatagtgctgaatatgttcagattcatagtacagaatgcatctcaaccgatatgactaggttcttatattttgacatgaagggagtaatgaaaatctaaaaaggttgggtttcatagtttctaactgttaatttattttctagattttataaatatagagtctaacaaattagatgagaatttaaattgcatagcggagatgtaaattttagaagaagttgtagccactaaaaaaactcttttaaacagatgctaagacatggttagaggatccaactccccatgggccacagggtatcaaaatcatgctaagacatggttagaagtcctccatgctctaaaaaaaaaagaaaagattggattaatccttctgagaggtttttttaaagatacttcattagaccttttacaatatagcaatataatattttctgtgtggcggtagaatcatgaatgtataactccatgcatctaccagggtgctgtacatcaatggctgatactaaaaaagtagcctcttgtaggctgtagcttgcaacaccctacttggatgctgcagtgtgaagtgttctatagatagagcaattacgcttttgaccctactttaaaacttaacagagtttgcttgtttgatcttttttttcgaaacgaagaagaggcctgaccctattccatgaagacaacgtgacggtgttaactcaagacaaaaatttcatttatacccttgtgaatttaacccaattagtgaatattaaattgcaaaaaatatacatggtacaaatttgtgtccaccaaaaacaaaaaacaaaaaaaaaacatgtcaaacaatagcactttcaacacaagcagaaatatcccattgtgctgtcgctggtgcgctcatcgcctacaaccacgaccaacggctcgccgcctccatccaccacgccgatggtcggatctacagcatcgcgggaccacctccgccccctctctactccaccgccgcaaagggagaagaaggacgccgcccctttcttgcgccgcgagcagcgggcgagtgctttgcgtcgagccgtcaaggtcttctctccacggcctccttctcaccgcgtcgctggtcatgcccctccctctgcgtcgggcgacggcgagctcccgcggcgccgagctcctgcgctgcgtcccgcccggcggcgagctgcgccaccctcctcgacttgcgccgccaagctcctgctccccgtgcccccctccgcgcccagcggcggtgagcagccgccgccagcactcctctctccgcgcctagtggcgcgagcagccgccgccagcgctcctccctccgcgccgcagctacggcgagcagccgccgccacagatcctcccactgcagcagcagtgagcagccgccgccacaaatcctccttccccggtgcgccggcggcaccgccgccgctccccgcgccaccgccgccgccgctccattcccctgcgcgccacctgagagagatgagtgagtggatgaggttga

SEQ ID NO: 64952 - DNA, 8824 bp, Oryza sativa
agcgcagtgaaaatagggccaaacggtaactttatttttgaaaagcagggtcaaataaacaaactagaaaaagtaaggttaatttggtagttaggctctgaaatagggttaaatgagcaattgtccctatatagattatcagtccatcctaaagaccatattctgtgataggcatcgttcttttcctatgtcttctcttgctaatgtatttagcgactacggaagcgtgggagatttgcttgatgatcaaagtgtagtcagtgtcaaccagtcaccaaattacttcctttaattaaagacaggtttgcaactaaactagcaacctatactgttaccggaaagcgctgtatgccctaaaaggcgaagtatcggaaaagaatgctggaagtagcatcataaaagagacaaactccaaatggagtacaagatggtagcctggtaggtaattgccgcttcaattataaatgtaaggttccctctgcttttttacatcatgagctcccattttgctcttgactgtgacaacgagctagaagtaacaagatgagagccagacgtaatcagcacatcaaagcaagttgccgacatatccacaaggtttcgctatcttgtctccctagccaatgcatcattccagcaagccttatcatataagcttaatgtttctctcaatatataccttttgctggcctttcccattagtgcaaaagatgaagctggtatatcaatagaaacctaaaaaaatatacgagagactgagctagagtacaaactcttgagttaataaccggagtccaccactagacttgaaaagagctactccctccatcgatgggatatcccacaatatataatctaagggtgagtttgagaagagggagattaataatattgggaagatacacaaaacgaggtgagccattagcgtatgattaattgagtattaactattttaaattttaaaaatggattaatatgattttttaaagcaactttcctataaaaattttttgcaaaaaatataccgtttagtagtttgggaagcgtgcgcgcggaatacaatgttcttttctcacccaatcccccagaactcatcacaaagaacgcagcctaaaactagctagatgaaacatcaccctgatcatacctcctgtctacatatgtactccatcttacactaggtaatgttccatctaaccttaggtttttatattttggaacggtgatgacggtgatagaaaatatagacacatctagtttttttcttgcatgcaacctgctatagattcttaccacactatttttactctcagtttggccagccgggagatttgtcgatccgtcgtctacggatttataagagcaaagtcaatattaaattttgttaattcgattagattaggcagtggcaatcgccaaatggtgaacgattttgttatatcttactcgaaagatttttttcttatctctcacttgattttctcattcaaatttacagtgtattttattgtaagttacaatgtaatttttgaatcttcgcatataagttttgaaatttatattggatttggtttttttcttgaagatatggtaattagtgtccattatggtgtttcttagttgctttttatcttttactgtgtctatttgtgtctattggattttaatccaaaaattaaaaatctttgtgatatgatcataaaaatctttcgaaaaatgcatttatactcccagtggatgactagttgttcgtttgatgaatcaacaaaaagttatataaagggaaatattttaagctcttgagagtatgcacctttgttatgtgacaaatgattacacaaatttctaaaataatacacaatgtagattattgtatcctatatccctccacaaacatatactcattctatccaaaaatctaagcgctcattctatcaaaaaatctaagcagtatttcctttgtcaccgagaccaaagaggaattaactcatgcaaggaggaattaactcatacaccacgtgaaaaaaattaataaactatatgtatgcatgcaactaatgagtattaaaatggctccttaagttctagacaataatttaatttagcacataaaaactataaatatgccatagacttcataaaaataagaaaatgaaaaacgacttagtcttttggatcgtgagagtatatcacttcttttttttttcactaaacacaatacaaacaaatacaaacatttatgctcgtataagtgtatctacatatacaatataaagatacatttgcacaccatatacttatgataatccccaagagactaggccgacacaggccttgtttggaagattagcccagggctaattttaagagctaatgttggcccctttgaattggaggaaaaacataggaattttagaggatttcaattttatagaaaaatttcctatgaagccctttgaaacaaaggattgaatcctatccaatcctttgaaatttctatggaatggacaatcctatagagattttggagaaaatttagcaagagtttcaacctcttggtaactttcctttgagtctatctctctcatcctattcctgcatttttcctgcggttcaatcaaacagtcattcttgtgtttttcctacgttttgcaatcctctattttccacttacattcctatcaaaatcctacgtttttcctattcctacgttttttcaaccctgcgattcaaaggggcccttagtcatgaattggtaggctaaacattagcctaaagtggtatgtttggatccatgagctaattcaagactaaaaggtggagagagagtaaaaagagaggagagagagggagagatagagctgctttttatggtccccacacaaaattagccccattagagcaggttcaatagtgctattaagctggctacaaaacttacaaatcagcttaatctgtgattaatgaaagaaaatcacaggaaaaggaacaagcagcgcttgttttagcgccggcgcttgctcagcgcctgaaactgtagcgctcgcatgcagcaaaaagacgataaaaaatacatttatgtgggtcccacatggaaccatgtaactatttaatgtatatgtatgctttaaccaatgcagcttatagctaacttatagttagtttgttatatgagttgtctccttaagttagctctattttaacatgataaaattttgaagcttgctgctagctatactattgaccttgctcttagcactccttgaaggggctaatgttttgaggggggctaattcactttagcctcaaattagcccacctgtttggatacttgagagctaattcagggctaaatgatgggggctaataattagcccatggaaccaaacatggccatatattaagattgaccaaagtcaaaacacacgctttattattgatggatgtgccacatattaaaaatataattagccgtaaatgcaagcacatgtgttgaatcgaacctaggtgagtaggtcccattcaaccacaagaacctaacaactgtgatgtgctatgctaagttcacatttgtagttgaattgatgtttttctatttttatgtatatatcaatttggccttgtacatttgtaaagaaatttgtgatagtcttttttttttacgaactagcaatcacagtgtaccaatttcgttaaatataacaaaacaaaaataaattgtacaagtatgaaaagaaccgtaaaaaaacaaagccctgagagctgttcgctcctactaggtcaagtttagtcttctctttgattttcgtagttagagctatcacgaagttctttatgttaaaacgctatatttctattttttcacaacttgttgaaccacatgcaacaaatgtataaaatccacttcctgtatatataggagtatgatataaagttgtaaaatgactttctcacctgctttacaactcctgacttcgtcccgtgcataaaatccctgcagaaatgcagcattagaatttgatcggctaactacacgcctttaccctcaagcatgcacccccatgctttcacctaacccatcctcatccaaccaacaagttcctcaagatggagacgcacaagagtagtactgctacaagcaccatatggacatggaatcgaatcgtttatatgtccccagcagccagcctgcttgctttttcccgcaagttgggacttggaaagttggaagtagcatattcacttctccgccacgtcgaatgcgaggttcctgtagtgcggctgtgcgggcgagacgacggatggcgccgcgcgcgcgcgtcccaactacagattgcgatggctggatggctaagctggacggccgcgcgcgcaccgcaccgcaccgcacgagccgtccaatcctaccctgcctgccgcgacggcgaatgacgggcgcgccatatggcgtgccatcccggactcaggcacaaagacaccgcgtctccatcatcggcgccctcgcccgcggacggcgcgcgcacgccgctctccgcaccgcacacagcggcgcacgacgacgcggctttcgtataatcccggacaggtacagggagagggacgtgatcggaagggattaaattaacatggtgggggacctgcgtgcacagctgcactgccgcgggaggattcgattcattccacacttccatagttgcatgcaccgcggatgacatgagccagtgcgtacgcatattgccacatgggaagcgagcagcgggcccagtccagtctgccacaacggatgctatattaactcgattgatcgaatcgatgtccatactggtacggccttcttaccaaaataatactcccttcctcctaaattatggaagaccccatttttttcaaaaaataaaaaataaaaccaggtaacttttgactaattttttttagaaacacagtacaaacgcaggcgctcacaacatgcgcacactgtcgaaacaagatttcggcaataataaaaggggtggctatcgagctaggaaagtggatgggtttggagacaaggaattttatacacgttcaggccttcttattcaagaagtaataccctactcctgtccggggatgattccgccgagtgtgttattgattgtatgattgggaaaaaaaagaatcgtgccccaagaggcacacggaccctccttatataggggaaggaatccgtaatatccatatcctaacggaatatgggattacagataaaatacaatcgtaaccgactaggatcccaggtactttcttgatatacaagtttagaatctaacccgagtcctcataaagatattctatctatatttggtactgtatatccagctggaatataactgccatgtagatatggggtaaccataatctccacagtagcccccgagaccttcgcagtcgaccaaaacagtcttctcgaaacaaaaaataataatccgagtgcttcaattcaacttgctccggcttgccgagtgctaaaagactgtgaagggcgaaaataaaacatggtgtatcgagtagatgcacctaattaagtgtagcccccgactatgtgattagttgaaaaactaaacatatagtcaagaaccgagtggttttacagcgaagcacgcatggtacttagtaagatacccagccgactacttctcaacttgaacatatcaaggacagaaaatacaagaagggctgagtgatgaacactcaaaaggtccaaaaatagacatatttgataggaatccgagtaagaaactcttaaaatgattcaccaaacatgataaaaaatcatggtaattaatgagtctaatagcctaggctgtgacccttaccataactaaaataagcatataacatgctaaaagaatgactatgaataaaccagtcatctcaaatcaacccaaacagcttttgcagcctaataaagcttacaaaaacggtataacacctttctgtcagacaccttttgtttgcatcgtgttaattctaaagaattagcaagccgcattaaaaatgatttaatcagcattgggccacaacattgtgagcacaaattgccaaagcaaaaagtgcctaagtccctaaggatcacaacgggccacgctggaaataaaattgggctgaagtactgtacaggcccaggcccattagcactcccgatactctaacaaaacaccgaagtctaagcgacgcttcgtcttccccgccgagactctcgccatttccccattcctcgctacagtacaagactgcgccgacggagctagggttcaccaatccgccccaatccattctcaaaaatcccacgaaacttctccgcgcgtccaccgcaccgattcccccatctctttccagccttatctcgaaccaaatcaaaccatcagttcacattcatggcggaagaaagagaaagcttcgagagtcagtgggcgccctccgatgtgacggaagataatctgaaggagatggtggcgcacggcgttcttccagcgaaggagatcattgggtggcgaccggtattcggcgaagcattcccgactcccgatacgcatgaaatcgtggtatttgctcacttcttctatggcggtttctcccttccaacctcaagattttttcggggaattctgaatttctatggaatcagcctgcatcatctgaacccagactacatagttcacatcgccaactttattcatgtatgcaaagcttttcagggcattaggcctcattttgctttgttccgccgcattttctttctcaagccccagccgaacaagagcaaaccatgcgttgttgggggcgctggtttccaactcagaggaacgctaagccaaaagtatttctccatgcccttcaagacctcaaacaaaggctggcacgcaaactggttttatgttcaaaaccccgagcctgtccttcccgagtactcctgtcttcctccagtttatcgggatacttggaactcactgccaatgggagatgaagccgcacaagcagtagaactgatggagaggatgataaagctgaaagaacagggccttcaaggagaatagatcacccggcactttatcaagtgtcggttagctccaatcaaagaaagatctcgtacagccttcgaatttgacggcaagcatgacccaaaccgtgaagacccagattctcttgacttcaaggtcatgaaggaaaggatgtataagatcttttcaaatgccatcgttgtcagctactcacacttgctgccagttgtaccgttcaatgcattcaacccccctccaccggtacgcattcatacacttcgacctttctcaaaatataatcttgctttcttgttgaatcagttaacaatgaaggatattacacccaggaatttgctttgatgaagtcggatcccccaatcgctcaacgccgatctccccgccaccaaactgggcaagggagcggaggaccaagaattcggtctgaaactcaaccaagtgcttctgatccagtcggccagtcagattctcgaaagaggaagctggttctaagcgacgacgaagccgatgataccaccaggaggcctgaagaccgagagacgaccaagaaactaccaaaacaggctactccaaggaagaaaacatccagtcgccctgcgccaaagatcaggaagtcttccaggtgcaactcatataacgatccctcttgtattgatgcacacccattgcggcaataatactgataatcaaatttgtaggaaaccatctgatatagacccgtctgggaaagactctgacccgactaacatggacacaagttcttccaaagaaaccgggccaactgttggggatcacccgagtgacaatcagccggcaaccgatcatgtagaatccggtgatccacctccaactgaaacccagttggccgaagccgaagccggagttaatcaggagcccccgactggaaaccagtcggacgcaaggccaaaccaagagattccagaagtcgaaacccaagcagacaaccctcgtggacaaaacgccagcaataaccagagatctggatctcctttaagggcatccgaatccactcgttctcattcagaaatcattacgggaaaacacttttgtctgaaaccatgttgacccaaataaactctgatcaattgtctaacctttgtcagcgaatacattaggaccaatgattggtgatgaagaagaaatcccccgtatacaagcagccgaagattcgtgccctcccattctggtcaagtggtgggatgataacttgcagcctcaaggaattgtaataaaccggcaaaaagaagacgaagaggtctgcctaccgaaaaaggcactcaaccaagcgactcgcattgtaaatgtaagttctctggtacttgatctcaaccatcttgtttgccatttaattcatgcgctaattaaactgtcttgcagaggattcatctcaggaacgaagccaaaacggcaaccttagagaagttagtccctcatctcggaactctcgaagccaccaggagtcaactacacgaggccagagaacttgccaagaagaacgaacacgatctaagggatcggattgctgagctctaggagtccaatttcgaactaagtggctcatcaaaaggttcgcgcaaactctgcttaactgactcatgctgttatctttgcaatcttgattaaccgtaatcaatgtagtgcaagctgccaagatatctcagttggagaagcagattcaaattctggaaaatgacaaggcagaactggcaagacaaagagacctagctctaaaggaagttgaaggt

SEQ ID NO: 64953 - DNA, 773 bp, Oryza sativa
tgggggggtgggggcgccacggacgatcgatcgcccgttagccaacaccgccacctcttcctctacccggccccttccacgtctctgcgcctgctacccctcacgctcccagttggctatggaggagcttcacgttcggatccagctttgcccccaactaaaccagcacttggacgaccacattgagcagaacatcccacaagatcacaaccataagaggctatcttcattctaagcatttttcgaacgattcttccttctaaacattaatcaactgcatctctgcaagcaaatatcaaccctcaaggacaatcgaactcctgaccgccttgactggcctttccctaaataagtaatatgggactattcccaacagccgagcagagcgaccgtcccggcgcacggcgccgatgacggcggctggcatccctactcaccagaggtttgctgccaccccgaacgcggagccgcttggcagcctgcagggagcatgatgcatgggtggcagcggagaggtggaattgtcggaaattgactgccgccgcgagtcgatcgctcgatcgatatggataggggctcagttttttctaagtacaaaactgcccccttgctaatggggggattactctgttaatccacttttaatatccacccattgatgtgctttaatttccgtgcaggtttttatttgagaagcatagtatcacttcccttccctattttcttttagggtgcacaaaaaaaacaggaagaacaaccccacaatctggaaa

SEQ ID NO: 64954 - DNA, 667 bp, Oryza sativa
taagctgattaggagttggcccattccttgttgtctagctaagctcattggatgatagaactcataagagacttggatgtttttcccctgatggatgcgacagaaagcatgcatgggctgattgcagctgagaaaacttccctggacttttggtatctttcatgattgatatcttcaaatctaaagtccgatgggagctcaaggtttgctgaatcttcataaggaaaccaaactcgaacatctttttgaaagccatcatagaaactgcagaaccagtccttgagcagttcagccgataattttgctccggcatcggttggtgtggatgcatattctccatatgacatgcatctgcgatagtgcgctcttctccatcatcttctacaatcggctccagtcttgggaattcggcttctgtcaaagatggccgattgacaactttcatgaccatcagatttaacgaagtctgcaatagccaccatggtccacctgctccaactactgatctgatagctatcttagctgatgcattattcaacatttggtatagatagccgagaaggattttgcctagaggaaattgctttttcgattctagggcttcggctacaaattaccaattggttgtaggaaaaaaactggatcacagaagaggaacttctctagc

SEQ ID NO: 64955 - DNA, 14257 bp, Oryza sativa
  unsure (1)..(14257): unsure at all n locations
aacattccgattatgataacgacgtaacccttgcaaatatcgagtcgattgaattaaagctgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggccggtagcccgactaggagtagtacgtaaagaccaaagtacggacgacagctgatctacccacttgccagcataggggcgtagtcggtcgaaaactcgtgctttgatcccttgcagtatcatgccgttagcgcgctcaacttgtccgttactcatagggtgtgccatggaggcataataaattttaatgccgaagtcttcacaaaagtctttaaatgctccgccagtgaattgagtgccattatcagtgatgatccgattaggtaccccaaaccgatgcacaatgttgatgaaaaaatctctagctttatctgctatgatcatgatgaccggtttagcctcaatccacttggagaatttgtcgatagccacaaagagatgcgtgtaaccgccgactgcccttttaaatgggccgaccatgtcaagcccccagaccgcaaatggccaggacaacgggatggtttgcaactcttgggctggcaaatgagtttgtctggcaaaaaattgacaaccttcgcatgtccgcacaatcttgtccgcatcatgccggtaagctttgccgacgatggtccgtgcagcagcatgattaccacaaataccagaatgtatatccttcaacaattgtctccctttctccaaagatacacagcgctgcagtattcctgatggacttttcttgtacagttcagcttcgtgaataatgtaaagtctgctgcgcctagaaatccgctcggcttcgtttttgtcttgagggagttcttatttggtcaaaaattttatgaggggttctctccagtcggcttcaagcatgcttacgccttgagtatccatggcttcaactgcttcttttctgggcacggttggttcgtaaagatgctcgacgaacacatcagaaggggctgcttctcgttttgaaccaaaattggccagtctgtcagctgcctcattgttatgtcgaaggacatgggtgagctcgagtccatcgaatttatcttccagcttgcgtacctcttgtcggtaagcggtcatattatcatctagacatgaccactctttcatgacctgattgacaaccaactgagagtctccaaggacgattaatcggcgaatgcctaaagagattgcaatccttaatccgtggagtagcgcctcgtattccgccacgttatgggacgcagaaaaatgtatccacaatacgtagctcaatctttctccggtcggggaaattaagacgaccccagctccagtgcctgtaagcctcttcgacccatcgaaatgcatagtccagtattccatcttttcctctggcatgtcttcttggcactcggtccactcggcaaggaaatcagctaaagcttgtgacttgatcgaagttcgtggtttgaaagatatgtccaaagacatcaattctaaggcccacttcgcaattcgtccgtttgcttcgcgattatgaagtatatccccgagtggaaacgatatgaccaccgtgaccgagtgactttgaaaatagtgagataatttcctgacggtaattaagacaccatataataacttttgaacctgaggataccttgtcttggagtcggctaaaacctcgctgacaaaataaattggtcgttggactttttgaatatggccttcctcttcgcgctcgacaaccaggaccgtactcacaacctgggaggtcgccgacacatataacagtagcggctcttgcggatgtggtgaggccaaaactggtggagtggtgaggagtttcttgaagtcttcaaaggctttctgtgcttcgggtccccactggaaattgtcagtcttcttcagcaacttgaagaaaggcatcccccgctcgctgagtcgtgagacgaaccggctgagcgccgccatgcaaccagtcagcttttggacgtctttttgggagcttggcggtttcatgttgaggatggcattgattttctctgggttggcctgtatgcctctttgagataccataaatccgagcaacttccctgacggtactccgaagatgcacttttccgggtttagtttcatcttgaaagcacgaatgcttgtaaaagtttcttctaaatctgcaatcaggtcatccttccgcttggtcttgacgactacatcatcaacataggcttcaacattgcgaccgatctgagttgaaaaacacctttgaatcatgcgttgataggttgctcctgcgttcttcaatccaaagggcatggtgatgtagcagtaggccccaaagggcgtaataaacgaggtcttcaagcagtcggattcttttagtcgaatctgatgatatcccgagtaacagtccaagaagctgagtaactcacagccggccgttgagtcaaccacctggtcaatgcgaggtaacccaaaagggtctttgggacaagatttgttgaggtcggtataatcgacacacatgcgccattgccccgtctttttccgaaccaggactgggttagccagccagtcgtgatgaaggacttcattaatgaagcctgctgctaacagcttggttaattcctccttgattgcgtccttcctgtcctgtgcaaaatggcggagtcgttgcttgatgggtttggcgtcttccttaacatgtaaagagtgctcaatcacctctctggggataccaggcatatcggatggtttccacgcaaaaatatctttattattctgaagaaaggtgtcacgaccggaaataaccaaacgggcgttccttacgtgcgtgtattattccttgtcccaggaggcaaggtacaccaaaagttaatacatttcagagtttaacaagcggaagcgtaaatagttaatttatttcatgggcagcgaaggcccagcacacacaaagacaaacgagaaacagcggaagactagggcgacgaccacaggcgcttgacagcaggcacgagctagacaccaaagccttcatcttcaaggggctcctcttctggggttgggaaaaatttgagcaaggctgagtacaaccaccgtactcaacaaaacacacccacaagtgcagattaaatgcaagggagtacaaaggagttatactataaagggttagggttgcagtaaacagcatttaaagatatttagttgctcaaagctactttgtaaacatgattctagaactatacaatattatttattaaggccatgaactcacacgaacctgccttaacccaaggcctacgatgattcagaccgaactggcaacccgaccctaggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccattgacaagagtaccgacccaacccacctacggccggaacctccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattagatagcgaagcatctacctaaaatcatactagtggtaccatgagtagagtgtccactagttggggttttgcttattctagggtgaacaaggaaatagtaacaataacaataataataaggtcataacaaaggtaaataggcatggctaaataaaacagtgataacgcgggaatttaaataaagcgataatgcaataatttaaatcaacataattttataaactaggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctcttttaatgaatatttgcgaatttcttcatttaaattttaatttaaaaatcggatttattgcgtcagtcgaggggaggagcgcgcggaccgggtccacgggagtggggcccacgcggcagcctcacggtccacggtggaccgggcgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggcgcacccgcgccccgatggtcgccgccggcgaccaccggcgcggcggagcggcgcccgagagaagggagggaagggggaagtgaaacggcggtccacggctcaccccgggtcgacggcgacgacgggaatggcgaccggagcggaggaaggcggcggcgctgctcgggtcgacggggacggcggcgttccggtggtcggcgggcgaaacggaggggtggacgaggtcggcgaggttgccgcgaaccggagaaggcgacgccgaagcgggagaaggtccggggcgacgacggcggcggaccggagctcggcggcgacggcggagagagagagcgacggcgcgagctcgattccgacggggagagagagcggcgagtggcggaacggtggagggaggcacggggagtgtttatatagggttgggagtgagagagggcggccggaggggaaggaaaccggcgcggcgatctcgggctccctcaatggcgccggcgaggtttgcgggagtgtttccaaacgaatccgagggagagagagagggaaaagtgggggggaaagggagagggcatcacggggaatgattccccccactttattgcacgcgggggcggcgggatgcggcggaatccgcggcggcggcggcgctagggcacgggcgaggcggcgggtgcggcgggtggtaggggatgacgggtgggccccacccgtcagtgagggtggcgggcgggcccgcccgtcagcggcgcgcgcgggggaaggccggatgggccgcgggggagaggagagagagggagggagctgggccgagccggcccaagaggggaagggggggaaaagactttttagggtttttctttttataaaaccattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgttttgggacgcgacaaaaggtgatgagcgcgctttcctatttacaatctaactcagcgcctattacagcagtcttgtcaggatcggagggatctaagggaatctttttcgtcttagcatcactttcttcggtcttcgtcagcttggttgtaggaacttctccctcgcttgccgtggtcgcagccagtcggatctcttcgcgggcgagagtggtctcgtgggtttgtgccatctcgcaactttctttgtcacatgtgacggcttgcttgatgtcgctccgtagtgatatgacccctcgaggaccaggcatcttcatcatcatgtaggtgtagtgcgggacggccatgaacttggctagagccggtcgtccgagtatagcatgatatgctgtctcgaaatcagcgacttcgaaacaaacattttctgtgcgaaaattctcccgagtgccgaaggaaactggaagagtgatctgcccgagtggtgtggctgacaatcctgggataacaccatggaagggtgcattactcggctttaattccgtgcgaggaatctgcatatcgtccaaggtcttagcgaaaaggatgttgagtgcgctgccaccatcgatgagagtccgtcgaagcttgacattgcgaaccactaggtctagtaccagggggtaccgccctgggtagaccactcgggcgggatgatccgagcggtcgaacttaattgctgtctctgaccaccgaagatattggggcgtgttaggctgaaccgcattgatctcccgttctgttagcttctgttttctcttggactcataagccaggggtccgccgaagatgtgattaagttctttgcgatgatcttgaaaaccagtcggggcattgtcttcatcatctttcttctttgatgtgccctgatctccgtctgcaggtttgcgggcgttcttgacgtattgctccgcgaactgtttgtagacggagcaatctttggccacgtggttggagttgggatgatgcggacattgggagttcattatcttgtcgaaggtgttgacgcgaggacgttgtcgggaagatggagaggtggtcgccacaagttcttcgggcttacgcttgcgatccttgtggttgttacttccactcccccctgcagtcggcgtgtccttatttggcttccaagtggtgcccgactgtttggacgcggtgatagcatcttcggctttggcatactcgttggctttttcgaacatctgcttaaccatcctaggaggtttacgtccgaacttgccgactagatcctcgtggcgaatgcctttagtgaaggcggcgatgatgacgtcgtcggtgatgtcggagatcttgttgcgttgttcggagaagcatcggatgtaatctcgaagggattctccagacttctgaacgatgttgtagagatcaaactgtgtgccggggcgttcaaaggtgccctggaagttggcgatgaagtgatcacgaagttccgcccatgatctgatcgtgccacagggtagtccgtggagccaggatcgggcggagtccgctagggccacaggcagataatttgccatggccttgctgtctcctcctgctgcgcggattgcgaatccgtagacggtgagccaagactccggattagtggtgccgtcatacttctcgattccagtcggcttaaagccggctggccaatccactcgacgcaggtcattagtgaaggcagctactccatccacgtcgtcatcgtagcgatttggtgaatggcggtgacctcgtgctgcacggtgctggttgatcgtctcgcgaaggtcgacgggacgctggcgaggtggagagtgaggccgttcagctcggcgctccctgtgacgttcgggaggtgagtgaacagatcgtttgtcgtgacccctgctcctgcgactagatcctgtgccggtgatgttgaggcttggctgatgataatcatgagatcggaaatgagggactcggctaccagttggggtgcgggtgcttgcggagttggttggaaccgaggcctttgtctggttcaagatgttgacaacatgatcggcttggttgagtgcgtcttccttgaggagggtgtcgaggagagtgattgctgcaaccgcgttctgctggggggtgcgaaagaccgctgtcccgtcgacgtcttgttgcccaatgagctctctcgctcggcgcccagattccaaggcgcgttgccgtcgatcttcagcctcctttgcaatccgttcgcgatcttgttgctcacgctgtagtcgttctcgctcctgtcgctgtcgctctttctccagtcggcacgttcagcttcttgccgtgcgcgatcttggcccgcttctcgggcttggcgctgttcctctgtttcgttgtcagccatgaatacgccgaagaagaggggcatgtagttatcctcatagctgtcgtcgaagttgtcgaggtcgccgtggtcgtagtggtagccgaaatcgtcgtagtcgaggatctcggttggtcaagaactgacgccgggggagctaaggtaaccatctaactcttccgtcgagactgtcccaagaggttggagtataacgccaacctccctggatctagactggatcggggccgataccggagctcgcctagatctccaagtgggagatgttttggctgtgaagacggcgaccaagtcatcaggaagtttcatcaagattgagggataggactcgtcgtcttgatatggccacggaggagtaaattggatctcgtccgagtagtttgaagccgactcggaagatatgatcttggagtaggcctcgcccgagttcggaataccgaactgcacggggacctggtctctccccgactggttcgaatccgagtcaaggagagagatcttgccgaagtcgttggtgatgaagttgaggctgccgaaccggaacgcctgcccgggagagaaggcgaagtcgtcgatggcagaaacagaacccatcgcacttagtcggcaaaaacttgacgcttcccctacctggcgcgccaactgtcgaaacaagatttcggcaataataaaagtgggtggctatcaagctaggaaagtggatgggtttggagacaaggaatttaatacaggttcaggccttcttattcaagaagtaataccctactcctgtccggngatnnnnccgccgagtgttttattgattgtatgattgggagaaaaaagaatcgtgccccaagaggcacacggaccctccttatataggggaaggaatccgtaatacaaagtacagtccatatcctaacggaatatgggattacagataaaatacaatcgtaaccgactaggatcctaggtactttcttgatatacaagtttagaatctaacccgagtcctcataaagatattctatctatatttggtactgtatatccagctagaatataactgccatgtagatatggggtaaccataatctccacacacactcacccctatgaacgcatacacgcataccctacccctatgagcacctccggaagactggaccggcatatcttgatattaacgaagtcaccacaggcgcctcgctgtcgacgggtatgtcgcctaccactaaaagaataatcaaaccaggtaacttttgactaatgattatattaacaatatctatgctaagtgttatgcatgctatataactaaattcatattttgaattactttcatttgatgctaatttcatatattcattggaaacataacatacaataaattaatggtcaaaatatattattgaaaaccgtataaaaatgtaaaccttataatttaagacggatagagtactatctagtatgcgataggatattttttagtacaataaatctggatagaggatattttctaaatgaatctgattagcctgtccagattcattgcacaaggaaatgttttatcgcatactagataggaacattgtgggatgtgggaagtataagtcagcatcgagtaaggcacattatgccgttacggctgagcgcgcgagcatttttacttggagggatttattcgggtaaggctattgcgcccctccccatataagctccctcctctccccccttcctcctccccttattctctttctactacagtatactataaaattttaaaaaataaaagaacaaagttagaaaaaaatatatatagaaatactatatataaaaaatatttaattcaaattcaaatttaaaacgggtatataaacttttgacttataaattttggatctataaactaatatttgaattcaaattcaaatttgaacgggtatgtaaacttttgacttataaactttgggtctataaactaatatttgaattcaaattcaaattttaaacgggtatgtaaacttttgacttataaactttgggtctataaactaatatttgaattcaaattcaaatttgaaacgcgtatgtaaacttttgacttataaactttgggtctataaactttaggtgtataaactttagatgtatagaaatactatatataaaaaatatttgaattccaattcaaatttgaatcggatatataaacttttgacttataaactttgggtctctaaactttagatgtgtaaacttgatgtgtacaaactttaggtgcataaatttactaaaatagaaaagtaatacggtgtcaaaaaagaaaaccaggtggagggaggggaggggggacgggctgatcgctaggggcgaccgatcgccccttagcaatctcagattgattctcagtatttaatgtttttcatgaaatcatctgtgtagtttcaaatggacttatatagagaaatcaggaatctcaaggataactatccgcgatataggaacaaggattccccaccgtggaaatggggcagcttggtgccgtcatccattcttgagctcctgaggatgtcaccaggtttcttatacaaattatattgtcagcggctcttaattatcaagtaattacaactaacagtataagctaaaacctaaatataaaaatttcaccgaacatcctttgcgtcggggagagactaccttaaatatccgcccctggtaactccatggtccttagcctagctcattggttgatcctccaataccgatatagacatantnnncanatntngaggaaaaagcagttacacaataattactactccctccgtcccagaataactaatctaaaaccggattggacatatttctctgtccagattcgtagtactaggatatgtcccatccagttataggttgctatattctgggatggagcgaagtatactatagctacactagtaacatttaatacaaaaatatttcaaatgttattaagcttattagtcaatatgatttttttttcgtcacgcaaaaggcttgcacaacaataaattataaagagcgaaaacttgttttacacaacgtgcatgagccacaacggttgtcgtgagagatggggaggagaaaaaaatataagaggaaaattagttagtaggatagtaatatactccagttgtgatctaaccctttcagtttctattgaaatagtgctgggtaacggatactccctccttccaaaactaagtgcatttagcagaggatgtaatatattctgcgactatgaatttgataagcactttgtccagattcgtagcattagaatatgtcaaaactaatttcgttttaaaaacataatatgcgataatatcatgctaatatcaagaattaatatctttttaaatgctacatatctgtattgataacgatactgatttgccaatttttggaagtgactgcatttcaaagactgaccaaatgcctacaaatagcaccagaggcttggctcacctactcacttcctcactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgaggtagaaaactgtgcgattgaatactaaacacatgtagaaatagaaatcaagatgcatgtagaattcagtttcttctaaaccaactagatgcatgttctcttgtttgatctgttggtgcggtgcgtatatatcgtgcagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatgcaccgggtggtggcgcagatcgacggcaacaggatgtccatcgcgtccttctacaaccctggcagcgacgccgtcatctccccggcgccggcgctggtgaaggaggaggaggccggcgagacgtatcccaagttcgtgttcgaggactacatgaagctgtacgtgcgccacaagttcgaggccaaggagccccggttcgaggcgttcaaggccatggagaacgagacccccaaccgcattgccatcgcttgatagcgtgtgtaccacagcgacccctaccgggtcggtgtcagtaaggtttagtcgtgttcgtagtgatcagtgcgtgcatggtcagctactcagctcgcgttttctacctgaataaattaagctccgtcgtcgtcgtctcgtcaccttggataattgtcagttggtgtggcgtgctgttgcacgtacggccatgtatctttgtcggctgtcctcgtgtggtacttgatagcttgtgcggcgtgctgtaccgtgtacggtttattatctactccagttctatatcgtggtgatttctgataattttcgtttttgtgttacatagcaaaagtgcccgtgcgttgcaacgggaagtgtatagaccagaaaatatgcaattatttaaaatataaatttgctgaaatatttggtatttttaagtaggtatatatataattaaatcaatttacaagtaaaacaagtgtgagaaataaaatgacatgattaaatttaattttattaaatactccatgattagttacgctctttagaattttattggaattttcagagcttaaattgctaattttaataatacaaacatcatttaacaattatttaattggaaaaagaatcaaaatccttccttttaggtttgggccgaatatggaaaagttcatctcgttccctcttgtctattctatgtggctggcctgtttccttcagcgttcaagtccattttgcatcctctgctacgcgcggtccatccggctacccaacaggccaacggtccaacgcgggagaagttggagccatccgatcgaatggacggtccagattaatcctaacctaaataaatagtgggcacccaaaattaatcaaaacactaaccctagattcattcactcccatcccccctcccaccgctggcagcctcccccgcccgacgccacatgtccccttctccccaccggcgccatctctcccctctagtggcgcagcttcccttcttctcccctctccccactggcgcgccgctccctctccccctttccctcccatctcgcctgcacggcgcgacgatggcggggtgcggaggagacgacggtgatagtcgtccctcctcctcctcctcctccctctccccgtcggcctcgatggccgtcccttc

SEQ ID NO: 64956 - DNA, 1044 bp, Oryza sativa
tcaattttcatttctttttatcttcattttttggataacccactttaagaagcatcttttaaatgctttgatgtctgtaagccaggatgaaaatataagtgggttggtcctacaacctggcatggggtaaaggcatcaattataaattatctcgctccaattaagtaagaaaaattaaaatagatgtggtagtatttgctttgcaaattaccactaaactagagcatcatgtaataattatatgtttctagattgttctatgttatgtgtcacaaattcacgatgtactgtagcaagttttacaaaaaaaaaatggatatagtcttttaattcatatctgtaattggcttatatattgctgaggccacatcatgcttgtttcatacttaagattccttggtgcaaccaacacgctcagtacaatcaatcagtatgctgttcaactagccacgtgacttcatatattatatatataatttagatgctatgatcacttgagattattgtttatctcctaaaatgatcatttattgataaaagcttcaatatcaaaatgtatggttaaatagctcctatatacaagctgagaaaaagttgatagaaagtcgttagatgtctaacggggtataagtaatgggtctacccgttttataaaagataagctgggatattttgatttttggtgagaaaatttagtattttcttttatttagggttaaatttgctaagcgacatctaaaaaacgtgttattgggcggggacacagcaagaacgtgtttttggtgtaggacacccaaaaaactggttattagctacccccccgttaaaaccctttttttttttttaaaaaaaaaatttttttggggggccccccggcggataaataatggatgaagggaaaactagcatgggtggaaccatgaattgggcaacacgcgttagagttatgcttggagctgccccaggtatgcttccaatagaagacaatggcaaatacgcaaagaaagaatctatgctatgccactgaattatcccactttaaca

SEQ ID NO: 64957 - DNA, 2656 bp, Oryza sativa
ctgttctcgcttcctcgcttctgatctcttgcgagcacgagagattggaaggagcagtgcctccgaaaccacaccttcacctgagatctgcaccgggtaggcggatgatcaggttttttgggagtgcctcccgcacgactgctcgccatgtctggagttgccgccgccgctgctggaggaaatggcggaggtggtgcgccgccgccaggagctggagccggtggcgcgaacaacaacatcaacggaggcaattctgcctcataatccagcggagggccattctcggggtatatcattctcctgttcctgttcccactgttagcgctttactgctatgtgcgctatgttcctgttcctgatattcatgatgcctctagcatgttattgcgttgctgtaatgttcctgttcttcacattcatgatgcgcatagtatgctactggttatgttaagatcaacctacactgcttatgccatgattattgctttaacattttggattaaaatatgccgattcttgaccatatttccaacaatccaaaaacctgataggtcattttcggtagttggctttgctgctgcactgaaaccacatgcttttgatggttctaactataagagatggaaagcccgtgcactattgtggttgacagcgatgcagtgcttctatgtttcacgtggcaaatgaagtgaaccacctctttctcctgaggaagaggctaagttcgaggcatcggattgtctgttccgtggagcattgatcagtgtactcgctgacaatatagtggacgtgtacatgcacatgccttctgggaaggacatgtgggatgcacttgaggccaagttcggagtttctaacgccggcagtgagctgtatgtcatggagcagttctatgactacaagatggtcgatgaccgttctgtagtagaacaagctcatgagattcagatgctagctaaggaacttgagaacaacaactgttagttgccggacaagtttgtggcgggtggcattattgccaaattgccaccttcttggtcggactttgccacttctctaaagcacaagagacaagagttcagtgtttctgatctcattggctctttgggtgttgaggagaaggcgagggcaacggacatccgggaaaaaaaggttgagggaggttctagtgccaatatggtacagaaaaagaaccctcatgcatcctacaacaacaagaaagtcaagcctgatgtcaaacccaaggctgcaaccaactttaagaagaaaggcaagggaaaagcaaagggagactgctttgtgtgtggcaagtctgggcattgggccaaggactgtcctgagcgcaaagacaggaagtctgccaacatggtcattggcgagggcggaggaacatcggggtacggtaaaatattacctacagttctctctgtttttcactcacctgattggtgggtggacactggtgctaatattcatgtatgtgctgacatttctctgttttcttcttatcaggtcgggagaggttcctccatgttgatgggaaacgggtcgcttgcggctgttcatggtattggtacgggcgatcagaagtttacttcgggaaagaccgtgcagctgaagaacgtgcagcatgtcccttcaataaagaagaatcttgttagcggctctctactttgtagagaaggttttagacttgtgtttgagtccaataaatgtgtcgtatctaaatatgggacttttgttagaaaaggttatgacagcggaggcttgttccgcttttctttgaatgacatgtgtaataatcataatgttgtgaaccatattagcgagaatgatgagtctaatgtgtggcattcgcgactctgtcatgtgaatttcagttgtatgacgcgcttagctaacatgagtttaattccaaaattcactttgatcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattacactagattttgttatgtgtatatattgaaaagaaaggatgaagcattgcattactttaaaatctataaagctgaggtagaaaaccaacttgaaaggaaaatcaaacggttgaggtctgatagaggtgaggagtatttttctaatgagtttgcatccttttgcgaagagtttggaattatttatgagaggatgcctccctattcaccccaatcaaatggggtggccgaaagaaagaaccgtactctaactgagatggtgaatgccatgttagagactgcggggctttccaaggaatggtggggtgaggcagttttgactgcgtgtcatgtcctgaataaaatttcaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggag

SEQ ID NO: 64958 - DNA, 7555 bp, Oryza sativa
tcagggcttctgtcctagatccccatccatttgtgcctatgaatcatgttgcttctcagaacagatggtaaattcaatatgcagatttatttactacagcaaaaaaataacactcaatatgcagattagttttctattaagcaagcatgtataactggaaatgtgcttaggacagaggtgatatattggtaggaaaattcctatccagattagtttcctattaagcaagcatgtataactgggtatgtgcttaggacaggggtgatatattggtaggaaaattcctatccagaatctggtatagcgccactgtaaacagaaactccgtgtgtgtttatttctacttagtgatcctggatcctgctaatatttagaccttgagatcctgctaatatttggaccttgaattatatcattcctccacatacacagcctgttgtaactgcagctcttatctgttctctctgttcttaccttgaattatgcagagttttgcatggtcaaattagatagccattaaaaaaactatggtatgttgcttctcagagcacatggtagattcgatatggagattcattttccagaaaaaagagaggcaatagcagattagttttctgtaacaaaaaatagcacatcattttctgctggcgataggaatttgcccagtaattctgtggcatgctgccaccaaagtttagcatgtgtctttcgtgttgctacatactagaacatattacctatgtgattaataagatgaatatatcacgtttggtttgtcggtttaattaggtggtgtttatagttcatcctgtgatgccttggatcctttgtgtggttcaccgtaggcatgtggttgggtgcgtgtgtgccatcggtcctaacgctctatggcccacctggaaatcaccttggtccatgctgcgtctggcctatgtagctctctccctgcctgacagccttgacttttggtgcacccccacgtttactcagcatagcctcatgtttctctatgcgatgtcactatgtgcgacagtgcgaggcaggcacgtttcttcatgattctcctaccaacgtttggtccaccgtaatccctggtcacacgagtgctcctctctgcctgtgttttgtgcgctaggagcacgttcatccagtgcaacgaacggattggacaaattacctactggttattacattggataaatgatggacatgcacctattcattgcagagccaatgacaggtggggtcggttttgtgggttgtcccatataccatgtgttatgcgtatccaagaggccgtgagtctatcgtgccatgtttttctaagcgccgcgtgctacagtgtctgacgtgccgcgtcaggccacatcaaatcgtcctgcgcacgagccgtaccggcatgcgcgcaggcatcgatgcatctggcatggccctagcctttcctatcgttcctgttacccggttagttaatagagattgaggccattcaaacagctgcgttgcttcggatgtcttcttggctcttctctcatctttccccttttcgctcttacatcaatggccaacactaggtaatctgctgccctgatttatgctccatgcctactgttctgaatgtgtgtgcgtgtgcaggggggatcgtggatgctgcgccggtgctgctgcttagaatttgcctcacgcctctagggtgctcccccagccacgcttccacgccgtcttcctctcgaatttcgcaggcgtggccctcaccaatctaccccataatttcctgcctatttatcgatgttagttccaattgttatatctgtgatgtataatgtactctagattatgcattgttctccacaaacaatgttaacattcaatctatgtattttatgtctacttaatccatcactggttttcctcataacctgaatgctatagctagtggtgctacagccaatccactgaataggctcttcagggcctccttatttattttcctcatttacacagcaagggcgccgcgaagcgcgccgtaggttctagtttcgtgaacgacatgagccctcaccggcttggttctgtccttcgtcagattaattaacaaacatacattcgatccgttcctcggtgcacgccatcctcagcctgcgcgttcagcaaaacagcacatccagataggctcattagatgccttcacacacaaaactaaacccaaattctccaaagatggcgccgctccgtgttgacatgatcagcacaaaagtactttggtagagtagtagcttacctctgacgacgtgcgactggtgctcgtcggcgtggccatggccatggccgtggtgttcgtgcagcttcaccctgttcttcttgagctgctccctgacgaacttgtcgtagatgaacgacgcccccctgaactgaggcagcaccagccacgccacgaacaggaccttcgcctcgtaccataacggtatcctgcaagacgacaattaatgtggtctagttctgcaatctgcatacccgtttgcagagcagatagaggcggtgccacgaatttaattaccagtacaagactttatggagtgccatttccatgagggtgatgagggagtacagtatccagtacaccagccattgctcgtcgtccaccttggacgtgctctccatcgcgcagatcgacgcgtacctgatccaattcaacactcttttatactcatccaactacaaaccaacagtctgaaaattcacaggcagcgatgtaaagtaaaatcagcagcctaacagagtaacagactagcagtgttcacttacagagggtatattagtgtcagggttggcctgcatgtgaagcatcgcaaattagccaaataaatgatcacaaaacgaaatgaattagaatttgcaattctcgtacatacccggcaaaagcatggaggtggctaatgagtgcccatgttttacccatctctttccttccgatatccaaccaaatcactcaacgaaggttgattttggagtttgatgggctaggagatgggacgcgaagagatccagtagcataggccttagcttgcttgagggaacggggtggttttatacggtcgcagccgcgcgctacaagttgacggcgatgcggggggatggcatcgggtgcctagcttggacgtggcgtccaaggcggggtgggtcggagcctggcccgaccagatcagccgggctcgaatcgctttgcgtggcgagtcgccttggtgcttcgccctctcgggccaaccaacacgccgtggtgcggcttttcatgaggccaggtggccatctcctctttttttttcccctcacacattctgtcttaaaaaaacaaatctagcatgacacatcatgtaccattatgttcatttttcatattatggaagaaatataatagagtacttgtacaaaacatacttatactaggtttatgttattaccttactctcttaacttttacattatcgtttttcacgcacacgtttcctaaactgctaaatttatagacaaatatagtaatatttataatactaaattagtttcatcaaatcaataattgaatatatttttataataaatttgtcttgagttgaaaatgttactattttttttataaacttggtcaaactcaaagtagtatgactttgaccaaaattaaaacgtcttataacatgaaacagaggtagtattagacaaactagttgggtggcccgcacaattgcgcggctaacacacaaacaaaatcatatattttttaagtatgattttacttaaaattttttaaatagctatctcattttcttaagtctttgaaagaccaaaccttatcatccccgtgtttctaattatatattttttaaaagtcataccagttgatatccttatatcatcttcttctttatttgcttgctcgatctaccactatttatattcattctcctttgaatctttaaaaattggcgtccattgtctcttctctttattgtcattgagattttaaaaatcgaacataattatcgtttgggttcatttttactttttagaagtcccgctaacggtttagccattgtactcctctacggctcacccgctatctcccttctttattgtcattgagattttaaaatcgaacatgattatcattgtttttttttttactttttagaagttccgaacctttaaaaattggacttgtagtttaatttttagaagtcccatcaaacgatgccactatgcccctctacagcccgtctgccgcctactctttattgtcattgtgattctaaaaatcgaacataactatcgttgcaattcattttttattttctagaagtcccatcaaccgtagcaactatactcttatacactccacccgttgcttctcctttttattgtcattgagattttaaaaatcgaatatgattaatggggtttattttttttacgttctggaagtcccggcaaccgccttacttgtttgcgtcacggcatgcctgacgtccctccttttaatcgtcattaggattctatttggtgtttcattaacaatttttatatgtcgtatcaaccgccaccactctactcgtttataggcctgttacttaattgatctcgttatgtgttttagatggtattttctttcaatagtctttatttttatcacaaattttagttatttataaattttattcctaattgtaatcttattttttttctaatttcagaatttattttttttaaaaaaaaattagttaatacaatagtattgcgttcttttaatgtttttattttttttattttcaatttcatttgtttcaaaattgtattcctacttgaagtctcttttaatttttctaattttggatattattttattttttattcgaaattttaattaatcttgtattgggttcttatatgatttttctttcaatattgcttacttttaattccaaatttcagctaattttaagttgtattcctacttgaactctttattttcttttgctaatttcgattttatttttatttttattctgaattttaattaatctcgtattggattcttatatggactcttcttttaatattcccttttttaattccaaatttcagctatttttaaattgtattcctacttggactctcctttccttttctaattttggattttattttatttttatttcgaattttgattaatctcgtattgggttcttatatggaaacttctttcaatattgcttttttttaattccgaatttcagctatttttaaattgtacttctacttggactctccttttcttttttttctttttctccgattaatgtgagaatttctagcccccacagtaaacgtggtgcctcctttcaaacctgttttaataatataatagatagatagatagatagatagatatatagatagatgatgggtcctcgaggctacttcttccctttcggaaatgccgttgctgggccatgaattgtgcatatttgagttgtgggcttatgcctatcgtatcgtagcttcacacaatggacacgcttcgtttcagtaaagcaacgcctgaagcagacgcaacagaatgcaactgatcaggcacaagcatacaaaggaaacgtgacctgtagctacacgaactcacgaagaactcgcctgttgaatctgcaacctttcgttctcgtcattgcaggatactgtgcaaaacctccaacagactaccagccagcttgacagcactatgcactatactgtagagtaatagtactgcccaggcccagctagtactggcccagctcggctgattctttgtggataaatatatttttaataatgaaatataacatctcgatctctgcttaatgagctataaccaattattacagcctaacactcagaatgaatacagttcaaatagaatcccttctttctataaagttaatgccaaaagctcaaacctcatgcttccacgtcatcatcaattgtaaaccgttagatgaatgcattagattgcttcccagccgttggatggaacgcagtatagagcccaatccatcaggcaccgggtgagtctcttcgcctcctcagtgccaaatgtagcccacatgaacacattggctcatcttcacacacatctacatgtatcaggcccatcaatccgtataaaagagctttatagtcgaatgcccattcagttaaccttacaatttgttaacttatgtcaaaccattttgcttctttgtagcttatactttgaaagttctacctaaattatctaaaaaatttagatagggttgctaaaaagaatttctccaagaaaaccatttgtttcttccgtttctttttgagattgtacctcctatctaacaaattgatgttaaccaaatccggcagcaacgcgcggggcatcctctagttatagaaataaaagacaccaatcatgaagaagaaacaaaccaaagactactaacccaagataaagagtacacaattgttaaattatgtttgcaaacctacatccgaaattggcaaacaattgcataatcgttgtcataagattacgacatgcaacctttaaaagctcaccatcttcatcacacatttgcagttgtgctcaagacttaagccaatgtgttgccttgaaaattacctgcatatacgaaacatatggtgttttataaaaaaaaaagatgttgaatcgacttatttttcatacataaacaacatttcaaacttccatttcaattcctccttgccaaattatccttagttaatagaacctctttaagcaagtaccacataaagatcttaatcttaagaggcaacttaagcttccaaataattttatttttctcaatatagccattatttattaaccctaaatatattgaccgaacagaaaactggtcattctgatgatagttccatctaaaacaatcactccattgattcaactgaatatgcacaatagaatcacataattcatgccaatttgctaaattctgaccaactaaagctctcctaaaagaaacatttagcggaacaaattccataacattagcaattgaagaacttctctttcgaacgatagcatataaagatggatacttatctttaaaagccaagttacccaaccatttatcttcccaaaatctggtttgttccccattattcacaatccaagaacccatgtttaagaaagtattcttaaccttcatgagacctgacaaaaatgagaatcaccatattttctatcaacttggcttatagactgattagagagatattttcttttcaataagtcctgccaaacccattcctcatttattaaggcaactgaagttgcagcaagtttcttctcgtctccatcaacgaggccctcgatgttgttgtggctgttgccccaccagcaaaaaaggatgaaattgaagatgccacgtggaagcatagaatgtactcccttcgtttcaggttataagacgttttgactttgggcaaagtcaaactgtttcaagtttgactaagtttatagaca

SEQ ID NO: 64959 - DNA, 2073 bp, Oryza sativa
taaaaaaccaggactacagagggttatcaaccgggactataaaccctttctccaccagttatttatataaataaatttttccaactttgtttttttattttttaaaaaatttatggtgtagtaggaagagaagaagggaggaggatggaggggggggagaggagtgtacaggggatggggatcgatcgcccattagccacagccgttgttgatcacaccggctatactccatctatctattaaggctcgatttatcatgcatggtcattaaaattctacttttgactttattagttcctcacatgatatgtttttctaagtactttaacgcactactatagatagggtttttccatacggctgagaaccatctttccatctttccatgacatcatttttgcatgcggacctcttaagagacccgtatgggaaaatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatataggctccaattcagaaatttacaatacaattctacaatcaatcatcggtgccgaatcagtcgatttagcactgctttccgattcatcaagaagcaggaaactaaccaaaaacttacagccgaggattctcaagggcctcaaggcctgagaaggtgagcgcgcgccatcgttaattgaagctgcacccgcacaaaacaaaacttcagcaatcctcgcagcgcaataattaatagcactggagatctacggtgaatcggcgaggtcgtcgtcaaatttaagtaattattaattattttcctatcatttgatttattgttaaatatgctttcatgtatatatataattttacatatttcataaatttttttaataaaacgaatgatcaaacatgtgcttaaaaagtgtcaaacatttagaaacggagggaatatttacatgtaaacttatagatttgtatttaatgagttttatagttacataaaaggttagatttccacgcatgagcagccacgatttctgcagcctctctctgccataatctcgcttttgtaccggtcccacgcctctcgccgtacgtcccaatttgtacttatcaaatcccagattacattactttgtatacttctctggatcacaaataatcagtactgcacatatttacgcaatatatagtttgaaatatgctaacatatattgtcaacttcttctcaaaaagttattgtttgatataggagctagactagtcgtcgactagctactagctagctagcgatcgacaagcggaaaattgattttacccgagcaacaaaaagaaggaagagaaaagccagccatatatttatatctttcgtattttcttagcagcaaaagcacacgactgtgtgcacgtgcacgtcgtcgtcgttacgcggaggaggctcatctaacttatactatagcttcctctaacttcagttggtgagagatatgtgtcgcttatatgtgaacccataaaaataggttctacctgttagggatctatgtctctgtaatttaaaagtcagatgagttcctttcgcattacgcccaacggtcctttccgaaggagcacaatttgtcaatttgctagagtcagttaaaacccgtacggaaggtcattaataacctacgtttacatatgatgtacgcagctgagaaaaaaaaacaaataattcattcattcggtgctccacagggttattactcttgtaatacgtaatttaatactactcttacatttagaaatggagagtttatgtgtgtgtatatat

SEQ ID NO: 64960 - DNA, 2009 bp, Oryza sativa
ccaccgaagcgcagtatctcaaccgcccgagccaggcgcaagtcgtagcgggcgccagatccatcactactggccgctccacagtcgtcaccagccctggatctgttgcctcctccgcccaccgtagtcgccggcgccggattgacagccggcagtccatgcaggcgcgagatcgactgctccaccacctgttgtcggcgccaacgctggatccgccagccccgccgtttgcgcaagggaggggcgcccttggcccaaaaccccccgggggggaaaaaaaaaatttaaccctccgggaccaattggagcacggttccgcccctacccccgtggcggttagggggggagggttgcctcgtcgtcgttgtcggcgttggcagtcagaaggggatgtcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagagtggagatgggttggaaaaaatttgatgtattgggagcgaaaagagggtgtagggagatgaaaaaaattagggttgtatttttgtatgcggacctcttaaggggctgcatgtaaaaatatgagaaatttgaatcgaattttatggtactaaatcaacttatgtgaaaaagttatcaaaaacaaagttgtagaactcattgagatctacctttttcttctggtcatctctccatccaagtttgattgaactatataaaatttaaatattaaaatataagatattcaaataatttttcgggtagtaaatgattttaaatgaacaaattgttaacaacaaagttgtataacttatcaagatctacaacttttgttttgatcattttgctatttgactttgtttcaaatataatttgtttttggggaaaaaaatttttttttcccccgggggaaaaaattttaaattatgataacctcagacaacattttgaagtactaaacgatttcaactaaaaaagtcgtgaagaacaaagttgtatataactcatcgagatatataacttttattttggtcatttcttcatctgacaaagtgatagtaacattattcataaaatttacacatctcttatatagttttataaaataaaagaaagatatgtaatttttgggaaaatattactatcactttgttggatgaagaaatgaccaaaacaaaagttatagatcatgatgagttatacaactttgctgttgatgaccttttcagctgaagttatttactacttcaaaatattatttaaaattttgaaattcaaatttttaattgacaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatattttttttgaaagaaagataaaatata

SEQ ID NO: 64961 - DNA, 4203 bp, Oryza sativa
atgtggcatcttcaatttcagccttttttgctggtggggcagcagccactacagcgtcgagggcctcgttgatgtcctgacttgcctcagtcacacgcttatcgacaggggcatcgtgggccttgttgatggcctgtcttgcctcagtcaagcgttgattgacaggggcgtcgcattccacttgcactaacacggctgatatcgcgatggctgcaaggagaagggcgacaactttggccattgccaataaaccgaacaaggattattcaatgttggaagatattgctactgcgggtggataagttgcttgagtttctagggatcattggggctttaaatagggaaacatgtaccattataacctaaggccaagagggctttacggtccaaaattggttggttgcatgcatatgtgccaagtattcggtccgtagtgcatgctctcccacgtcttaaccgttgtcagccggcgtggggtggcgtcgggcaggcgacggggagacagccgtcgggcggcctgggacggcgtcgggtggcgtgggggcgggcgacagggagacggggaccggagcaggccggtgccgggagatgtggcgcgcgacggcgggagcacgggcggcgcgcgctggtggcggcaaaccctagcgccgcgtcgaaccgatggccgggcgctcggtctcgcgaaaggggaacgggaaagaaagaaagtgcgaatcgtttttttccataatggtataggtgggtaattttacccctcaaaagccagtgaaagcaggggtagggactgcttttggatttgtactacactaaaagcagctttggagcaaaagcacttgtggcttttgggccctttggttggcttttagcttttgtaaaagcaaaagcaggttgaaaagcccaaccaaacacaccctaaacttgagagaaatgagagagctattgcttgaggtgtgtgtgaagtgaagagagtgagctccttatatagagctagttatgacggttgtggaagagaaattgtccgaagtgccctccaaccgtcattgggatgcaatcctggacgtccacgccaaaacttgaatccaacggcgccaggattggttcggccgaaccaccaagcccaatccagcccaatttcggctggtgacctcctctattgctccactccgcagacttgtgaattttggcccaattcatcgtgtcagttctgagttcttggtccatctattcataagtctggtactcgacattgtccgattgatttatcgtctgagttgatgtcgattctcctctactttatgatcattctctgcaaaaggttagtaaacctaatactagtggaatattattattctaacagatttatgcattgcaagcatcactagttctcctttattttggtagtatcgacggtcgagactgatcgataacgaccgtcaacggcatcaaacttcattaatgttacttagggtgtgtttgtgaggaggggaaagagaaaatacgtaaaaaaggtgggtcattagcgtatgattggttgagtgttaattattttaaactttaaaaaggattaataaaaaaattttaaagcaacttttattatttttttttgcgaaaaacacatcgtttagtagtttgagaagagtgcgcgcggagaacgagagagtttttcccccgatgccgaataaggccgcagcctaagaggttataaagcaaagcagaagtgaatgtagaggacatcgatggtgaatatgtcagattactcgttgaaggttacagtgaagtgggtcgtatttgggataggaagtgctttacacttggacggcgcggctatgatgctcttgttctagttttagctgctcatatagtacttacggcagagaaaagatatggcgggttgtcgtaagtcctaaatagaattcaaacgaaaaagtcatgcttttttactgaagggtacgctgaacagggagctacgtgcataaatatttctttgattaactctgcgaataggtccagcggctacaacaagaaggctagcgcagctgtgctattgattcaaggcggtttgcaacctatcaaaagtaagatacctaagaagtgagatatttaacatggaggttttgggcaaaccgaaaggtcttgcagaagtcctatggttattttacatggacgctccgcaaacaatagtcacctaacaacagtcttatatgtgcgcatatatcgaagtgttgatgatcgcaggctagtctggtttacgttacttcttacatgagatatttttactccatacttatgtttaaaaaaaattcaaatgatttcacagttgcctgtctagcagccactttgaaggattcttccatcactttaaacttctcagcaggtgcggctgtgaggacagcattagcaacattcttgtaggcaagtgaagctgtagcaagtttcttctcatctccttcggccattccgagagcagcaaaggcgaacattctctgcttccacatggcatgttcaatttcagacttttttgctggtggggcagcaaccacaacaacatcaagggccttgttgttggcctgacttgcctcagtcaagcgcttatccataagggcttcgagggccttgttgatggcttgacttgcctcagtcaagcacttatcgataggggctttgcattccacttgcactaacacggctgataccacgatggcctaaaggagaagggtgacgactttggccattgccaataaaccgaacaaggattattcaatgttggaagatattgctactgcgggtggataagttgtttgagtttctagggatcattggtgctttaaatagggaaacatgtaccatgataacctaaagtcaagagagctttatagtccaaaattggttggttgcatgcacatgtgtcaagtgttcagtccgtagtgcattctctcccatgctctctcaccggcttcatctctgaccaattttggttaatgtactgatccatgttgacaagaaggcattcgaacaacgattacgatcccaaatggacaaacagaggaaatactccatatttttcacaattagttgcatgatgctttcacctagcaaaccaaaaaaaaagcgtaaattacactgacggtacacaaatttacgatataggtataatctgatacataaacttgcaaaaacacttgttttggtgcacaaacttatctggtacgtgtgattgtgtgaacctaagccaaatgagcatgctatgattattagtacttagttgaatgttcatcaggatatcatataggcacaagatatgattagactatctagatatgtatgtactcagccaaatgtataataagggacctgagtaatataaaatatagatgaaggatgcaatgaattgaaaacattggtagaacaaaattaaatatcaaatagaggctattcgcacatgtagcgtgtatcatgaccccttatgtgtgctcataccattctaagtagactctaacttataattattagttattgtctgtcgctgtgatcttgtttcacgtattaaacaagttcatgtactgaaacgagcgttttgcaaatttgtgtattaaattgcaccatgttaagttcgtatatcattgatgtaatttactcccagaaaaaaaaaactcagttgtatgagaactataaaaaactttcacatgtacccaggttgtggctgtatacatccttaaggatgtagtggccggattttatttaatctattatctaaaaaacgtgtacccaggtttagttacttctcttggactaatatgaattccaaagctcaaccctcttgaccagaggcatctctttgatgtggtgcaccgtcattgtctcgatgagggtcggtcatagttgctctaagaccaaacaacgcctaggctacctatgcaggatacaggaggtgtttagatttaagggtgtaaagttttagcgtgtcatatcagatattatatagggtgttgcatgggagtattcgggcactaataaaaaaactaattataaaatccatcagtaaacagtgagacaaatttattaagcctaattccgtcattagcaaatgtttactgtagcaccacatcgtcaaatcatggagcaattaagcttaaaagattcgtctcacaaatttagtcgcaatttgtgtaattaattattttttagcatatatttaatacttta

SEQ ID NO: 64962 - DNA, 4467 bp, Oryza sativa
gcaccccaatcccgttgtacaacattgctacgctaggctgtcaggcattatgcaccatcaaacatgcatttcagtgctccatgcattgtacttcagtacctaggcttagctagcttggaactgcctgcagctagctcagcatcacttcatcagggccacgccacacaactgcactcgaagtgctggatgcatgtagcactaggagtgtattactcgcagtatgtagagccggacggccggccgatcgaaatgatgagcccatgattaattaaccaatccagcaccatcctagttggcactcccgattaaaaacgacggcagcgagtacgtacaaacggtaggtacacacagctacgcgaaattaaagcttgtagtacacgaagcatatatctagtatgaacagttgaacacacccaacccaacccaacccaacccaacccaaccaaccatccacggaggaaaaaaaaagagatattctcacgaaagagatcgaactgttcgagtacgcacgtacggttaggctgtcacattcggtatgcgtggcccccggcgaaagtagggaaagtacgggtccggttacgctgggaggactgcgcgccggctagccgctaggagtcatcaccctggcccgtctcgcgctttttctgcttgcccaccaactacttctacagttctactagtactcgtccggtagcgaggacggcacacgccacacggccacacgatcactcaccgatcggctcggccgcggtggaaagcagctgtttcttgaggggccagccgcgcgcgcgcgcgcggcgccggcggatgcgggcttcctcgacccgtgctgcctatcgggctatcggctatcggctgcagcacggcgaggcgaggggactcgcgcgcgggatctggttgggttgcccgcggcttgggctctccgcggatgcatcgccgtggcctggaggaggcctggaggagaggagtggagtggaggctggagctagctaagctagcgtgggttgtcacacgtacggctgatgtgacggagcccgtcggcaggtttggtcgggccgcgtggttagttatctgattgttgttgatcccggcgagtttatgtatgtgtcgcaacggagtgtacggtgctactcgttctgtccccaaataaaccaacgtaggagtatctggtaaataagttagattggtttattttaagataaaaagagtatgttctgttcttggtttgttttgtgataaatgtagcactccgtaacttaatagtataggcagcgagagaatgtgatgtacgcaatatatatatgtttacgtacgtctagagtcttggttatggctctgacgagtaacaaacggagccaaagttgctaattacgtgcatcggagcgactggatcgctgctgtaaaattagccgacgtttgtgcttttcatcgaccggattgcttctgcaatttgcgcactgtgggaaataagtgaagtgggggcttgagatcagccaattatctttgaggatgtgagctagggttcatcacttttggtttctcactgagctgtgggcactgcaaccttagaatttgttttttcctcttgtttattttccaaatctgcaaagccaccgacagttaaaagagtaggttgggtttcaataatcatttttttttaaaaaaggtaatgaacaccaacaaaacctcaattagggcagctatgtggctctagtggcgagatacgtcatgccattttgagcgttactgggttagttgcaatcaaaatactagaaataagcattagactatctaatcaataaacaatcataacaaccgaaattttgcaactctctcaatctgtaaccaatatgtgtatacgagttttgtaagaaaacaatcaagagatgtatgcaacttattttttaaaagggaaaataagggagcacaataacgtgttaacagtgaatcacagtgttttgattgtttggaaaccaattaaactactaatgagagtacgcaggtacagtaagcagctttgttgggaatgaatggtacggctgcatgccggccagtacgaaaaatgcggtacgagcagacaatctcatcccttcccgaggtatatgcatatgcggcttgaaatggtccatccaccgagagattaaaggaaatcatttggccattcgtgtgcaaaatttatgatcctgatccgagatcgatgtgggcaatcaatcattggtgtcctaatttgcagataagttcagagatggatacagaagagaatactctcaacacaatgataggttcagataagtagatgcctgctagtagggacatgctactgctagggacatgagacaccgttctttagttcagatcttggtcggctcccctgaatttgcgctagctttggcatcttgtttggttcaatagggtggtttgacctgtaattaattcatcatgcttccagaaaattattgttgtagagtttatttagcatatttcagtttaccctgaggagaatagattaaattgcctcgattcatctggtgactccactggtccaacgctgtgtagctcattctctgtttggaccacacgcattgacagggattcaacattcaaggggattaggccatgtacgactgcaactgtgtcgttttgaggcacagttggatttttattaattggtgagaaggtaagagaacttttttttacaaccaaatctatgaaaaaagaggtagttccacaaatataaggttacaaatctttcgttcaagaaaaaataaggttataaatcaacaagagaacgctatctgaataatgtttctgtaacctttggttgtgtcaaaataagttgtgatttgccatgcgacctatcatgcatgtcttttgtgtgtagtttctttagttgttttgtagtatttgatatggagaccagaacacaaccatctcaacgctgccctcaaatgaaaagccaattctcgcaacaagaaatttctccactccagctccaggaagaaactgaagacagaagacaatctacgaacagagacactccatgaaaataatacccaaatttatgtttttaaaacaatacaatacacaattacacatcagcagcatatctccttatgcccccatgcagtagacaacgaacccaactgtgtgtgccatttgctgtcactcaaatcggtcactgtggaatttggtctagcgtccacttcatgtcctttgctctgatcactttagaatgcctaataaattccttctcccaatcatacaatctgacgcaacacccatgattaattaagcagacctaatcaggcacaagcaccggccgaaaggtgcaaatcccctcgtgattttgcttaggactcgtatcaaaactaacctcctctcacctaaaacgaatgcaatagtacgaaggttcagagagagttgacctgatttcgctgcaggtccctcgagctaccacaagatcaaagaaggcctttgacttcccaagcttcaataatggataggactgtggcatttatatccatggattaaaaataatttcaaatgcatattgtactatttttttccggtgtaatataatgtacaacattacacggattatgtgtgtacagtaaggctgtgtttagttcagcgcaaagtttgtattttggttgaaattggagatgatgtgactaaaaagttgtgtgtgtatgacaggttgatgtgatggaaaaggactgaagtttggatccaaactttggatctaaacacagcctaatatggctccaaagagaggaattttgtataaacacatgcaagaaacaatgtaattcctttttttgattatacgcacacacactgctacacgtgcaacactacactcacacacccacatacatgtttcctaacccacactcaaagagatgaaaactaacatatcccttatctcactaaaattctattgaaaacacacctatatgtacgtagtatttatggacactaggatttgaactctagcagatagagttatgcacccacaactctatcatcacattgccggtgcttctctagaaacaatgtaattctaatgccatacatgtgaaatttccatctgcagctgagattaattggctcagacaataggatggcaagattgaggagaccctttggaatcatcagtttgcatgccccaaagatacaaatcagattttaggtgaagaatagcatcacatgatcccatgcgtaccgcccgttgcagcataaaagcggcgggggtgcagttaatggcgcgagatcagatactgtgtacgcaggtagttcaggtggattcagtgatcatatcctctgcatttttgcaacttgcacttcttcacagttcacagcaagtgtttggggggaaagctgcagtgttgtaccatttggtcggctagctctaaatgtttctgtcttaaaagaaaatttactgatattttgccctttcggcttaga

SEQ ID NO: 64963 - DNA, 912 bp, Oryza sativa
gcttaaattttccaaaatcactaggaaaagagcttctttggtccctaggttgctggcattttggtgcctacttttttgctcgctgttgccgccttctctaatcccaagaggggagaaatggagtagaaggctaaaataattcagatgcagctttgctcatggcttcctcaggcagttagggcctaggggtggagaagcctgaagctttgcctgattgcctccccaatcttcttgcctcctctcctttcacttcttctctcctctccgctgtggtttcttgctggttcttggaggcctccacttggttaaatgatgggtgtaggtggtggtcttggtatggaagctactaactgtggtgctttgctcagggagcttcaggtatcctcttgcctgtgttcttgagtgagaatagaattctgtttctttggctgcaattcctgttcttaatattgctaaatgctgcctgtgtcttcctggttcttcttcctgtttggagtgacggttccaggttccctttggttaaattgttcttttatgcgtgtttcttatctgagtttattcagaattcaccgcgtttactggtgaaatattacagtagggattcatttacagattctggcacccttgtgggtttctatcatatctatttgtttactgtccctgagcctaagtttcttcagtgatgttgaagagctcagtgttcttgagcttattcttgttgcacaaaagttagaccttttctttttctttttctgtgttagtattcctcctgtttgtgttgccctcgtttttgttgttaggtgtctcttttgctgcaaagcagtaactttttttttttttggtgtaaggttctctctttttcaccttcctggttcttcagctgcacaaaaagcaatttattgattcgttttc

SEQ ID NO: 64964 - DNA, 1076 bp, Oryza sativa
taatgttttctaagcatggctaagcatttatatatataaagcatttagttgaaccaaaccaatatatagggttctagctaatcgaattataacccataggaaaatagagtcatcttcgaccattaattaattggaaaaggctcaccacccgatgagattcaaaaataatgcataagttgaaataaaacaatagctttaaacgggttcaacatgctcaaagggttgtttggaaactgtgtgacttgcttttgaaacaagcgtcttcaattcgtctttaggaacttctccaacgaacgaacgatcctccgaaacaacggaaaacaaaaaaaaacccccttcctttaaaaagggaaaaaaaaccccggcccaaaaaaaacgagaaaaaaactctaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctaggggcaaacaa

SEQ ID NO: 64965 - DNA, 6459 bp, Oryza sativa
ctgatgctgaactaataacccctatctaccaggtactcttacactgctgtggttctcaattttagtcagtcatgggccttgtattgtctggttcagttctatgctgccataaaggatgaactagcccatataaagcctctgcaaagtttctgacattcaagtctatagtcttcttaacatggtggcaaggtgtggtgattgcattgctgtacaattggggcttgctaagaggtcctattgctcaagagttgcagttcaagtccagtattcaggacttcattatctgcatagaggttgtcgattcctattttaccgtgacagtgaaggatttcctgtttattcatttagtcatgcttgtgtcttttttgttgtccatttgaaacaaaccctaactagttgttttgtcatccaatacagatgggagttgcttctattgcccacctgtatgtgttccctgccaagccatatgagatgatgggtgatcgtttcattggaggggtttcagttctcggagactatgcttcagttgattgccctctagatccagatgaagttaaggacagtgagcgaccaaccaagactaggcttccccagccaggcgatcgtgtcagatgctccactggcataaaagaaagtgttcgtgacgtcgtacttggaggaggagaatatgtaagataaagatgctagctcctcattgctgtctcccatcaattttacttcaaaatatgtttcttactgtaacattgactgaatcttgcagattgtgaatgacctgaagttcaccgtcaatcatgctgtggaaccaatcaatgaaaagctgcacaggatatcacagaacatcaaaaagcatgagaaagaaaagaagaaaacaaatgacgatagctgcataaattcacaacaatccttgagcagggtaatcagcggtattgacgatcctctcctgaatgggagcttaagtgataatagtggtcagaagaaatcacggaagcatcgcaggaaatctgggtacgggagcgcagagagtggaggagagagcagtgatcaaggattaggtgggtatgaaatccgagggcacagatggattactagggagtaaggattaatgctctgaaacatgaatttcttggtctggatcttccttggaggctaaatgcttactaccacgcaaacagatgacagagactcgaattaggttgaaacctaggatctctttgtgaggacactgcaatgctgcagattgagctagcagatgacattatctccaggttgttcaactgacatttcagatgctagggtcttgatgataaacattgcaggcatgcatgcatcaaattgtgaagcatggcaggttaactaattcatgcttgcattatcagttgtaaaggacagttttttccacaaaagtatataagattctgatttgaggaagaaatgtcttgcaagctttgtttttggtgttgtcaagtttttgttatatgtacttacagtatattgttcattctttcattcaaataaattataaaggagggcgtccttttacctccctggcattagatgaatgatttgcaccgtaggtaaatccaatcattgggatataccgcatttgagttgagttgcgtcagatcatgacagaatgataactgctctgagcttgcaatttctgtaacatcccagttaacgcaaatacatttcaagtggctactttttatcaagaagacaataaatttcaagcagattaaagttgaagaggaaaataaatatgcagttcttttcttatcttttcttcaaggtttcatccagatgtccttgaatcctttttttttttctttttgacaagaaaacatatgcctttgtgccgggaattaatggaaaaagaaccttagttaagctgatcacgcgacagatttggcacaatcacgttgtgctacataacacgcatacaaagtgattatcctcctaggatgctatgagtcaccaaaagcaactgataacaagacgtgagagtaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccaagctgatcgagcaacaaatacgttttattcccccactgctttagctatcaaaaaggccacataattacacattttgacagaaatcaaagctgcttttaccttgtatgcatttgctttactgacagctaacagcagcaagcaacctcatttggatgaaacaagcaacagtgtcagcatagaaatctcattacctttcgcttttgtcttgtattatgatttacaggaattcggtttgtatttatttgcgtctggaaaaagaaaaggaaggagagacacgtgaaggcccatggccaattggcccaaaggctcctgggcacctcctggccgtccacgtggcaggtgtccacgtcagcactttggctttgttttctcctttttttttctcccaattttcactccactgctgcacaagcttttccgtgcttcctcgccgcctccggcctccgctccggcgctataaatcgccgccgatttcgaagctgtggaaatgggagtcgcctccacggccaccgacatccgccgcaatgctgtgtctcacctcctcttcctcctccgcgcccgctccgctccttccctctctcgctgatcgaccgagcccgggaatcgcggtcagtcaatatatagaaacttctatatatgatatgattagttttccctctctctcttgttttgttaggtgtttgggttattgatggtgtggtggtccgcagggcgggggtggcaatgttcgcctgagcgtggtttcttcgccgcgccggtcgtggcctggaaaggtaagatactgttgcaggatatctatcgaattaggaatttgatgatggtgataattaattgtggggaaaacaagtaagtctgaatttctttggccacaggcgacagccccaaaaccccgacaccccaccgccgaccacctcgccgccggcggcaccgctcccctttgccgccgtcggctctacctccttcccactctcccgtccttctcctagcctccctcctctctctctctctctcaatacttttttctacctttcatactaccttccatgttcttgttccgaatctgggttcccaagccgctgatgcgccccttccctgattcttctgatggaactaggggaggctgtgtggccatttttcccgttggagggtttcgtctagatctgtcgggtgtgggacatgcggattgcaggtgctgtcggttgtgttggcggcggcgggtcctgccgggatagttggccgccgacggccgcttggctgttgggttgcacggtgtgtgctggctggtagcgaggatggttttagggtgttgggcgaaagctctgtccgactcatagccggcctgacggcgatgaacgtccttggacatcatgcaatgcccctcctggaggcgtcgtcgcaagagcatctccagtagagaccctaaatacaattcctaaacagtttttaggtgctaaggacaaaaaataaactccagcaaaacccatactacaggtcctaaaataggaaggacctcaaatacccctccgcagtccctaggcctgggggctgtagaccgaggccctatcgccgtttttctacgcgggaggaaatttcctgacgtgtggtgtctgtcttccctcccgcggaatcgctgccacggcgccgatcttcgccagctcgctggttccgccgctcgtggccgacggtgcgaccatccagtacctccaccggccactgcttgtcgtccgcgtgcccgcttgcttgttttttcgtggtccttgatcagttcgcacactgatgcactatatggtagacaagaatgttctgaaattcatgaccatcagaaacatgttctaaacaatcctgctctcgattggtttatggctaactgtggttctaaacgatcatggcataaaaattattgttctgttcctttaaagtttgtggtgcttggtaggttgagacaattaggctgcttgcaattatgcagtagttccttcaaagattattctgcagtgttgttcttttgtgtcagttgtgagttgaagtttaacttcaaggttttttttttctaggaggatttaagctctttctgaagtttctcagatagattagattggaaaaggtatagagttaattttatctattgattatagttcttatttaattgaactacgtagtgtcttgaatacttgccggtaggatttcactcccatgtttgagaattttgaatttgaattatggtatttaaaattatggatttgaatacaattgaattctatacattagaaatattcgtatttgaattattactatgttaaactaggtgtaagcatagagtataatcagaaatacaagagaaaaagaaatgggggctaagaaatagggtctgctggtagagttggaggtaatttttgaattcttagaaaatagggacagccctcattcaacctttgaggactctaaaatagggactactgctggagatgctctaacaccctgttcccccttgctgctgggtgaaaaccctttccagtctcctgtttatgcgatggtggcgtcctttccgacgtcgtcaccttcttcaaggcatcgtttttggagaaaccctgcaaccagtccccctgctttcccatccttctcccctattccatcccctcctcctccccttttcttctgtcaagggctcctatgcttggaaactctcatgtatctcttctctgtaatatattcaggtggggaaatgttggatttttattgattggaatactgtattgggtcatctcggtgacaccaaagctgtactttggtggagtagcaatctttgcccttattgaccggataggattttggttaaatttatctacgtttttgtttgcggttcatcttttttcctaccagtcttatacaagatggtacagtttagcaactgattgttacattgcaatatataaatcgaagtgatagaagccacctcaagtaaatctaactattgttcataattcaaaggtcaagaccaatttctcagttcctgcgactgcgcgaaaaaacaaaaccatggtgactgttgtggaggaggtcgaccaccttcctatatatgatctggaccctaagttggaggaattcaaggatcacttcaactataggataaaaagatacctcgaccagaaatgcctgattgaaaaacatgaggggggccttgaagaattttctaaaggttaagttcactacttcaatttaatgcacaaatactccttcatacaagagtcggcatatgctattttctttgcatcttttaactctttatggttctctcattccatcttttgtaggctatttgaagtttgggattaatacagttgatggtgccacaatatatcgtgaatgggcgcctgctgcacagtaagttctaatgtagtcatccagctattcgctaatgtttatgtgttgtaggaaatatggatcactgatcaagttgtttaagtaccacttcttcattttattttcaatactatgctttgtctggtagcagctagcagaaagttaattttacaacataagatagctcctcaccgccggtaatagagatgttttgagttttcactcatagcacgtcttggctgtttaaggtaagtatcgggggtagaacataatgccatgaagagagaaaattatgttatctgtgtccgattgtagttggttctgaacttgtgaggctgtgatttcttaattgtcgtttttgttaagaccttaccagtatttgcaatatttaatgcatttttttgcggggaaatattcaatgcatttaacttggaggtttttcttcatgcatatagagaagcacagctcattggtgagttcaataactggaatggtgcaaaacacaagatggagaaggataaatttggcatttggtcaatcaagatttcacatgtcaatgggaagcctgccatccctcacaattccaaggttaaatttcgctttaggcatgggggtggagcatgggttgatcgtattcccgcatggattcgttatgcaacttttgatgcctctaaatttggagctccatatgatggtgtacactgggatcctccagcctgtgaaaggtcctctacttgtgccttgaactacaatgtaaa

SEQ ID NO: 64966 - DNA, 2262 bp, Oryza sativa
tggtgaataccggcggtggtacaccattcgtgtcaacggtgaagctaagcccgtttaaagcttggcctacccgaccgacaatcagtcactctccctctatgaacggaagagcatgagatcaggtgctgacgtcgatataataaggttggagcactactactgtatttcctaatttccggccgtcgtagtaattaaggagcagctcatttaatttgcaccttaatataatgtacaaatggattggagaagaacctgtatattctctgattttactaactcctaattttctatatcaacctgtccttttgttccttgtggtgaaaaatatttacattaaggataaagtttgatcagactttaatttttataccctaactattaattttacagtaattaatggaagtgctcttggattcgtacgtacactattttttggaaagcatagaacccttcttatataagtattatttttcaacataactcatttcctttttgatggttgatggtcaaagttttatattgtcacaaacatcaaattttaggactagtcaaatatttacgaccagaggaagtaagtattcatcgtcaatttgtttttcaattgcatgtttcctttcatattcaggatttcataaatacaggtttcctgatgatcagtacgatcgttattggtatgcgtgggaattaactggaaatgacccttattcaaacatttctacccaatcagccatcgaactgaataccacatttatggtgcccttgcgtgttctccaaacagcttttgtgccggttggtaactccaatgaactagttttacgttcaaagagaagagacagacttcccggtgatcacttggtgatcctgcacttcgccgacttccaggataacaagactagggagttcaccgtttcaattgacagcggcatgcaaagtggaccgatcagtccaccatacctgaaaggttggtctatcatcaattggtccagtgattctgaagatctgtccatcaaacttgttgccactgccacatcttctcttcccccgatcctcaatgcttatgaggtctacagtcgcatcatccatgaatatccaatgacgttctcccaagactgtaagctctatctgtctctaacaatgtacactaattaaatatatcagttgggtttcttccatgtatttctttccatatgctagttgatgcgatcatggccattaaacatgagtacggaataaggaagaattggatgggtgatccttgttatccatctaattctgtttgggatggtgtggaatgtactaatcctggtgatgataaaaccatgaggataatatctctgtgagtattattcggaatatttgcacgtgctatcgtacttgctttattgtatatagttggtacctttcatttatgttgtattgcttgaaattattatgcagtgatctctccaacagcgagttgcaagggcagatatcctataatttcacattgtttagtgccctcaagtatttgtaagtatacataaaattttcactgcctttcattagccacatctgaaattcctgactgacattaatggggatagttttatgctatttaaaatcaccggaaaacaccaactaaatgatgagcagttgcattctggtgcaattaaaattatataaacccatcctaactactccctccgtcccattttaagtgcagccatggtttccgtgtctaacttccatcgtccgttttatttgaaaaaattaaaagaacataagtcatgagtaaagtactattcatgttttatcatctcataacaacaaaaatactaaataaaaaattttaaataagacgaacgatcaaagtttagcgtagaaactgatagttgcacttaaaatgggacggagggagtaggagtaagaactagtggaggtttattgcatcgcatgtactatccatgtggtgccacatcttcgagagaatgagactagcagtaatcggtttcatatgtagttgagggatgaaaacggaccaaggctacagttgcatgaccaaaagtaggcttttctcttgtagttttaaatttgaaagacacatatggaggaatctttctttattacatatggggcaatctgaatctgaaagtagagcaagaataatatatattatatggtctataatatatcagaattccttcaacacatgtgcttagctttcaaaattcgtagatatcacaattgaaggcatacatcaacactgtatccgtccaactgtag

SEQ ID NO: 64967 - DNA, 1686 bp, Oryza sativa
tgtgactattgtttcgccaagcgaggtgaggcgcagtgggtatgaaggttcagatttagaaataagtatcgagatggtttatttttaaatttaaaattttaatgttcaaaaaataacaaaaattcccaatgaaaagcgtgtgactatacttccattgtctgttgcataataaccttttacctacctaagagggtggcactggagagcacaatcatgtatagttctcttaacaatcatgtatatgtactttcaaagtgcaagtcacaaaggcaatatgatacatccaccgctctagtgtatttataatctttgtccttcaacatacaccagaaatttatggcacctcacaaaagggaaaatataccttctgctgcagcctacttatcgacacatctccttttacaattgaattgaagtaaaatgaagcactgaagtttaaaagaattctccttttacacatctcatttttgccataaaggaatttttttatgtgagattgccacttggatgatggaatatacctgtttacttttaaaaaaaaattcaagcgaattatttcatgtccgattggcactgccggcccttcatataaaactttttagtggataaatttgtttgcagattgttaccaagtcaggatgtctattgtttaatgccagattgtatcccactttatacagaaacttgtcatgcaaccaactaaccgggacaattccagactaccttcgcaaaagcaatggatcaattgttttcaggtgtgcctactttcattattattgatttcccttttagcattttccagattgtggggttgttcttcctgtaatctttgggcaccctaaaagaaaatagggaagggaagtgatactatgcttctcaaataaaaacctgcacggaaattaaagcacatcaatggtggatattaaaagtggattaacagagtaatccccccattagcaagggggcagttttgtacttagaaaaaactgagcccctatccatatcgatcgagcgatcgactcgcggcggcagtcaatttccgacaattccacctctccgctgccacccatgcatcatgctccctgcaggctgccaagcggctccgcgttcggggtggcagcaaacctctggtgagtagggatgccagccgccgtcatcggcgccgtgcgccgggacggtcgctctgctcggctgttgggaatagtcccatattacttatttagggaaaggccagtcaaggcggtcaggagttcgattgtccttgagggttgatatttgcttgcagagatgcagttgattaatgtttagaaggaagaatcgttcgaaaaatgcttagaatgaagatagcctcttatggttgtgatcttgtgggatgttctgctcaatgtggtcgtccaagtgctggtttagttgggggcaaagctggatccgaacgtgaagctcctccatagccaactgggagcgtgaggggtagcaggcgcagagacgtggaaggggccgggtagaggaagaggtgccgtcggggcaggtttcctttatctcgtcgaactttgccacacaccagaggttctcgatctcttcgagccgtgtgtgtcgaaacacttccgctcgcggttccggaaaatccttccgaagctgtctccgcctgaaccggtacctcctcaacgacagccgtatgaaccggta

SEQ ID NO: 64968 - DNA, 695 bp, Oryza sativa
tagctcatcacatgggatcacaacctgataaccgcaagttcgcaacaagtacttttcagttttacaaacagtttctctgtttctgttcccgcgccggctataaaagcgccaagctttttgggacgctgcagctggagaagacgagaacgcaaaaccaatcagtcgcggcgaacgcggcgggcggaagaggcgaatcgcgtaacgatttttgttaaatttgtaaccggccatggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcgggagcttcatcctcgcgctcgccatcgagcactacaacatccaccgtcggctcgctctcaacgtacgtgatccgcgccgcgagcccg

SEQ ID NO: 64969 - DNA, 4639 bp, Oryza sativa
caccccccccccccctccttcctctcctctaagtggtttcttttttttggtaccgcattactttccatttagtaaatttatgcacataaagtttatacacctcaagtttacacatataaagtttagagacccaaagtttataaatcataagtttatatatccgattctaatttgaatttgaattcaaatattttttatataaagtatttctatacatctaaagtttatacacctaaagtttatagacccaaagtttataagtcaaaagtttatatacccgattcaaatttgaatttgaattatatctgattcaaatttgaatttgaattcaaatattagtttatagacccaaagtttataagtcaaaattttacatacccgtttcaattttaaatttgaattcaaattttttatatatagtatttctatccataattttttctaacttttttttatttttttaaattttatggtgtgttgtagtaggaagagaagaagggagaggaagggggagaagaagagtgtatagggggggagggacgggtgttcgctagaagtagggggaagtgatcacccgcccactagcagtaccttgatgctcgttgccttggtaggtgatcgctaggagtagggggaagcgatcacccgcctactagcagtaccctgatgttcgttgccttggtggatgaactgccgcccgcgctgtgaatccatcgctcgatcgataggatcaacaagaatacgggctcagatttttctaaggacaaaattgcccctttctaatgggaattactctgctaatatcacttttaattcccaccattgatgtgctttaattttggtgtagatttttatttggcgagcataccaatttaaaaccatggacttattgttttatgtaatttcagctacgagtctgacggagatatgtgcaaaaaaccaataacttcgtcctcaagaaacagagcagctaccttagctgtttatgtagcggctccagtgcttgtagtcgccatgcttgttgtagcatatttgatctggagagccaaaagaaagccccattgtgtgtaatactataatctgcattgaaaaacacattgtttaatatctgcatttaatactgctaaacatgttctttctccaccagtttctacagatgattctcccacggtaccagaacagataagtcctccaggacattggacaaatcattgggaccatctacaaaaacctgagaatcgtcgattcacatatgaggaactagcgaagttcactgatagcttcaaatgtttaattgggcatggaggctttggaaatgtctattacggctgtttagaagacaataccgaggttgctgttaagatgcgatctgaatcatcgtcccacgggctcgatgagttcttagctgaggtgccaaatatagttactattatgtttaaccatagataaaatcaatctgttttcagtaaaaaagattcaatacttagaatgccatatatgtgcatgtaaacttagtcgcatccactgtgaggtttcatacgcatcaagatatttgaccatttgttttgtcccattacataggttcagagcttgaccaaggtgaatcacaggaatcttgtttctttgattggttactgctgggagaaggatcatttagcacttgtctacgagtacatgtctagtggcaatcttagtgattatctgagaggtttgtccattgcaatctttaagtattgaatatttgggaaatctgagggaggatactgggcatatacattacgtagaccaactagtcattccttccttacaacttaaatactctgcatgaccgaaccagctcacagcgaagccaattaactcatgttgcataacagtttgcagaactatgacaagtagtactgcttacctggagagtgcatagttagacattttgagaaaaaaaaaagactggagagagcatagttagtctctacctaaggggcttcatggccatcgcttaaactcactaaagatatcataatatatttagagcaatttttggatactaaaatgtgccccaccagtctattggttttttgaatagtagatgtgagtagtttgtattaaagccaaactattagcaaggcctatattaatatggtaactctatatgtaccaatcaaatttggctctaaattggttctaaccaaagatgatccatgcaactctaccctacaaaaaatttagtagtgcccaaacttgccttggttctaatagtgccagttatttagtacgacagaaaacaaaaaactacccttaattctgctgccctcaagtatagaatatgttaatcttgcattaccaattttttttcataattgctcatcatctcattatctagacatctgattaatacaacacaataataaattgtgtggatgtttaaaattgtatacaaaataaatgtttttgcattattgaaggtctatctcgactgattgtgcagacatagtaatatcaagagatggttgtatctatctaataaattattacattgattctatcctttttttaaaggaataatactgttttgacttgtcaattaacaccgctcccccccctctccccctccccccctcaccttctaattgcgtataagtaatgtatgaaggtaaaactagcatgggtggaaccatgaattgggcaacacgcgtaagagttatgcttgaagctgcacaaggtatgctacagtaagaagacaatggcaaatacgcaaagaaagaatctatgctatgccactgaatttatcctactttaacaatttgtcatcaattttgtctccctctataatataaatggcactgactttacagtaagctattgtggtggatacttttctgaaatgcctagaatgcccttcgagttatccaagagttgacaattgtttaacccactagaagttttgaaaaaatatgaaagtttttgtgtacttagccttcttacgaaatatagaatgtgtgtatattttaaatttttctttcatgttttttaaataataattttatatagtgtttgaaagaggaatcatatacacaaaagatagccacatcacaataaaaaaggtacaacatgtgaatgatgatatacataaaggaatattaacacgagagtattttgttgccatataaaacataaattatattttttaaaagttaatacgtgcaaaatgaaaaatcttgaaatatacacactgttatattatgcaaggaggctacataaaaattttcaaatttattcaaaacttctagtaggtgtaacctcttgtatgtcttgaagagcattttaggtattttctaaaagtatccacccctaatggtatattgtagaaaaaattgacaaagtcagtggcgtattataagaaagacaaaatcgatgacaaatcatcgaactaaactgatctcagtgatataaatggatttctatgttttatcgctcatctcttgatctaactgtagttttcttgtatgtagggctagaatatctacataagggttgtaacctgccaataattcatggggatgtaaagacaaataacattctcttgggtggaaatttaaaagcaaaaatagcagattttgggctttcaaaaacctaccatagtgactcccagactcacatatcagccattgcagcgggatctatgggctacattgaccctgagtatgagcttctttctacacaattaatgctaattttgtgctgtgtattcatatattttaatgattctattcaattttatccttaatcacttggtgcaatcattgtgtttaacataatgtgggccatttttaggtactacatcaccggtagactcactgagagcagtgacgtttacagctttggtgttgttttactagaggtaactagtggtgaacctaccataatacctggaaatggtcacattgttgaacgtgtgaagcagaagatggtcactggtaacatcagctcagttgccgatgcacgtcttggaggttcttataacgtcaactccatgtggaaggttctagatgctgccatgatgtgcacagcagatattgctgctcaaaggccaatgatgtccgccgtggtcatgcaattgaaggaaagcctggaattggaggaagctcatggggacatgggcgacatggaaaatatagcaagagataacaagttttcgatgtccatgttgggtccatcggcaagatgaagaattaaccattgcataactagctttggaacatacagttggttctctgcttcaagtctaaaataaaagaacttgtttgcatagatgatttgttatatatgtgttaagacacaatgatttatacagtttgtattcgtaacagagctgacagtaagcaattcgtgagagtaggtcagtcaaatgctgagaaggtggttgtttacaaccaaatattatgtaatagaatcctctgctattttataagctgtttgttttcaatgtgcaacagtaagctattcgtgtgagtaggtcagccaaatgctgagaagtaggtggttgtttacaaccaaagattatgtactagaatcctctgccattttataatttaaccgaaatgttaacacagcctcttgcataattcagcacaactgcaaa

SEQ ID NO: 64970 - DNA, 26109 bp, Oryza sativa
  unsure (1)..(26109): unsure at all n locations
acaatttctggagatgcgtcgacgtaagttcatactgctagcttattagctgcaaacactggcgatctctacattcagatcgatgtacactgaaataatgtactgcttaatttaaaaaaatcgatcgaatcatgcattcattcatatatatattggcaaagcaggagcctgaagagcatataggcgtcgtggatgcgcagttcgttgtccatcgcggtgtcccaacgctcataagccaagtaactaaaaacaatatctattatcccataatgcaactagctttggttaaattatacactactcctaccatatttaattgtgtttttctctccacatatatacagggcaacggagaacaagaagggagcagtgccaaggtaagtcgtacaattaactgtattattctaagtagctactctcttaactcctcaaatactatttgatacggcatgcacactgtttttaagtttaaacttcaatcttaccttcttttaagaatatatgaatattttaaaatatgttatattatcgaagtgtgtatatatagcatcataaatataatcgtacaacttttattcatagtatatattactctttccgtattttaatgtatgacgccgttgacttttcgaccaacgtttgaccattcgttttattcaaaatttttatgcaaatatgaaaatatttatggcatgcttaaagaacattcgataacgaatcaagtcataataaaataaatgataattacataaattttttgaataagacaaatggtcaaacgttggacaaaaagtcancggcgtcatacattaaaatatggagatagtataatctatactcttaaaatggtaaggatggtggtgtctattttgaccgtacatctccttgatacctgggacccaaaatgttggtgaagggatgacgctccagtctggatcaatcggcctctctctctctctgtgcgcacgcgcttcctccgctactggctgccgctactaggggtggacagggagctcgtggctcgttagctcgctcggctcgtgacaagctcggctcggctcagctcagctcgtttgatttttctaatgagccgagctagaagtttagctcgttagagataacatgaggtacttgagaaggtaccatgaggtaccattttttctattgtaaatttggtacctcatgagatacttgaggaggtaccataaggtaccattttttctattgtaaatttggtacctaggtaccatgaggtacaaaattttacactaaatttttggtacctcgtggtacatcctcaaggatcgtagaattgctcctctctctctctctctctctctctctctctctctctctctctctctctctctccgcgcgcgcttcctccgctactggctaccgctaccaagccttcatatacttctcacgtagcctactctctctagcccccttcctcaacccgtgcacctactccctccgtcccaaaacaattcaacctaggatgggatgtgaccctttctacgacaacgaatctagataagcctttattcagcttcgttatcctaagatgggttattttgagatggagggagtatttcagatatgcaagaaaaaaatccaaaaaaaaagttgggtttaggtgccacctactgagcttattgggtctatgaggcaaatttggtctctttggctaggaataagttcactataggtccctcaatctatcgccgagtttgcaattcatccctgaaccaaataccagatataatgggtccctaaacttacaaaatcgaatcactcgaggtcctaagcaatattatattcggtttgttttttttttcttaagggctcattagatatgccatcttttacaagagggcccaggtaaattaaaaaaaaattgagggttatgtaaccaatcaattcaatgtatttacaataaggaaaattatataaaatttactatagttggattaaatatgtgttcaattgttttgataagctaggaatttggcttttgactagttattaaaaagtaatttgtgtactagttattaaatatattaatgtataaaaaaacttgacgtaatatatatattcctgtagatgttaattaatacatatctggtgtgtaaatacgtaggtgagatcccggcagtttgacgagatgcgcaccttctaccgcagaatcgccgacgccgaaaaggctcaagccgacgccacggcagctgcagcagatcatcatcgctgagttattaattaacaattaacgtcagcctagacctctacatcatatatatcgtctcggatgatcaaattaaccagatttagttacaaagaggcaggttctttggggggcaaaattaactaggctcacgagagcacatatgaactagtttagtatacatggcatggttaatttgaaagttaaaaaaacatttgacagccaaagagataatgtgagcactttaattgagaaatcgaatatgggatcatggggttaaaactgcaccctacagtaccaaatatacatctcaagccaaatagtactaaaaacgacttcaattgatttgcattgattgcctcaaaagaaatttgtgttgattcaattcttcctctagctaccttctctttttctcctcttttaatttgactcattgcgtacgtgttgactttatgttgattaagctaggtctcgtttaatttctgtaataaatcagttgaacttctggtgtagtaatatatagtatctacacaatattggtcggttcataatataatattatattgtttgttgttgtcaataacatactccctccgtcccaaaaaaagacaaaccctagtttccgtgtccaacgtttgactgtccgtcttatttaaaaaaattatgaaaaaaattaaaaagacaagtcacgcataaaatattaatcatgttttatcatctaacaataatgaaaatacgaattataaaaaaatttcatataagacggacagtcaaagttgaacatgaaaacctagggtttatctttttttttttgggacgaagggagtatggagtatggcttaatttgtcaacatgtacatgcatggctacgtgtcgagagaaaggaaaagcatgcttgtggagagaaattgcttctgctatagctagcacttcatatttgacttcagagcatatatagtaatcttcaggtttatagactaaagtatagttaaattcatggctttctaggcgacggctgactaattaaactaggccggccggtttccgaaccaggcaagttgtgtactatatatactagtagtactaattgaccgattaattcattggttcacagagattgagtacatatatatgcttgataccgatgaaatcgatggtatatagcagcagactcaacggccggattcaattataaaatcgacattatgttcattgtatttcatgctgagatcgatgatggctttttccaataatcaatcatatatgtgtgtatgttgaccttggagcctgtgctggtcaatgccaacgatatggttgatcggactggatttaatttgtcgcttgcttaatttcaccctaattaaacgaaaccctcatatatagtttcatcatcaaaatccgcaagtgcgtgcagcatgcatgttaagacacagagaaatcaacgtctgagtgcattgattgagtctaacctactccctccgttccgaaaaacccaacctagaaagagatgtaagagatgtaacctttatagtacaacgaatctggacaaactatagtaggaggggtcggttgggtttttttggacagagtactctcttcttcttaaatatgttctataatctagtatgaaatgtgacacattctataggcttctatctagatttgcaatatcataatttgtatcacattttatattagattaatttattctgtgacagaagtagtacaaatgactagatcttaattaatgtgcacatttgcgagtggtgacctatctaatcaatttaaccaccttggcaccttcacatgaaaaaaattaaccaccttggtttatctgaaaaataagcattataccctagctatagatggccaaatgggccgcctacatggtccggcccaaacacaactaaggcacggttcaagatcagttgagcccgcatggcccgactgacacgtcgtgttatgcccgctcatgggctgcacctatgttctaggcatgacgagcaaaacccactgtgctcgtccttggaataattatatttcgcctccctcatctctttatgccgtgccttatatatgactggaataagtctatttacctcccttatctctttgagtcggccgccaacggactacagcctgcaggagcgggggatgtcgggctgcggttgtgctgatcgttgggtcatgccgtgccgaggaagagtcccaggtacaatccaacggccgggttgggccgtgctgtgtttgggttgggccaaatctctgtgtcggacgtaagtcgggccgtcggggtacgagcctttggcgaactggctttaatttgtatgcatttttcctaagctaataaagtcaatcttacctgaaaatttaatttaacaaagaaaaccctgatacacagtaggttccattcgctgcggctggcgggctgcagcagcaagctagcacatacggtttttcttttctttttcttttttttcatttgctgctgcagcatagccacagcgctgtcaaagattgggctcccaacaaacgcataaatacccacactgccacacagacgcaaaaacaaatatactacatttgtcctaagttcaacatttcaatatttataaattcatatagtttaacatcataagttttatattctcaaaacttgtcgtgagaaatgctttcttaatattcagttcatatgttgttaaactatacaagtttctaagaattaatggtttggtatagaaatatttgatttgggataaacctaaaatgatgtactaccataataaaaatgtccagtaccattaggttggaaagaaagtgagcttagagcacaaccaaattaatctaactagtgttgatttttttttaaaaaaaattgctagtgttactaaatttctagtgtgtactatagtagtatatactaacagttagcagaagcaatagttaaactgctcacagttgtgtacatcaaatttgtattagtgtacattaaatctcacgctagtacttgatggactctcattctgtcgtgcttaatacagcaacaaataaagtcaataagcgtaagcgatgaagaaaatggatggtgtggcagagatattaagcaggaagaacacacaacggctcttcttcaattcggagatgagaatcagacagacaccaccgagatcgacgcgatgaagacgatcgatcgccgacggcagccgtagccgccgccgccccctaagccggccgccggagcagccgcctccatcccctcgcgaaccgccggccgtacgtgcaaccttcggtatccaaatttacagttttaaaaaacctacgcacttttttattcaacagttatatactctcaattttaattagcacaccactgcttaagtcgttggtaggactaggagatccttttcattaaactagtggatttcccgcgtaaatttcttggagccttgattttcaaagcagaataggattcgatatacaacttttagtttatgtttttcgtttgtacagttgtagccttttatatacagtaggattttaaagatatacatgtattgggtgtacaatactttttttttcctcatatgtagtgtgcaactgtattttatatacaactttatcaatcaatttgtacggttataatctaaactcacaatgaccaaatggtgtatatcttttttattctctgatatgattaacctggtaatttctacacctccaaaacagagatggcggcttctttttttagctatcttagtaatacagtataatataagagaaattttacagtacttaagaaagtaactggaggtatcaacttttacactacaaatgtcatacattctcaaggatgataaaaattacccataacataagtatgataatagatacaaggtagataaaactaggtggtgtttggatccagagactaattagaagtattaaacgtcggatgtttgaacactaattagaagtattaaacgtagactaataataaaactaattgcataaatgtgagctaattcgcgagacaaattttttaagcctaattaatccataattagcacatgtttactgtagcatcacataggctaatcatgtattaattaggctcaatagattcgtctcgcgaattagttcagggttgtggaatgagttttgtcattagtctacgtttaatacttctaattagtgtccaaacatccgatatgacagggaataaaattttagtccctgatccaaacaccattgtttctgttactggtagggaccgctgtaaccattgtcaaaagttaatctagagaagtataataatataatacgtgcagaccttgagagcaatgctggccttactttgtgtgcaaacttgctagctagcataccttatgaaacaagttgcagagtagctagattgtaggatcgggagtcagctgctttgagtgcaagtgtaaggaactcaactccatacttcccctgcataagttagccggattctactctatcaatcatgttattttagttatccctttatttcacaaccaaatcaaggctaaacagcagtccaagcagagtagcttagccagccagcataacaagtcatatataggtcagtcggtgcttaattttcatcctctttgcatacctgcacccgtgtacaggacgtcaattctgtttgtgcctgtaagtctgcagctccttcttgttttccttcttgtgtgtactgctgccattgcctgaatgttgtttggttgctcctctgaaacatgggttttttacagttcagttgggtcactgaagagtaaaagaccttgttagcagacagcgaacgcaaactgcgctgtttaatttacttgcagttctcaagagaaataatgtgagctcttaccactctcttttcttgatgttttcatcttttcctaaggactaactaggtgtactaactaacatttgagatgatcttgttagtaaacagtgagaatgagagcaaaccccattgtgaccgcattatctgcggcggtatttggattcttcattggcatttcttttccagtacagatcacaccacaggtaatagatagatacagtatgtactatttatgatatctgtttttgcccatgaaatttgagagatgatctttatctgatgaatcaatgagtctccttttgtgtgatgcatgcagcttcagtgtggcttattaccttgcagcagtggtgatggtgcgaactacagctttagtggcagcagcatgataggcatactgtggtcaccattcagaaacaccactatcctgtcaaatggcacttcagaggtaaaatttgagagcttctagtttctcagctggtagtagataaactcattatcttctgttgtttgatggttttagaatcctgcgttgacaaagccgaaaggtgcagagaagctaccaccaggattagtagttacagagtctgatcttcacatgagacggctgtggggatcaccaagggaggtaggcagctctctgaactctgattctggtttgttaacttaaatatggacagtaaagttgatataagagcttcatatatgtgtttgtgcactgatcgatcatcaggacgtggcgactggcaagtaccttttggcactcgcggtgggatactctgagaaagccaatgtgaatgcaactgttctcaaggtaaaaggaattaagattcaggaagaggcaggaaatcatctctctgaatgtttttcttgcttctggtagctagcactgcatctctgaactgaacatgtggcgtttggatgttcagtttctgaactttaccatatgtcgtcagctgtaaactttaatctcagaagtgaacaatgtgcagttctctgataagttcgacgtggttctgttccactacgacgggcgcacgactgaatgggatgacttggagtggtcgaagcaggctgttcacgtcagcgccaagaagcagaccaaatggtgagcactgagcagcagcattatgcttacagtagtactccaatctgtagctgatgggctaatgacaaatgattgatcgaaggtggtttgcaaagaggttcctgcatccgagcatcgtggcgccatacgaatacatcttcttgtgggacgaggatctgggagtcgacaacttcaccgcggaagagtacgtgtgtgtctggtttctgaactctgaattttgcttattggagctgatcaagtaatgtgttgtggcctttgaacaaccaaccaaccaacaaatcgatcggaaacacataggtacgtgaaggtggcgaagaagaatgggttggagatatcgcagccaggattggacagcacaagagggaagaagacgtatgaagtcaccgttcgaagaaacgacggccgggaaatgcacaagtaagtaaagcagctgaaaacgaaccatggaaatcgatctgaagaaattcaggctcttgttacttcagtagagacactgactgacgcagacagtttgtgtgtggtaaaatttggaacaggacgaatgagggagggcgttgccctgatgtgcaccaacgaccctgcagcgggtgacatgaatttcctcttactccactactactgtcttatttggtctctgaaactcctcgagtctgaaagacataacgatcgacacgcaggttcgtggaggtgatggcgcccgtcttctccagggaagcctggacatgcgtctggcacatgattcaggcaagtatatattaattcattcacaattatttctcactaacacttaatttcaaccaaaagtaaacgagccaatggaactgtatatgcttataaatatgcagaatgacttggttcatggctggggtctggacttcaatttctggagatgcgtcgacgtaagtactagtacactagtgttcattcagatggtactactactcaaatagcttgctgaagaaataaggttaaacacatgatcatcatgcatgaatggcagaatcctgaagagcagatcggcatcgtggacgcgcagtacgtgtcccatcatggagttcccacgctcattgcccaggttaataaataatttcttcttaactgtaatttgcttgctcgttactgaattcagggtctcctttgtttgtttgtttgtgttactaatcaatttctcgatctctttcttcagggtaacggtgaacaacaaggaagcagcgaaaaggtaactcagtaattctttagttcaatatgaaatgaagcccattctttgcaccaatatgaaatgatacagtaattactactgttgtagtacatagtgcatgcatgttaactgaagaagcattctattagtgtgtgattaattaagtattatctaaagtgttcagttgaagacgtactccctctggttctatattaattgacgttttagacaaggttgaggttaaacttttataactttgaccatcaataattttaaaaatatttagtttaaagaaactagaaaaacatatatagatttgtctttcaaaacactataataaaaataaacatgcatttatttattgtatatattataatagaaaaacaatgtcaaaggtatatcttgtagagcgtgttattgttcaaagcatcaattaaaatgaaaccggagggagtaatcgatgatgttaattacgtgcgtgcgtgcaggttcgagcccgacaatgggcggagatgcgcaccttccacgacagaatttccaacgccgaaaagaagcttggggattcgtcgcaggcactagaagagtatcacccttgaacttggacatatgcaaccaccaacacttaattgtttgcatagttcagcactggcatcacatgcatctttttttcccaaatgaaattaagcgagaatatatatatatagagagagagagagatggaggcatatatccctagctatatatatacgcgtacatgctgaagactgcgtgaagaattgaagagatattaccaaattaactgcacacacttccttttcatcattgattcttcccgccatttttttttgtgaattatctatggtcactgaccgatcatgtatgaattatcacgcgtttgtatacttttcatggtcaatttctctgaaagagatacacacagatatcttaaagatggtgaaattgttgtatttttatgtgtcgacgtttgagaccataactacagtatttacatggtatgagaatcgttggtactagggtatatataagattgagataaaagagacaaagaaaaggattttttttatatatgttcggaccccttcatcggaaggtaataacctaatcctgttggccgaagccagtattggtcttatttatcagaatcacacaagtacaatacttaggataatcaatctagtcatcatcgacttggcgacatagaacaccaacacgtagtcaacaatggggtaatcttccttctcgaatacgtactcggcgatatcagagatagcgttagatccatcttatcggcatgacaccagattggatctgtctagggtaatctaatatctgatgtcaatgtctggtggcgtgtattggtatctattctaactgagcttgttgatttattcgggtttgtcctcccctccctaaagggtcttgtatttatacccatatatatcaccttgtccaaatagaattagagagacaagtataaatacaattcgagtagtatttataattttcatgtggaactctgcttgtcatttcttatccgaaacttcttctatatacgaggtatgattctgtataaaacttggtatataatgggtcctgccgagcttaattgattattattgtatatgtgttattcataaccctaacaatggggagcccattaattgaagaaattaaggtgataaatgttgagcctttaatcctactgctttgtagtattgtgtagtgtgagtagcgtggcatcacattcacaaaccatcagctagctgattagaattttagggcccctttgaatcaaaggaattacgaagaaatttcataggattgaaatcctataggaaatttcctatgtagctctttgattcaaaggattgaagttttccaaatcctacaaaattcatatggaatggcttatagcatataggttttggaggaaacttagcaagagttccaacctcttggaaaaaatccttcgattctatctcatccgattcctatgtttttcctatggtccaatcaaacgatcattcctgtgtttttcctgtgtttttgtagcgcccgttccgtcgtggcgcctagcgggaaaactatctcttaaaaaccctaattgcgaaatctgtttctttgcttgttgtctagtgtccgtgtcatctcagatctcaaatccccgatctatcgtcaagttcaatcccgaatccaaatccttcccaaatcaaatccctccccaaaagtctattttgcctccctcgggttcgatgggccgaactcctctcggcccatctctccctccctccccatctctccctctctctctctccccgctctgcccgcgcgccgcgcgtgcgtgcgcgtgagccgcgccgagccgagccctccctctccgctctcgctgcccgagccgcgccgcccattgcttcccgcgcacgcgtgccgtggtggccgaccgcctagtcgtcgccgccgtcaccctctgccgcgcctgtccgcgcctgccgtccgtgtcgccgctccgctccacaccgcccggccgtcatcgccgtcgtcatcgactcgaccccgcctctccccgcgcgtgcttccaaggaaaggaggcagggctcctcctcatcgccctctctccctcctccttttcccaaagtggcaagggggcaagccccctttctctcccccctttctcccttttctctcccgccggcgtcatcctcctccccccctgtcgccgtttgggccgcgaccgccgagcgctagccctctcccttgaccgccctaggtcggttcccaaaccgacattgtcgcccctataaacccaagctcctccctcctccatttcctcccccccccctcgttttcatctctcgccgccacaccctgtcgcccctgttccgtcgtcgccgttcgtcgtcgtgcgtgtcggaggagccggcacgagcaaggacgcggaagcggactccgggcgtgccctcttcttcctcttccccggcccgaggccggagagatcactcccgtgccgtcggcctctcgtcactgcgccccgtcccgcatggtagtgcatccctccgttctccctcctcgctccatctcttccccttagctttgagtagccgctcgagtagtaccccagtagctagctggcgccgccccgactgctgccgtcgctcgccgtgtgctcgccgccgtcgccgcccgagctcggaagcgtctctcgtcgccggcctccctcgatgcgtttcctcctaatccggcgcaagagatgggttcccgtatccgcgtagatgctctcaccgccgggaatcggcccctcgtgacctcgtcgccgtttcccccttttctctccgtcggttgccaccgccgcaatccgccgccgacgaactcccttcggcgaatccaagccgttggcttgctccctctcgttctccctcgtcatcccggtgtacaccccgtcgcccctcgtcgtcgcacggcgttccggagaaaccgccgccgcccgccgtccattcgcggccggcaccttcgtcttcctccagccggcctgcgtggcagccacgtaggcgccacatcggagccacctcgacacgaccggatcggctgacccggccagccgctccctccgttcccccccggtgcgcatggtccgcagtgagccgtgaggctgcgcatgggcccgccgcaccgcgtcctccgcgaaccgtgcgcatgcgccgcgcctccctccccaaaccctagcacgccccgcgtgcacctcgctcacgatgagccgagtcgccgacaagcgggtcccacccgagaccacgcgggatggacccggcccaccggctctctctctctctctcctccccgcccgcgcgcgcgctttgggccgccttcttgggccggccggcccattaagctcggccgggccgcccctttctctcgggccgcgccctagccgcccgaggaaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatttaatggcacacttagaggtcaataatagggctttattttcgccgttggcttagttgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggattgcacttaatctgcttgtcccgtctgcaaggcagattggcggacctacctaacttgttgcatttgacccttccattgtaattgttataccatgttcccttgtaaccgcctagttgcgcctcagtaatcgtgcactctgcacgagtatcgacggtcgccttcaaacttaaaatctgagaaacatcttgggtaaaacttgggttttacaaaagatttggaaaacccgacacctgggtcggtgcttgcgaacctaaatgaatttccaaaatcgcggaccggggaacgtaccgggtgtatggtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacgggatggtgtcggggaggacccccgggtttcctggcacagtatggtctgggacctaatctggtgttggtctgggacccctctcattggcatatggtgaacctgtgtcggcttttgaaatgccttgtcataaaagccttaaggtctctagtcgtggctgttctgcacgggctggatgatccgggttagtaatgtcgtgtgggtaaagtgtaccctctctgcagaggttattaaactgttcgaacagccgtgcccacggtcatgggcggatgtgaggtgattcctagcgtagttttgtttgactactgcttgtgaaatttgctgatgtggtttgggttcgatgtttggaaaacctgcggctgatgggatcagccaggcccgggtggccgtttaaaagccgttggccgggtgccaaccttgatcaattcaaaagactgataccttgcacatactccgaccggacaagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtgctcacccttgctctatataaataatcccccccagttgctgaagaagatgaagcggatcccgctgacgaggagttcttccaggagtaagccggctacgatgagttttagggtttcggcctagttcccaagtcgcgcctgtgatgtctggcccaagtcttggcttccgctttccttttgtaatgcagttgtgagctcgggatctgtccgcagcccaacatgactgtaatcctactctataataaagagacctctattgctgtgatattctgtcttcctgtgataccagcactgttacctgggactggtatcgattaacaggttaatttggagcgtcatgggctagttccgctcgggactagttcggaacgtgacagttttgcaatcctctgttttacacttacatttctatcagaatcctatgttttttctattcctctgtttttttattcctataattcaaagagacccttagtgcctgtttgtttcctcttcgcctttgcatggaggaatacttttaccacccttgcagacaacgtaccacagattccacacaatattgatcatctctctctctctctctctctctctctctctctctctctttctctttagttaattatattaggacctacctggattaattagtttgataaagtcgtaattgtaatacagcatgcatgcagctgctggtatatatatatcgcccccatagatcatattgataacgcacaacaaaacaaagatagaaacaaagtgctgttgaattaattgataaaagagtactagcacgcagtaacaatataacgacgtggaatagctcctgttctacgaagaccacactaacttgctctgaccatgactgccgtgtcctacacattaatccaagctataattacttgattcttaatttgcttacaattccttcaactactaattaagtatatcaatatattgccggcacaattcgcacatatactatatatctagtctaatggaattagtggagtatagaaatgcttgggaactttctcaagtctttcatgcatgcagatatatattctctatagataatatgctccggatatgcaatggagtccggaccaaaagtgtggatgcatgcttaattggttcgttagttagttatcttcaatcgtatcgatcgatcgcatcaaaatagggatatcatatatcgatcggatcgatcttgatttttttttcctctcttcatccatcgccgccatgcaggcgcgccggcggcacgccaggcagtgccgtctggtcgtcgccggcctcatcatcgtcaccacgctcctcttcttcaccggcgacgcccctcgcgtcttcatcgacgcgcccacgcagaaccagctgccgcgccgcctgccgctcagcctcgccgccgtccgggaggccgccacatggcccgccgacgccgtcctgctcccggactgggaggtcctcctgctcctgcatcccaacgccaccgccatcgcccacaacgccacctgcgcgttccagggcgccgcgtcgtcccccgcgcgcgcgctcgggaggctgccgtcctcgggccgccacgcctacacctgcgccatgccggagccggcgcgccgccaccagccgttccacgcgccgcggatcgtggctatggacgccgtccatgcctcaccgcatgatgatgatgagctggtgatgatggtcaagtggagcggccgcctcgtgtacgactcggtcgtggtcgacggcggcgacgtgctcgtcttcgccaagggcgtcaacccacgccagggagtcaaccgcccggcctcggacgtaaggtgcgtctactaccgcggccgcggcggcagcgccgacgacgtggtggcgtcgctccccgcagccacgtcggcgcagcaggtgttccggtgcccgcctccgccaccagcagcgttgctacgcgtgacgctcgccctcgccggcgaggaggagcccatcccctcggtggcgacctacagtctgcctccagcatcggcggcggcgacgcacaagagacgacataaaatctgcgcgtgcaccatggtgcgcgacgtgggcaagttcgtgcgggagtgggtggcgtaccacgcggcggtgggcgtgggccgattcatcctctacgacaacggcagcgaggacgacctagacgagcaggtgcggcgtctcacggcggagggcatggacgtcaccacgctggcctggccgtggcccaagacgcaggaggccggcttctcccacagcgcggcggtgcaccgagacgcgtgcgagtggatggcgttcatcgacgtggacgagttcatcttctcccccaactgggccaccgccgcctccccatccagctccatgctccggtcgatcgtcgccgtgaagccggacgtgggacaggtgtcgctcgggtgcgtggacttcgggccgtcggggagaaccacccacccgccggagggggtgacgcaggggtacacgtgccggcggcgagcggtggagcggcacaagtcgctgctccggctggaggcggcggagaggtcgctggtgaactcggtgcaccacttcgagctccgggaggggaagcgcggcgagtggaatcggcgggcgcgggtgaaccactacaagttccaggcgtgggacgagttccgcctcaagttccgccgccgggtctctgcctacgtggcagactggacccaccgggtcaacctccagtcaaaggaccggacgcccggtctgggcttcgacccggtccaaccggccggttgggccgccaagttctgcgaggtgaacgacacgctgctccgggacgtcacgcggcggtggttcgccgccgccggcgagagtcagctccaagcagcccgttgatcgatcgtgcgcgattaggagatcgatgatgatgcttcattattagcgcgctacaggtatattacatgcatacaacagacaattaattaaagattgattaggtttgagttgatcgaacaactcaatcgttgattcgttcatccatttttcctttttgttggttgtttttggcatgtatatatacagttggctaaaaaaattttcttcccaaaggaaataatatatatgtagcttagctgtagagattaaattaacacgcatggttatgaactgtatgcgttacagcaggctgaattcttttcttgctgcaacaggcaagttaagtatagacgcagggtacaaaaggtctctcaaacgttgaatatacacttcattcatttgtttatatgctcaaatctcatccgctatatatgtatatatatatacgtatacgtatatacatatatacgtatacgcgtgtgtgtatgtatatgtatgtatgtatgtatacatagatatacatatatatatatatatatatatatatatatatatatatatatatatattctattaatcctagtggacttaggaacaggaaagagaaaaagatatggagaaggtactgtgaaaaacgaaggagaaagagaaagaccagctagggcagcaggaaaatgcccccctgatagagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattaatatttggaaatgtttaatagttcaaaaatatatacaaaaccagcacaatataggaagtaaagttgaagatatgataacctacttagaaacatttttaggtgaatctgctaaggttctatgggaacaattggttgaaaagaatcctaataattatgaagaattgaaaagagctggtagcaatccgcataattttgcaaatgttatatctaacattattatagctgaagatccggaattaggttatacaactttgtagaatgaaagattaaaagaaatagaaaaattaacgttaacaagttggaaaggcataaaagaattctcccaacattatttatataatgctacaactgctaaacaaggatataacaggggaatagttgaacgttatttcaataaattacctgacccactaggaagtatgatatttgaagaatataaaaaggaaactgaaggagctgaaatcaacatctcgcaagccataacttttgtgtttaagcaactaagaaaaatatgcacgggtatccaagtctaaagatctatgaaacactcggattacaatttctgcaataaaatagttcaaatacccttgtcatatggagaagacaagcctagaagtaaaatgatttataaacatcaaaatagaaacaacaacaacgaagacaccattcagagcaaagcttccaagcgcgctctcaccctccattccaccgttcttagtagtagtgactttagcctaccttgcatagtatattgaagcaaggagttgtgttataacgctgtgtaaggtaagaacagcttgcttgtacttaccttcgggtttcccgaaagggaaaaccgtatgtaagcttatctgtttaatatgaagtaattttccttaagtattcctgcacgtttgttctaaacaagtgtttatgctaaggaccctataggagaaacctctttggtttgttctcgtttttagtctgcatcttgcataggcgtctggagaatcggtatccgtagagaagtgttcccttctggtggaactgcctggggagacgataaactcttagctagaacaagtgtgacttggaatatctttttaagttgcttctaaaaagacagataggtaaggcatacggtgagtaccgagtaggactttacatcatctgaaacaagcttctgaggctgtctaagtaggattcgccaccctgcaaagatcctaaagttaaaatatctctcgaagtgaacagtattgaacagtaatttgaacagtaaactgaatagtaatcagccgaataaatagtgttcttgaaatattgtatattgtctgaagtatagttatatatatatatgtgtgtgtgtgtatgtatatgtgtatgtgtatgtatatatatatatgtatatgtgtatgtgtatatatatatatatatatgtatatgtgtgtgtgtatatatatatatgtatatatatatatatatgtatatatatatatatatgtatatatatatatgtatatatgtatgtatgtatatatatatatatatatgatacccatatgggactccatggtgcccaggctccaaggtataaaacacacaaattctctcaaatttttaaaaattttcaaattgtgagtatatacctaggtatatgaatttgattcatacatatacctaacaacaaaacaactcaaactcaactttatttcacaattcattattacatacctaacgaattatatgtttgaatgttatatacctagaaccaaaatctaaccaaaaaaagttcaaactcagttcaaacttgtttgaacttgttagtaaagaagttaatgttcatatctaaatattttttaaaaaattcatgctcattcaaattgggtatatactcaatttgaatcttggagcccatactccatgtagcaccagttaatttacctatatatatatatatatatatatatatatgtgtgtgtgtgtgtgtgtgtgcgcgcgcgcgcgcgcgcgcgcgcttgtacctcgtgctttggtttaggatgagttgtactaatttggcagcaaataatttgggaatttttgtgttgtggtgtagttatactgtaatcacattaaaaatctcttacatgtgaatatgtttctatctctcctgctccctctgttccaatatacttgcattcaacctttttaatcaaaatgtatgatttctacattctaaagcaattttagaggtgactatgtattactccacaatacaacttttatgtttgatttgaaaaaatattgctacaccttatttgccacgagattttctacagtgccaagtaaatttaaaagtaaaataaaacctgtaggggtgatatgaattactaggtccttaaaaatattgcacgtttatggcctgttcagattgtagccaaaataaaccttaccgaattttggataccaaaatttttccgatttggcaatattgccaagatttcttatttatttatcagaatttggtaagaaaataaatagatggacatatttggtaactttactcaaaaaataatatagtttaaaatgacattaatctgaacaagcccttagatctgtaaactcaaaaagggccatataagtgcaaaaaggcaactgaaaagtgaaaaggtccatatgtagagcccgattatactagactggtccaagtgtgcgtgttccgatgaagagaggagcccacacgataccggcctgttttaagtctaatattgggcctagtagccttatgctaggatggaatataatatgggcttttcggcctgcaacatttgttggtaatcgtaggcccatcccattggactgacagacatatagacatatcagtaatcagtagtctactagagtattaatttggatttgtttgccaacaaaactttgtggtaattcttgagaggcttatttgtgttgtttttttgttgagtgtgcttaattgatatatgatgcacacaggccggattaagtcatcttatttttacaacaatgaaagatgtactactgtctgtgcttttgatgcagacttcttgacgtgtgaatgagagattaggaagaccattccatgacaacattgctgaaggatacaaatagaagccgtgtatatgaaaaaatgacagtatgtacattgattagtatagcaaaaacgtagcattgtgctatggtttttgtgtttcatgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagccatgaagggggccaaatccaagggcgccgccaagcccgacgccaagtaataatcaatctattctcatctccctttaacatctctattctatgttcacgccgtcgcagatctgttgattttcgccgccgcagattagattttgacttgatttttgttggttgcaggttggctgtgaagagtaagggcgcggagaagcccgccgccaagggcaggaaggggaaggccggcaaggaccccaacaagcccaagagggctccctccgctttcttcgtttttatgtcagaccacttccccgattttcttctgccttcttttttttttttggaggggattttcgtttgatcttgtttcgctcagggaggagttccgtaaggagttcaaggagaagaaccccaagaataaatctgtcgctgctgtaagtttttcttttttgtttcccctctcgttcgtaaataaaaactccactactagagtctctggcttacaattacaattattattattagttgcaccgcttattagatgttgtatcatgattcgtggattttattttttcaaaacaaaaaattcaggtaggaaaagcagccggtgataggtggaaatccctgaccgaagcggtgagtttcgtctcgtcgcacatagagatagtatgatttatttaagtgttagattccttgtgcccaagcttatatgtagccatggctgtttgattctaggacaaggctccctatgtagccaaggccaacaagctcaaggccgagtacaacaaggccattgctgcctacaacaagggcgaggtataaacaactagattaccttgtatgcttgccaccgcgtccaatttgtttattgttctaaacatatgctctggtttgtttgttcagagcactgccaagaaggcacccgccaaggaggaagaggaggacgacgaggaggaatctgacaagtccaagtccgaggtcaatgatgaggatgacgacgagggcagcgaagaggtactacatacataatccttgtgatcaattcagaaaatagtatcgcattagttcgttgtgtgaagcttagctgactatgcctgaggcttgtacgattaggagtacgattcacactttgattaggctaatgcctcatgggtagatatagaacaatagttagtttgagagatgtatacaaataggctaatgtctcatgggtagacagaagaacaaataggtagtttgaaagatgtattttcaagtgtgacattctcaaaacggaaactgatgaaattaaaaatggttttggggattgcaggatgaagacgatgacgagtgagccttccagtggacaagatgggagcagcaagacgctaagggcggcgggcgtcctaaggagcctatccatcatcatcatcgtctactagaattattcagtttcacttcacatcgtgatgttttactttttctctcgtcctataacggatagcgctccttgttggcgccactggtgggtgttgtggtgcagccaatgtcttgtctccaccgtcaatgatccgcttgtacctagattactctttccattgtcatcggctaacattgtgataatatcagtttgcgtatgttagattaaattgtttctaattccgtcgttttcttcttccttgcacttagcttgtgataaaattgctttgcggtaggtaggtactccgctagctaattgtggtcgatcgattgcttgtttgattgcggatcacactagccagtgttgattttaagatttgtttttcttgatgctccttgtctgtgcgcatgttgcctacagtattaataggctttgaaggattagtctgactgaccctccttgagaaaatgagatgagatgagatgtgtatgaacaaggcaacgttgctgtttgtgcattatagtgggggctaccacacgggtttaactccatctttcgagtgagatggagttggttgatgattattgcaaagagagtattgcaagtaatagtagtaatgaaaatgcagtggttgggattttccattttcttaatcggtggttgtggtgttttggtgaaataatagtgagtgaggtacaccagtagaagaggtttcggcaggtctgtgtcctacggattgccgacgtcttctttggtatgatatggtttggcctcgacgaagttgatgctgcctcctactatagatagttgcaggatggttttgaagttgatgtctcctggtccctccctggcctgtgtgttgcatttgcaattttgcattgacgatgcatagcacagcacggaacggaggaggcaatgctgcaggtaggagtaacaacgtagtagggcctctggctggtgatggagtgagcgtccttttgctgctcgaaatttacatcgactgtctggattggtcagcacaggaaggagccgttagatatgtgaaagtgattatgatgagtgaggggactactatacgctcctacggcggattcatttcgtttcgttggccttgtctccatgcaccaatcaatttgacgccgatgtttaaaatactcgtctatttattcaatactccctccgtcccataatttacaaccgaccctagaactacgaatctggacataagggaagtagtaacattatgggacggagggagtagtaccagtacatattactactccctccgtcccataaaaaacgaatctgtcttcgtccgttttctaaccaggatttgaatctaaataaaaagagttaattgaattcatatatcatatcataaatttacatgttttaaaaatactcttattatgtactcgctctctctagtcctaatattgttgacgttttgaaatgagaaaaatcccctgtgtacccttgaaagttcacctaatcccttacgtacccatgaattttagtttggaccccttccatgccctttccgctagttgaccgttaaattcttatgaaaaagtctattttgccctttggtataaacaagcgtataaattaatggagtatattgttggagcatagaaatttgttatatgagactattatgtttataagatagttatgcaccatactatttgcgataaacatacttttagatatgaaataaaaaaataatacttatttattagttattaaaagatttttttagcatatatgttctgaagtaataacaaatctgttatattactatgaaaacacatatgctacataaaagaacttttaataactaataaataagtatcaacctttttatatcatatgtaaaagtaaatctgtcacaaatgatatggtgcatcacatactcataaatatgggctgcagga

SEQ ID NO: 64971 - DNA, 3456 bp, Oryza sativa
  unsure (1)..(3456): unsure at all n locations
taatagaatcctctgctattttataagctgtttgttttcaatgtgcaacagtaagctattcgtgtgagtaggtcagccaaatgctgagaagctaggtggttgtttacaaccaaagattatgtactagaatcctctgccattttataatttaaccgaaatgtttccacagcctcttggataattcagcacaactgcaaagggcagcacctcatgacagagctgaggagcatgtgaggactcgaccatcaagcaagaacgaatgatctcattattcccgtttgttttttttttgttggggggggcgggggggggggggggggncntnnatnnnnnnnttnntnctgntnnnncnntgcnntnttgaancctncnnntttttnngacatgttttgttgattttggttaggcgtagttgcttaacacattgcaaagtcaaggtaagaaaaactttacttacgtggatttcttcccaattctaatcatgtgagataggatatctcatacggagtacagccacccctacaaaattgatttttctggatgagaccctttttaggttgtacacggaccataactgcttccgcctacaaaaatccctcccacggggtcagttcaaagcgttgcatgcaaaataacatttgcatgcggcctcttaagagatccacctgtaaaaatggactaaccttttcaggcgagcctcctaagtggccacatgcgaaaatcagatttttacagacgcctccttaagaggtccacttggaaaaatcactgcaaactaaatataaaaaccaaatccactccactccacctttcctctcttatcctctcctcctcctcccccccctcccccctctctgtctccctctccctcttgagcacgtggctggagcagcaagcgggtcggcgtttggtcgcgggtaggagcgactagcgttggacaggagtggtagtgagctcggcgacatggaatccagcgtggaggacggtgtgagaggcggtggtggcacactcgtattgggtatcggtgccctcggctacggaatctgatgcggaggacagcggactcaggcggccgtagcaatgccctcggctagggattcggcgtggatgacgacgggagcagcggaagcaccctcgaattgcatggtggtgccctcggttgcgggatgcagagctcggccgcgggatttgatacagaggacggcgggagcggcggtgatggtatcgggcgacaacggcggtgtcctaggctatgggatctggccggagtgatgagctcgaggccgacggatctggccgtgccatcctcggcaggggcggatctgccacccttggccacataagaggtgaccacgacattgggtggcgacagcggatccgacggcgccaccctcgggagggcggatcagccacccctggccccgagagggtgacgacggcattgggcggagttcgagggcagcagatccatcccccctccccccgcgggttgatgggccttctttatggatgggcaataaaatttactttcacttctgacaaagctacgtagcaaggttgtacatggtcagggctatactaggctactagcaattttttgcgtgagctgctcagttttgtgaacttcttctccttcatacttattattctcattgtagtcgaggagtatctagacggtaccttgacgctctctaggcattcaaacatactttcgttctcttccttactcaagtaatggcttcctttcttcttttgttccggatgatggccaccgcgttgttccatatgcttgagatcattacgtgcttcatgtgtatcttttgacttcctatatacacctaggaagcccagcaagttgacgcaaaggttcttagtgaggtgcatcacgtcaattgcgtggcggacatccaagacttcccaatagggtaactctcaaaaaaaatagacttcttcttccagatcgccgcgtgcgcatcttagctctctataggttggttgctagctccctttccaaatactactttcagatctttcaccatagcaaacatgacttttccattgcaatgtttaggcttagtacggtggcttgccttctgttcgaagtactttcctttcttccgtacaggtggcttgcaaaaaggaatcgacgatggcccatgtacactaccttcctacaatgttttagatacgtactttcagtttcatccatgtagtgggtgtgttaacaacagaattttgtatcagatccggaaaagaaggaacaagatcgaagcggatttgatgaatgatcaagttgtatttgaagtcggaccgcgcatcggctgggcattgtatcggctggagacagaatagaagtttggcttagccaatatggcaagtggccgatacgatatgacttgggctcgtttcgggtctagattggaataaccgtcattgtcaattagagatagagctcgattaaggcaattgtatatattaattaggatatttaagtcgattgttagagatttggcaacagaccgccatgtggtcttgtttgtatcttatctttaggaaagtttgagtcgcgttcataatggactatgtttgtactcggggtacaaatatgaaccccagagcattgtaataagggaaataatccaatacaacttcggcgcatcgtcatccgtttttgttcttcttttcgtcgagttctctcgacaagaggtaactcgtctcaatggcttgtgctatcggggctactatgtcgttttggatgttatagttcttttatcataaccatctgttgtcatatgtcttagttaatttagtcttagtatctcaatttagctctatcggctggtactcgttttggtattggctaaatcgttttactagattagattaactaaggcatctactatcttgaaaagtaattaattcgttgattgtttagactttaggtttctttacctactttgagatgcctcatccctagtcttgtctagaaccctaaaaactaatctgaaattaattataattagatatagaatcagagtttcagctgatctttttttaatatacatgctactttacttgttttatgtatatttatcacttatatagatagatcaacatatataaatacatcaagtctagatcagtaatcagctaggtcatcaaacctggtaattgatctcaatttgatatactagtcaccaacccgtgcgttgcacgggctattgtcatgatattgtgtaattttaaaatatagccagttagatttaaaactttgtccatattacttataatttacttattatttatttcaaatttcgaaatattatgtgtttgatatgggtacaacttcaagtttattaattccgactttctatttaaaatgtcatgctttattatttgggtacaatggagaaaaagtgaaagtcaacgatatttcctattgtatatttatttaat

SEQ ID NO: 64972 - DNA, 547 bp, Oryza sativa
gcgaattcgagctcggtacccttctctttctggttccgtttcctcttcctttcccaaaacggcaccacatctgtttcccgcacctttcctttctaggcaacccctcctcccgtatctttttcccctccccctctcggacttctcccagccgtgcgcctcccccctctcccagccatgctcctactttgccctctcccctacgagtccctccctctccccctctgccgggcctcccttggcccacctaatcctattcaatcttcccctatataagccgacctctcccctcctgtttcctttttttttgtgttgcagccacccctagcctaccttccccttttcccccttttccccccttcgggggttttttttttttttaaaaagccgccttcttcaacaccctagccggcgatgccctagtcgccactgccgctagccgtcaccccttgccgtcgtcgtcttggtcgttggcgtcgtcttctcaggtgagctcttctctctcccatgtcgtttaccggtgtagtttatccctaggatttaatctaat

SEQ ID NO: 64973 - DNA, 1921 bp, Oryza sativa
gtacagatctatctccgaaccaggaatgtaccattccaaaccaggagcaaatcaaattattaccagttatcgcatcatttattatggtgaaaagtgtgagactaatcacgaaagacattgttatacccgctcataaccgcaggcacggctattcgaatagttttactctggctagaagtgtaccactatacccacaagacatgattccacacatgttaccatgccttgaagtaccaccacggcactacaaagggggaaatcgtgacagtacccttcgcacaacacaactcaaagcagtgcaccgtacctggatcataatcacctccttatagacaaggcatggactccccagcgacccccgtgggcttatctccgccacttctcagtctggtgccccgcaataaatcatgctatataaaaggtaaagtcgttgcccatgctggcttgtggttggcacggttaatgtttcacaactgaaactcgtgaaccgtctttaattgtcatgagcacgaccatcaaaaccatgtgctcacaatccaccattatcaagttttagttggcacattaattaattaaccaatcacgattagccatcatgagctacaattaaatatccatcattaagtgatagtgaaacattagttatcccaatcatgtgctaatgtttctaagcatggctaagcaattatatttaatatctagctgaaccaatatataagtccaactagtcaaattgtcacccatggtatcaaagaattaagtaagcaatgcaaagtggtcataacaaaggaataggttcacaccacccggtgacattccaaaaataaatgcatggttgaaataaatagagaatttaaatataggatcaacatgctcaaaggaattgtgtttgggatccgtgtgacttgccttgcaatattcggtcttcaattaatcttcttggatacttccaacgcactcacgaaccttcaaaacgacggaaacgacaagctaacctgcagaacgaggaaaacactaagaaactccaaataaacagtacatataaagtaaacaaacatgtagatcatgattttagatgaattagagtcaaactagtcccggttcggatgacttatctctatcgggtgtattctaaaagcccgtcacggatgactaatctctaatgggtaggactctatagcccgtcacggatgagttatctctttcgggcattagctaaatgtccgtcaaggatgagtttagaacaaaaaaaataaaatttggctttttggctagcctcaggcctttgctagccatgcccgctgcaaaaatgacagaagcatatatatacatagtcccattcccagcaaccccattcccagcatcaattcacaaattccatcacagccatttcatatagacccattcccagcatcacatcagccaattcacattcatattccatcatagcacagccaattcacaaaatcaaacacatatacattcacatccacaacccattcacatatatatcattcacatccatttttctctccaaaccgccgacatgcatcaaaacctgcaaaaataagttataaattggaacaattttatatgtaactagaaatgcaagtatacagagacgagctacctaggactttactctaaagaatataattgtattacaaagaatatttacaaaaatcaaatgtttgtcacatatgcattgcgaatgttctgccattgcgagacgagctacctaggacttcactctaaacatccctttcaatgacaagatatcatctagtatgaattgtgctagctcctctctaatgatttcgaagttgatttccggaatccttcaaataaatttctgcacgttcggcgccaacatcgtccacctctgttatggtgtagacttccttaggaattttattctggg

SEQ ID NO: 64974 - DNA, 5565 bp, Oryza sativa
  unsure (1)..(5565): unsure at all n locations
aaaattgtctcatccgacattgtgattgtaatattataaaaaagacatagcatagcaccttaccgactcgaccgcatagcatgggaccatgagaataacaccgacaagaaacttctgctcctgtaaaaagaacacaaatatggcaccaatgagccaaaatagcaagtcaaacacagctccagatatatgaacacaatgcttcaaattgtaaatgttgattgcacctctgggttcttgtaggctgacagatgattgaacagcaagaacagagatagtgaaagcgaggtgatgacaaaaatgccagcggtgattgaagcccaaatagggggcgcatagctcctgaaaactgagtacagctgctctgccaattccattgttctctcttgtctccctcaattctactcaaagtacgccactattagagctaccaatatattgacagcctcctcctgtttcacaatatggttcataaagtatcataattcacaagccccaactgatactggagtcctttattaggaggcagacaccaagaggtaggattatgttcttccaccaaatgcacggtagtattcaactgcaagcacaaaaaagactgaaatttttatgggcaaatcccagatcagaaggaccagcagcaaggacatgccctccatagaaaggagtaccagccgaatttaaatctggagaaaacgaggctcataaattaagcaaaacaaaaatcgcatctttccaatcaaactcctaactttgatgccgccgtgaatcagaaacaaaaaaaaaacgcaaatttctgccgaatttccatcgaaaccaatctattttactgctaatagccctatagagtgccccactgaggagcaaaaggagaatccgcccaaggaggggcaatgaatcgaagaacagatattacggtctgaaacaacacaaacctggaggatcagatttgtgccgcaagagaggagagccaatttatgaagtgaagggaataaaagaaggaagaagccgaagaatccaacgatcaaagttgcgtctggatttggaatatgggatttgggatttggagaggagcaggagttaggagaagaatgtgttgcattctaattatgatctaattagaatttggagaggagcaggagttaggagaagaatatatttggagaggagctttatgatctaattatgcaacacacaatgtgttgcataattagatcattgttgatgagactagaagggtaggtggtggggcggaatcgtagttagcaggcgatttgtgacgagaaattgaagttcagaagtgagaaatctcgtcatgagagaagagagcacttggttccaacattttggagtctatgctgatctgggcccatctttcctttcttgtcccccccccctttttttttcttgctaatctaggtctctaactaactttttccccttatcttactagttacaagcccgtgctaacgctacggtgataattaaaagtgaaacaaccgagtacagaagctttctttctcacaatataatgcaatataaatttctatatatcaagtgcgctgcacaactctaattatgcaacacattgtgagctagtggctgaacaaagaagtaaaaattgcaacaaggtgcacacatctaaatgtaaaacattccacaacatatattttttgcacataaatatttggaaaatgagtggaaacaaaaagaaagagagcagaataaacaccgcgtgctaaaaaatgttgagcttaatggttaagaatatttagctccagaaaaaaatctctacaaagaaccaaaccatagaacaagtcataaaccattttatctgattttaaacttctttcacttcctagaatacatgaagctcctatggtataaatctgattgttctaattgctcctctgtttaagaaatgtatctaaagaacaagatgcaatgtggtgagggacactcaactttcaaatcctggtagtacatctccggaaattagaacaatagtaaaagctcggaaattcagcaatgaactttcaagtctttacagggcatatttcataaattcatagtgatgataaaaaattcagcatatgagcttcatgtattctgggcagaaattcagcactgaacactcatggtataacatttgatatgttcagattgcataatttccatgtacatcaaaattattattaaaggggtaaaaaaaggatccaacaaaatagaaaagaactgctacctgtggcaagtaattttctgttaagatatcagtaagatgtggcaggtaaatgttaaaattgcaaattgtcagttcttgtagcattattgaatagaagtttgtttattgcaaaagtttgagtgagctacttatgagatgtacgaggggaaacatgaaaacaattgttgcttgtactacatcatttcctcgtgcttttagagggtgatgtcaagttgattgttatttgcataagtgaaatgaaattgaagggcattagtggttgagggatatatttgaacaaaccgtaccactctataatctatatattaatcaaacactaatgggatttctgcatatatccttgactttaaatggcagaattcccaatgaaaagaattacaatgcatgaatcaaacaggcaagcctagcacattcatacttttttctattttcgagaaatacgcagaacctacattcagttttgtatgggcgagaagattcaatcctggatataagaaacaatgcatattatgagacaaaactagagtgaagtagacaaatagaatggagaatatgtggatcaggttatttatttattcgggcaaaactgtgtacatggaatattattttagatttggttcctacaggttcaaaagagctcacatagtcaatgatcattctaaatctaaagaacacaatggatctaaacctagggaactgatcacagatgcacgccaattatcagatatgtatgtactccaataagcaggaatatagggtcactgatacactgcaaactagtatttatttcttataaaaaaaccaaagagattgatttgttaggaggatgtatattgtacctgcttggaactggactctgcaagctgaggaatgagacgagggcatggcctgacgaggcttcgcttgatcctgcagcaattccaacctcgaaaaatgatctgaaacctgagtatttttttgtagctggaaacattttaactggtaaattttgtttctcaaactatctaatataaaatatcataaactaaaaagaagtgaaattggggactataaaagtcacaacaagattatgtatgcatgaaaagacacggaagcatattgaaagacttccacagctatgatttgtgtcatgccaacataaatcaacattattaataaaactagtgaatcatcagcacgcaaatacacagatccaaaaagaaaaaaaaagaataccatcgatcaatcaacactcaagttagcattcaccttgagggagatgtgaagatgggcagctaaggagcggaaccacgggcggcggagggaatcgaagatgcaggcaggacgacgatttgcggtgcggggtcccggcggcgagcggcgggagatggaggcgggggaaatcgacgatttgcgctgaaagggggcggcggcagcagggctgaggggatcgacgacggcgattggatttggatggatggggggcggaggaggaggaaccctcccgcgtaggcgtagcgtgctctcgatctgatacgttcgatgattttaatactactttgaactgaactataagaattttctaatatattttacgatattcttataaaaaaatttggtgagtgtttgggaccgaaacaattttatatatctactcttattttttctatgaatctttcatacttaagattgattattattattttactgcacggatagtattgcgagttcaaggtgaaaaatacctatncnncgcggtagggaatagggaatagncntncacgccatataaaattgaatctttaaaaaacatgaagggggattaaaggtgtgtttagtacatgttaaaattggaagtttggttaaaattgaaacggtgtgatggaaaagttgaaagtttatgtgtaggaaaattttcatgtgatggaaaaattggaagtttgaagaaaaagtttggaactaaataaggcctaaaataaaaaataaaaaagatgaattcctgaagcaaaaaattcaagttgaaatatagtgcaaaaggaataatttgaagagaaaaaaaatgacaagaaaaaaaaactgaaaacaagaaactagaaacttcacagtactagtagtacaaaacaaaaaaaatcagagaaaggtgttaataaatcaagagagagatataattcctgaccggcgttggactggcgcagccgcggcgattggagtggaggggcgttcccctccggcgacgattgcttggggagacggagattaatcgatccaagtattgtttattaactcgtgttgtgccgtgtttttttttccctttaataaattggcctaattgtactgtacctttcgttctcttacctaaatctgatggcctgttccagaactctccagttctctcattcatcttcttgtttttcttttctcatagccatggccatttatgaattatgacagaaaattaatcagattatccattggattggattgtttatcacattaaagaaaagtaatcagatccgcagttaacttatcccatcatatcagttcttctggcaaagtgcgtgtaccgaatgtcagctataccggatagtcaacttcagagctcattcacatacttcagttcaggaactaatacagttattacaagtcccataaaaacaccaacaggcgtcaggccgcttcattcagttcattacactgatcggcaaatggtcagaaagttttgcaaaatgaaagtgcttctgccaaacttcatatgttttcctgccttttctggttgatcagacattcaaactcatcaggatacaccaacaaaattgtgtcctaaactcctcaagttactgttctgggtttcaactgtctagagcttaggaaaatgttcaggtttgttatgctccacattgaatcaagaaaagtacccccaatcatttttagtgcaaatctgagcatcggtagaatatagtggagcattttatgtgaatccaattgacaacactgcatattgtcatcaattgaaaaccatgcctgcttcaacctcaagcagctttctccaagccaaaagcaaggcaaattttgggcacaaagagttcagaattgaatttctctaacaaactggtgcaaagagaagtttactcatagaacataaccaaaaacatggtaaaatggcacagaccacagtagaggtagactcaactcaagatgattgaacaggcaattcaattaatgtttattggcaaattgcatgtgccacagaacaaatgaagaataattctcttaaatacaacatgaaatcaagttccaacagatttaattggaagcaacctaaaacatccaaacgcagatcaatgtct

SEQ ID NO: 64975 - DNA, 854 bp, Oryza sativa
ttttcgaccgcctcgtccgcggccttttcagccatgtttttccgcctcctcttcttcctcccgttggggctcgccatcacactcttcgacggcgtccacgtcatcggaatcggaggaagaagaaccctccgcttcctaggggcaagcttcacctgcccgcgcgtcgcaggaggcgaagagcggcaaaacaatacctgtcacatagacaataaactttatttgcaggaacaatgtaggtttcggcatgagcatcggtcgaaagggggcgccacataccataccacatggtttgcacggtctcggccgaagctccaatctcacccttgcccgtgaggggcttgttggcggtatggcaatgagggctacaaatagtcccatagggcatgaggccctttttttttttttgtcgaagccatgcgaacagtggggattgaagcccgagacgtcaagattagtcagggcgaagtccccccatggcgaagactatggaataacgacggcgagaggcggggaatcacatgggtaccttgccaagccataaggcctcttgggcgaaggatgcagggcgaagagtatatgccgaaggcgccatagcaagttcgcccccgcaaggaccgaagaagtctttccagcccatcaagcctaggggctattgggccgatgatcgcccgactgcccatcaggggcccgtgaacctcaattacactatgtacccatataaatgtccctttcataagggcaaccatgtaatttcccatgtataaccacaaccctagtagtaagaaccagtaatgagggctataaatgttcccatagggtcatgtaatgggggatccgaagaaaaattctcaatt

SEQ ID NO: 64976 - DNA, 877 bp, Oryza sativa
ttaatcaaatctaaagaggattgacttaaaaaagttaaaataacttgtaatttaaaacagaggtaaattttctataaatttaattgacttaaaaaagttaaaataacttgcaatttgaaacagaggtagtatatttaaagatattttcagaatatatagggttacgtttattggattcgcctaatagcggcaacgaaacataattttggatacgacttttgtatttctacaattagtgatttcaaattaagttcagaaattaaaattaaaaagcacctataataatttaaaattaagtttaaaattttaaattttagctttgacttaggctgcaaattgctttagcctttcggatggaagtaattaggatatgattaattgagtaataaatgttatacacttgaaaaatatatttatttattttccaaaaaaccttcatatatatatatatatatatatatatatatatatatatatatatatatatatatatatatatatatatatatatatatattcatttgtttagatatatatataaagattgatccatcgagtaggtttagacatatatactgtacatgtatgtatggaatatatttactcacctttggtgtgatttctacaggaaaagaaataccaatgaagaagccgaacacggccgcggataatgccgtaaagatcgaacttgctgctttcatcttcgacctgcttttgctaagctaataaacttatcaaccaacaattaagctgttcgatcgatcgcccagctagctgctagcagaagctcgatcgatcattagcatgcttagctagcttgattgtcgctgtgctttgctcctggatcgactagctatagcctatagctgcgcattca

SEQ ID NO: 64977 - DNA, 672 bp, Oryza sativa
atgaatgtaagcatttttccctcatgttaccttctctcgattttttcctaacatgtttgtctagattaaatttttaagagagaatctattgaatttgttgttctataatatgctactgagccatacttaacttctataatatatcattgttgtgcagtaagattcattagtattgtatactcactccgtcccaaaaaaaattgaatataggactagatgtgatatattctagtacaataaatctggatgtatgttcaaattcgtgtgtcacattcaatactagattagttttttatgagacagagagagtaatttttttaatgaccgaagtacccttgagatgaaaacttttaaaatctgctgaaaatttcgaaatatcatattgtaaactagcactagaacttacggcgcgcttcgtggcgcccttgctgtgtaaataaggaaaataaataaggaggccctgaagagcctattcagtggattggctgtagcaccgctagctatagcattcaggttgtgaggaaaaccagtgatggattaagtagacataaaatacatagactgaatgttaacattgtttgtggagaagaatgcataatctagagtacattatacatcacaaatacaaccattggaactaacatcgataaataggcaggaaattatggggta

SEQ ID NO: 64978 - DNA, 2165 bp, Oryza sativa
ccttgagcacaatctacaaattctttttagagcaacgataagatatacttgaatactcaacaggtgttcatcccaaaaggaaaattcatggcaaactaggtcagtagttcaatgttcaaaaagagtacatattcagaaaaatatttgtaaggtgacaaacaatgagcaaatggttactgaaagcttacttttaacatcctgccgtataagcgacatcagtgctttatgaacagcatcacgctccacattttcctctaaaatacatgcagaactcagaagaatgcaaatgtgtaccatttgatccaaattaaaaatagcaaaatgattgtaccacttgcaaggagttgtccaaggatatcggcaatttttgagacaaattctgcatctttggcaagaagtggaaaaccacgaatagcttgtattctagtctgcaagaacatttaaggaggagttaatcatgcagaattaatggaacctgagacacataatgcatccatattgatctaaagaaaactgaagacgtaatgatgatattctaacaaatgtagtttatttctgaagaagagctcttgcttgcctttacacatgagaaacaaccattaagtgacaaaagactcttaagtatcaagtaaccagggacaagcatgagaaaaaaccattaacggacaaaggactgcattactcagttcatttgttcagcataaatacattaagtcatatatgaatatcagaaagcaaatgggcatcaaaattggtaggaacagtctaattttctatatgagaaccgaaaacaaaatgcaccagatacatatttcctagttaccacatatcaaatagtttctttcaaaaataaaggtacagtttcagttagatagaatactccaagaaaaaaatattataatatttttccacaatgtgcatttcgattgtagggtctatttggcttgtagccactttcaacccaactacctttattggtagggtagcaattgttacaggttaccaagatttggtatttccagaagttcacagtctcaaaatctctactaagatatggtacggcttcaaaccaaacataatcccaacactgccaaaatttggttcgtgcaacaaaccaaacaagcccttagtagcaacaacgcatggataagataataagagctagagaagaaataattgaaggctgggaagagtgaccttgtctcttctttctctgagtttgttcatgaaatgatgatgttcaacatgaagaaataaatgatagatgaaatcccagtcaacgcatattgtttgcacatattagggaaaaaagcttcgttggcaaacaaaagaaaatgatgcgcctaagcaaggggcagaaaatgtggcacgattttgccaaaaactcagtggaccaagcaagttacctaaacaggaaagacctgaattccagaccttaaacatataaaagctctagcaattcaggaattttgttttaaacgaatggttaaattagcaaataatgcaagtgactcgttctgtaattctgtaaagctaaactaggtcgtacacgagcagcattatctggattctcgaaaagggagagtgcataccgcgagttcctccatgtcgacgaggtcgaacatggcctccatggcgcgcggggcgagtgccgggaagctccggaagaagcgggggatgagctgcgccgcgagctgcttcggcttcacgctcttgccctttacgggccgtatgatcgcctcgtagtcccccgcgtgctgcgatgcgaaagcccgcccccgaagcaaaccgaaaccccgtcaaacccttagccgcggcggccggggcccgtagcgccaattgaacaagccgccgaggggggaaccgaagcgccccttggaccttgtctttgccgaagaaaagcccctccccaagttgttaaacccgctcgacttcccggggttgggcttcgaagccgcccatgccgccggggaaccggtttggaaaatttgggggggttagggtttgggaagggaagggaaggaaagcggccggtaaaagatggctggctcacctacgcaacgcaacacgagaaaccagtgaactcaagaggcaggtgggtcccggtgctcagtgtgttattatcattcgggaagcctcacgtaccttctggcgtgtggattact

SEQ ID NO: 64979 - DNA, 674 bp, Oryza sativa
tacagtagctcatcaatgcaaaacaaacagatatagtttgattagccttaaaatattacacgcttaattgtgtaatgcgtatatcaagctagggtttgatattaacccgtgcatatcagttgatcaacacatgcacgtgaagcactcagtcgctgttgatcccatggactgaattgccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattata

SEQ ID NO: 64980 - DNA, 551 bp, Oryza sativa
atcaatgaagaaactcggggatatgaaaaggatcagataaattctacaacatagaaagggttagtaatatatttaggaggtatacaaagaatttctccatatgtgtaccttgccagttacttgaggtttaatttgaacccgcaactagcttggttgattaaacgctagttcatcaataattgtctttctcttgacaaatagggcaatggagaacaagatggaagtagtgccaaggtatgtaaaatacaactatctatctgtttggacaaattttgtagtccttacaaagtacttgcatgtaccaaagagctatattaaaaattttgttaatttacctcgagataccttagaggtattaaattttacattgcacataccgatatctactcaagaagggtaaaatcattttactgtttacgtatatgtctatacttacaacattctgagaaaatctctcacgttaacgagaaagataagctggacgttaatgagcagaacaaattatcactgtatatagtgaaatttaattgaaaccctaaataagcacaact

SEQ ID NO: 64981 - DNA, 16386 bp, Oryza sativa
ttcagccagatggccgagcaagcaaaggcgcacgaccactctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcggatgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcagcagccgctgttcgccgttcggctgccactccttcgtcgactccttcgacccgggaagatcagcgtggggagcaggacgcccgcaccagcatcgagcgccggcgtaatgaccgaagtgctacccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgccgtacagcgaagggacgatgagtcacttcgatcgtacattcagcggttctgtcaagtccgcaataccataccatgcatccttgcacacgcggtaatctacgcgttcagggggggcgtgcggcacaaccgcatgctcgaaaagatcgcctccaaagagccccagactaccgcagagctttttcagctcgcagaccgagtggctcgcaaggaggaggcctggacttggaacccctccggttccggtgtggcagcttcggccgcccccggatccgccgctcagacagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgctcccagcagggagcgtcccaccggcaagtggtgcaccgtccacaatacctccctccatgaccttgcggactgtcgcgcagtcaaaaacttggttgagcggacaaggaagtgggaggaggagaggaggcaggagcgccgggaaggcaagtccccggcggttccttccggccatcggcgaagtgaggccaagcagaaggcccccgccgaggacatcgatgatggcgatgatgacctaggtttccaagagcctggggccaccattgccactgtcgatggaggagcgtgtgcgcacgtttctcgccggagcctcaaggccatgaagcgagagcttctggccgcggcccctactcatgaggcgacgcgccgggcgcggtggtcggaggttgccctcactttcgaccagaccgaccacccaccgtgcgttgcccggggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggcgtgacgccggggcacacttggcagctaggtcatatcgacctcccggtcaccttcggtggacccgccaatttccgcacggagcgggtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacgacaatgcccttcgggttaaagaatgcaggtcctacttttcaacgtactactcgaatttctttgggtagccaaatatgacgtaatgttgaggcttatgtcgatgacttggttgtaaagacgcacaaccaagagactttactctcagatctagccgaaacttttgaaagtctccgctccgcccgcataaaactgaaccccgataagtgcgtattcggtgtacctgcgggcaaacttctcgggttcttggtctctgcccgaggcatcgaggccaaccccgagaagatacgagctatagagcggatgcgcccccccagcaaacttagggatgtgcaatgcgtcaccggttgcatggccgccctaagtcgtttcatatcgaggctgggagagaaggcgctacccctgtttaagctcctcaaacgctctgggccgtttgcttggacggaggaagctgaacatgccctcactcgattgaaggcatatctcagctctccaccggtcctggtcgccccggagccagatgagcccctgctactctacttagcggcgaccccccaagtagttagtgcagcgttggttgtggagcgcgatgaggacaaccctcattccgcgcacctccaccctgtgctgacttagcccgggagcgagcagggaggagaggcccccgagccgaacggtggcctaaggcccctgacgaccggagtcggccctcagcccgctcgtcagacggtgctgggtgcccccgaccctcaggaaggccccgaggccactgcgggaaagccgcatctatcgccctttgaccccgaggctaaccctgtgcggactcgacccgggggagagcagggaggagaggcccccgagccgaacggaggcctaaggcccctgacgaccggagttggccttttgcccgcttgtccgacgatgccaggagggcccgacccccaggacggccccgaggccactgtgggaaggccgcccctgtcatcctccgaccccgaggtcatcggcacagaagacgagtgcgccccgagaggccacttggacgaagagcgccccggggatatggcccctagcgaagagaatcggccccgccgaaaggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcactttgaaccaagccacgctatcaagagccaggccctcgccgattttgtggcagagtggaccccggctccaaagaccgtttcagtctctgaggccagctcggacccctcgcagctgcctcacaccgcccactgggtgatgcagttcgacggctccctgtctcttcagggtgccggtgcgggggtcacgataacttctccgagcggagacgtcctcaaatacttggtccgtctcgactttcgagcgaccaataatatggcagagtacgagggactccttgccggactcagagtggcagctggactggggatccgccgcctcttggtgttaggcgactctcagctggttgttaaccaagtctgtaaggagtaccggtgctctgacccgcagatggacgcctacgtgcgccaagtatggcgcatggagcgccattttgacgggatagagcttcggcacgtgcccagacgagataatatgatagccgacgaactatcacgactcgcgtccttgcgagcccagaccccaccgggcgtctttgaagaaaggcttgcccagccgtcggcgcgacccgaccccttaggggagacggacgcgcctgatcggcccccgaggcccgtcggagcccaggcctcgggacccgaggggagcactcctagctcccttagattgattgcttggatctctgagatccaagcatacctcacagataagactctacctgaggaccgcgaagggagtgaacgcgtccaacgcatttccaaacgctacgtgctggtagaagggatcctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaaggattctattggccgacagctctcaatgacgcggtcgatctggtccggcgatgcagagcgtgtcagttccacgccaagcaagtccgccagccggcccaggccctgcagatcataccactttcatggccatttgctgtctggggactcgatatcctgggaccgtttaggcgggtcccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactccgaagacatgggcatcaagctctgtttcgcctcgcctgcccaccccagaagcaatggtcaagtggagcgcgccaatgcagaaatcctcaaaggccttaaaaccaagaccttcaatgttctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgcgcggccctccgagccgcgcgttaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtcccccggccgggttccgtgcggctggccacgggcgacggcactgagctgcctaacccgtggaacatcgaacaccttcgtcgcttctacccctgagaagggggggggggtcgggtctcaggtttcgggctcgggccaaccccgcacccccccctcgggtgtgcagggctggccgggggctaccacacatgcacattctcatttctcttatttcagtatttcaataaaagcagtttcaatttcctaagggctgtatctgtgccgttttttcctttttgaagaattttgacttgaaataaggtcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacggatcatcctcatctcatttgtatagcagagtaaaattaacacaaaaattttcatcatttttgattgcagattaagttgagctatacaaaaaagagacctgaaggccttagaagaaagaaaaagaaaaaactgaaggggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttaattgtcctctcgagctcctcggggagctgctggagagccccggccatcttcgagaggcgctgggcaaggcctccctggttggcggcagactttattgtctgccctctccaaaggcccacccgccgacctgcacggtctaggcgggagactgcatcccaaagcatgccgggccctatctcgcccgccaagcggagggcctcggcttccccggtggatgagtctagcgcgcgctgcatgtcggcgatggtgagttcggcagctgcgaggcgggtggctaagtcactttcgcccgcagccgccccaccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgccaaccgttgcgccgcggcctcggcctcttcgagagctcgctcccgctcggtaagcgcgtcctcgcggaggcggagtgcggactcctcttcggcgcaggcagactcgtgcgccgccagcgttgcctctcgggtggtgacggcggcctcgcggtctgccaggtccttctccgcgacgcaggcgcgctcttccagcgccatggcgcgcgcctcgagggcctcttcgcgccgccggagcgccgcttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctctcgagcgatctccgccagtgccgtcttacgggcttcaagatctgagacatgccggcggtgtgccttgcggcccgcttccaccatggcctccaccgagcgccgcccctcctcgacacgcgcccacgcggcgtcgagctccgcacgctccgcctgcagggcctccacctgggcacttaacccatccaacaccgcggtgtttgcggcggctaaggcctgcagaaggggctcggcgctcagcggggcgacggaaggcgtggggaagagctgccttggtgaagatgccgcgcggctcggcccgccaatggacgtgccggactcggggatgtcccccggacctgtttggtcctgggcgtcgcccgaaggagtaggcccaagcgatgcgcccgcggcctcgtcgcgagccaccccagaagctgtcgcctgaacgtcgcccgaggaggtgggcccaagcgacgcgcccgcggcctcgtcgcgagctgcctcggaagtcgccatcgcctcagcctggcgagcccgggcggcctcctcccgagcggcttcttcggcttggcgagcccgtgcggcctcctcccgagcggtatcctcagcctggcgagcccgggcggcctcttcagcttcccgtaggcgatctgcggcctctcgccggtcagattctcgcctccgtgcctctgcggccgccagatcttcggcctcgcactggccggacttgggatggcgggaggaacgcgacgggacatcactgaagcggaaggaaaaaccagaagataaacaagatgggtaagagaaaacttgcttttgggatagaagaaagacggtcgcaatgagcgtgggacgaacctgcgagggggtcggttaaatgaccaccttggaggggaaatcaggtttccccgggatggttctgtctcccccatcttgcggagccgcttcttcttgcgctccccctcgggctacgatgttggcgcggccccctccgggcgcctgctgctggcacgcaccgccccgccccctcggggaggagatgggagaggtgttcctcccagcttcctcttcccccgggcgtcggtagggcggttgctccccgagcccccaacgcggggcccagaagcacgaccccctcctggggtagattgttcccctcggcggctcccgcctgcgccgtcatggcccttaggagcctgctcctctgaggccccaaccgccgtcataatggtcaagatggaggcgcggtctggatcgctgcagagggggaggattccgtggggaatgagggacgcctcaacggagttgagattcagcacccgttggaccaatatcttgaagtcctcgggagcccaatcccatctgactccctggtgggtccgcatgtagtcttcggacccggtgtactcccaggcgccccgagcgcgccgctggagtggcgcaatccgacgacggagatagtcgccatacaccatggcccctgtgagcccttgggatcgcaggcccgccaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcccccgcggcaggaagtagcacccaccgaccaccgacggtggcgataccgactgcacggtgaagaaccaccggaacagccgaagagatgggcgcaccccaatgaacatctcacacaggtgcgcgaagatggctaatgtcatcactgcgttgggggtgaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcacggccggtggcagattccggcatgaagcggcgcggcaacccagcctgcttctcgctcacgatgcgggaaggcggtagcacgctaccatcaagcagtgcggagccccgtgccatggcgccggacgaagagaagatggagagcgagcgcgtgtggcgaaagaagggcgcagggaagaaggagttagggcgcaagcggcgaagacaaggggaatgatggcgaaaggaaggaaacaaatcccttccccagtgcctttatacccttgccaatgctgtgcccggctcctcgtttctcgcgcccattatttcgccccctcgtttctcgcgcccacgcttccactaatcccattcgcccgcttgcggcgcatgaggtggatatgcggttgtggcggtcgaggtagatcatatcgtgtgcgcgttgattacgctcgccgaccgaagcgccatcacctatctcctggcaaagcgaatcggctcgtccagattcgtgtactactcgagtaatgtgacagtctggaagagaccgctcattactgacagccgagttaccattgccgatgtgcgtagtttgtgaccgttgggtttctgcctgtttgtagaagccggtcctacttgtcaccaggctttaggggtggcgtcacgcccgaccgcttcccttgaaaagggagatcgccctggcataacgccgggggctactgtcggtgacatgggaccgggagtatcacgactagaggcttgaggcagacacaatcgcccacgtggcctggcaccctcgggggacgtcgggcccgagggtgatgtgtgcgcccacctcttggtctccccgaaggggggggtcggaccactcctgcctcgcccccgagggccaaggcgccccgacccctcgcgggttctactccgcgtgtatgggttaggtgagcacagcggggctcacctaaccgcatttattgcggctcggctaaatgtgtcacgccgcacgaaatacagtgcagtgcactcgtttgtccggtctgtggccagtcacagaccggtcagatcgcaggttaggaggcgacagtcggtctgacgcacgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgtcatcggcagacagccacgttcccacgacgcgcctgcccccggcagaagtggaggtaggtatgtgccgtcccgtcagaaggatgttcggagggcaaccgtgcaaatctccgtccatttatgaagagaagaaaagtccagtttggaaagagaggggtgcatgtggtatccccttgagatataaaaggaggaccttgcccattgagaagggggggatttttggttttttccagagtcggaacctagaacaagggggaggttggctcacactttgtagctccttcatacacagatccaccaaaacacaggagtagggcattacgcttcttagcggcccgaacctgtatacatcgcttgtgtctcatgctctttcgataggtcgcgatctttccacatacagagagagcttgggatttcaccctgagcccccggccgaaccggcaaaggggggcctgtgcggtctcccggtgaggagccccgcgctccgtcatctggcgcgccaggtagggggctcagcgtgtgtcctctgagctctcgcactctgccctgtgcgccaagcttttcctgttcagccagatggccgagcaagcaaaggcgcacgaccactctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcggatgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggaggaccttgcccattgagaagggggggatttttggttttttccagagtcggaacctagaacaagggggaggttggctcacactttgtagctccttcatacacagatccaccaaaacacaggagtagggcattacgcttcttagcggcccgaacctgtatacatcgcttgtgtctcatgctctttcgataggtcgcgatctttccacatacagagagagcttgggatttcatcctgagcccccggccgaaccggcaaaggggggcctgtgcggtctcccggtgaggagccccgcgctccgtcagtaggaaaatccattttaatgcatgggctatttatttttgccggaatgaccgaaggaggtcattcaatataattaagataggaagaaaatgttacaagaaaagttttacatcgacagctggttgtcgagaaagtatgtgcactagagcacacgcctcaaaccatataccaaccgcccaaacacatgcttcagaaagggaagccaagcaccggccatcgctatgcgagaccgatcgccaccaggccaacaacaccactacgacacgaatactctaaaacgacgctctcacgagggttgcgacgatgcatgggctattttgctaatcattacaaaatctcaaaattcatcactaaagaaattatatccggctctagtgttaccgcagcaagcacaaagtgagagtaataattaatcatcatcctgtctctctagccaagcgaagacaaaaacagaaaggcaaagacgaaggggatcacatcctgtctttccagcctcaactgttccaccccattacatgaaaactgtccatcaacacgcacaaaacaaaacaattcccccagaattaaacaggaaaacccaatgtgtttccagcacacggttttcagttcagtggatgtccaactccaaagcaacgccattcagcagagtgcagagagaagcagggcgatcgaaggaatcagaatcggaatccgaatgtaggagcggcccgcccccggagtggaacgggacggaatgtcccccgcaggtgccacccctacgaaccgtccaaaaccatcgcgagattaagctgctcctccctgataaaagtcgcgaaatccggggaccattgccggaaagccgagcttggaataaaggcctagctagtacgtgatgagagacagacagggagagatctttctcacgtcaattacatccagccagtcaggcagaacagtagttctcgatcggtagtgagaggtgacgcactggcgctaatcttctcctcgagcttgctttgctggctgcaggctcgaccgtgccgtgcggtgccttgtgttatgttgtgtttgtgtggctcgcgcttagctagctagggcgggctagtgcatgcaagcttcgtgcgagattccgacggcgatggcaatggttatcttgaacagcttcgacggctggcgctgccggccggctgcccaatctttccgccggaaatgacaccatgacagggaaaaatctgaaattcagatgcttcacgaggctgtcactcgcactgcccccagtgatggcactgtttctcctctgcgtgagtgaggtttacacggcgatggggttgtgatatactcgagttgatcggcggtagacgtacgccaatccttgtttatccctgtccgtttcaggcatttctaaagcatgttccaagatgtgcaaatatgccggcatgtacaacttgcggcagcagtgccgctttcgaatttttgatccgaagcaggaaaggtcccgagtgagtgagtgacatgcaagccaagcgattcagagaatgtgtgttagtcacagtaattaattaattagatctctatggatagcctttggattttagaagcattatattagctgtgctcgtttacaggtcaaaggttcactgctcatgcgaggcactcagatataattactctttttttttttcttatgtacatcgactatggccagtctaggcaacagtctcatcagggaaaaggctaatgcatgatacacataaaaaccttcactttgcaacgctaattggaggagaatataactgaaagagatggcgagacaaacaggagagattgcgtaagggctaagtgactgctgctttcgacgacaagagcttttggaagagagagcaacatggccgtgatgatcagtagcgataacgaactcgttttccttgctacagagcagaagcaggaggcttcaaagctatagttgttttggcaaacaaaagcgtgaacattggacatcagcaagcactgcatgcacagctggttttccagtggttacagatcaagactccagaggatgccctagctctatccagaaaagggcctcaactgattgcatatcaaaagtgaaaaaagtagaggatctaagaggagatttgtcctgtactaaaaacgtctttacttgaagaatagtgcggaattgattacaaaccagcctgaactgtcagtaattcaacctgaaagcaaaaatttctggactcagcgaggattttcatttttagcatcaattatctgaatcttgaaaatagcctttcaatcttcttcaacaggcccaaagatggttatataatgttctttgtgagaaaataataatgcactagaagctagggcgggtttgtgagaatctgcctaggagcaatatttagtagtgcatgccccatcaacttgcaatggtattagtaattacatgtatgaggcaaaattagtactacatgaaaaggcaaagaccaaaaggaggcccaaaagaagaaatatggaggatgcaaagcaaagcagaacaaaaaggaaaaaaggtttatgctaatgacaggaaaaggaggaaccatatgcttctgatgctaggtagtccctacttttgcctatttaaccgaataagcagtgttctgctacgaaggataaagaaccagtatttcagtagaattcctacttcagcacttcagcagcacttcctatagtcttacatcaggattgctagcctttgtcgggttaatttaagaatagccgtatcatgatgcaaattcacccatatttaattgggattctttgatatgcaagtggaaataaaagcatatgaagaatgttttttttttttctgctaccctagttatcttgtctaacggtaggctgtctgaaatgaaattttgtatctcatcaactagggcaacatgttgctttatgtccacttgtaataagtgattttctttttctgtatttcctggtatagaggacaggatatttattccattatcttaaaaagaaaactaatcttatcacaccaatacatgtccaactcaagatgtagtatgtctctaacactattgggcagaaacattaccaacagaccagaacatataccattctaatatgtgatttgtgaatgaaatacacagtacatgccattttgttttttcgagatagtgattacagatgttttttttatttttttttattaaatgtggattttctgatggatacttaatgacagaggcaacatataagtattaattcatttcttccaccattttatgttgagccccactacggtgctctctctggtagtatagaaagtaatctgaactgttgatctcatttgattgaagggtacatatctatttatactaccaccccaaataactgtagtagaaacatggtggagtattattgagaaaaaaataggtacaaagaggtataatcgttatttagtacctttttttctcctttgtttggcttatttcgatggaatatgagcgatgacagcgtaatggatgaacacatatcgatctagtcaaatatatatatatatatatatatatatatataaatgccaattacccctaatcgatatattagtaaattactaatttacccttaataatgaacggatcaaatcatttctaccggtagtataatactactagtacaaaacactagagcatcactagcaatggcggagcacacccagatctaacacgtcggttgtttattgctagggccacggttgatgagtgacaacacatggtgaatgcgtgccaccctaatgtttgggaccgtccctaagactttgaggtcctgtgttaaaaatacaaaataagaagtcttatatatatggcaa

SEQ ID NO: 64982 - DNA, 826 bp, Oryza sativa
cagatcgcttgatctctcagttctatatttctgctgacaactacatgaccatatctacatgttgctcaatgttttgattttctgtgagctaattaaagttatgagttcttatagcttaagtactgaaagtttacaaattcaccaatagatgtaaggtttgtctgagtttagtgtctgaccttgacccttgcagtgtgtgtaaacaatatactcatgttaccttttaaggttacgatttattctctacaaattcatactaaattcatattatacaagttcatacttaacaattgatttggatttctaggtatttataaaatccagattattttgtgaacatgaacatggaatgtatctaaattctgcgtgtggacacagccttgccatgtttctcaagtatgaatatatccttgcacacactgtttcccccctatttttacttttcttaaatatatattatacaaatgtgcttttgattaggtaacttttctctctgttgttgtagctatcaagttgctttcttgtgtgcttttgatgaagtcgcagacttttatcggtcccagcttatcacaagtgaaactcgacatggcatagttgttgccacggcattggaggttgataaagcttcaagtaagtcgtattttcatgtttcgatcaattcactgtcttttacttgctgtcattatcaaacacgaaagacatttatgtttcagattgcctatccaccatagctgcaactacaataatgtttttgcacaatcgtgactaccagcggtatgctttgttggaaggtacaacatctcaatattttgctattacttttgaa

SEQ ID NO: 64983 - DNA, 616 bp, Oryza sativa
cccttgcgacggtacaaacacgaactccagctccagcagtgacagcaacaacaacatgctcaacttctgggcaccatccgtcagaaacagcactagtgccccgtcgaatgccactatttcaggggtacactactactactactactactactactactactactactactactttgtgttcgatcgtgatatatacactagctagctacctcatatcatacggatttttacctgcagctggatcgtacctagcggttcttctttctcggacagtacactagtaaaggcagtagtttgtctgaatttacatatatatgaacgatcgatctgtctcgtaaccaatttacatatcgatcgatcgggctgtgcttgcagaacggtacaacgacagcagcagctgcagtggcgaaaaaaccgcaaggagcggagaggctgcctccgggtattgttgtccgggactctgatcttcatctacaccgcctctggggccacccaacatcggtacatgctacagctatatatatgcattatgtctgtctatcttctcatcgatcacttggtgcacaggccgcttgtatctatactactttagaaggtagtagtactttagagctgg

SEQ ID NO: 64984 - DNA, 2746 bp, Oryza sativa
ggattacgtcacctgctgccacacatcgacgagcagcttcctccccggcgacacgccggtgctgtcgacgacccaccgccacagcgacgacccggtcttcgtgctacccatcatggtgatctcaagcgcttcgttcgccaggtcgaacagcatcctgtgatcagctgcatcttcttcagtgttgtaggtctcctctacctcgtcgaagacgtagtcgcagatcggccttcttgccattgagtccacccgggcattgttcatcatcgatggagacgagtacgacgacccgtcttcgtatagtcccacggcaatgaggacttgctttatgtacgccatctcagtatagctctcctcggtttcagttgcgttcgtcctgttcttgcatgatgatgattcattgctggctatgggtgttgtatcaaatttgaccaacttttcgggctcagttctgcacaacattggactcattgttttacacttcaggtctcagtgaaactctgaaatgtaacgaacgacagagagagggccgtagttttttcatacctggcaagttgcagttcagatcgctgaagaaatggcgggaactgctgcctttaacctccaacggggacaccgggctaggaggcagctcggtgaaattctcctgaaacaaatgcagcaaaggaagtgaatccattgtacaaaagaaagttattctgatcctctcaaggtcaggcctgaaatacagatttgattttgacaaatgtagtacagtgcttgcctgtgcaacgatgaaagggctcaaaatttcaggaggtgacggtggtaacatgccgatcgccatcttgtgtgggtggaactcgcccaacgatggcttcagtgaccaatgcgtcttcttcccgaacagcttgttggctctcgatctcaagctgttccgcagatttgacactgtccctctcaaactgaagctgctgctgttcttgctcgctgctactgctgcaccttcagaaaccgcgtctgaattcccatgcctaccgctgtccacattattgtcctctgcaaacaggcgacctcgagagatccctgacgccggtgcagagaatgaccggactagtgcccgtggcgacacgacgttggcgtcagcaaacttgcattctcctgtgtagctttggtcatcaaagccagaagctggaactgactctgacactgacactgacagaggcatatctgtcaacgaccttattcttcctctgcttcttctgattattggaggagaacaatcattggacccttgattggttccactggttcttgaggtgacactcgtcggactgacgtgctccggagatgcatttcttgcagcagtagcagcagcgttgcgcttgcggtcactcctgaatgctctgaatgattctgatcgggagtacagcctcttaccaagatcctgccttctcactgtctctctgatctgcttcgcgatgtctcgagcgatttgcttcgggtcagtagtaccccagcttctcctgacaacctcacttttggacttgagcttgagctctttcttgagcctctccttcacctcctcaagaaactcctccatgttcccttccctcttcaccttggatgaactgaacaacgattcttggtcactggcaacaatgtcacaagtactaggcttgaggagcactatccgtttctgggaacgtggtttcgcagacgtgcttatactgttattatgttcatcctccaaatctctgaacttgtccggcatcgttgcacagtggctcacccttaaaacctttatgaccttatctccaggagatatgttagattctgctgcagcttttgctgaagtaatctctgtatcactactattatctgtagcattcttcagggtgtctttctctgccatggaaatcgtgcagcttccatagccaaatttggccatcttttccttgtgcaggttctcctgtgcaagaatctgaatgtacctaccttcttccatgcggtgtctactactagtaatagtaggacaccctgaagctgtaaaaacggttcttgcattctccagtgctttggatgtttgccatgcctggaaatcctccctgatcttctcaagcagctcctcctgtggatgatgctgacgcgaacgacttcttcgcggtctcattttcttgagacaatgcctgtaagtgtaatcaacactgctgctaccgtaggagatcaggctgcatttggattgcctgaatgttgcagaacggggtgatgtgacagtgatcatttccagtttacttggcagcttcaggttgctgacttcttctgcatggatcatcacttcatccctttttgcagataccgggattgtgccgatgcccatcagacgtgcaatgacactcggctggctgggaaaaatatccttgtggatcacattctttgcagtggttctgtcttgaggggtgcttcccttgggtggcttctgcctcatctaaatatttttattaaagaaaaacagtaaatacgatggtactaattgattgcattaacaagaaacttgagcattaagcataggagcaattaagtacaacatacagtactagtcatggtgatggtggtatggtcgtacagtggagagtcaaggctattccggggagcttcagggcctacaacaacaactagtagagtctccattaaccattcagaggtctgcagataatccataggattgctatctaaatacgcactgtttccatgtattcgggctgcagga

SEQ ID NO: 64985 - DNA, 3558 bp, Oryza sativa
gggtgcatttttttaggccccggagggggagatcgtggccgtggcgggcggcaacggccggcgtagggagctccggcgacgtgggcgagtggggctcgaacggcgccgatttttgggggggaaatgggggagaaagtggaggaaggggaggatgtggggtggaccacgtctgcacgtgcgcgggagcgtggaggcgcgcgggggaagcggcgtcgtggggtggctcaggcggccatggcggttggggttggccggcgagaggtaggaggaggagctcggtcccacctgtcggccggatggagagagaggagggaaaccaggggacgtaaagtagactttcgcaaggcgcgggccggccgagagagagaggaggcgcgcggcccgcgggagaggaggggaaggcttgggccaagcccaaaagggaaggaaggagaattttatttgttttctttttatttaattggttaaatgatctttgtgactttaaaattatttcttgagctccgaaaatttgcggaaaaatccggagagtattttggggcacaaagaatattacaaaatattctcggccaatgatttttaaaggaaattttaatttcctctataatttcatttgattaaattgatttaacttttaatataatttctagaaatgcattattaattgatttttaatcccgaacgaaaatcggggcgttacaaactctctcgcgtgcacgccgcagctcgcgactcctcctgcaccgccgccgctgctgccttcttctccaagccgtccaccgcctcctcgtcgtcctcctgcgccgccgccgccgccgccgaaccgtccaccgcatcctcactgtcctcctgtgccaccgggcgccgctaccttctccgagtcgtccaccgcctcctcgccggctgccgtcgtctgtcgcctcatcccggcgtcaccccagcggcctacttgcttgatcaaggttcaaagtcctctcctccatctcctccttcatctcatctcattttctttgtctgtcttccttcatccacttgttttgttgctagggttagacagcggcggcttcaatatccccctctgctaggaccttcaagatctagaaagtacagccatcctgcttgggtttgatgatctgcaagagaaatattggagacgaggtatgtcaatgcttggagatatgtaaagtacagccatcctgaagggaacaaaacacagtagggaatcactagcttcgatcttgtgtcaatgcaaggagatttttagcagaaataaactacaactagtagtattcctctacacactgctgagattgtaccaccaccactgcatgatataacaatgaatagcaagcagcacacattacagtattttacactaacaccattgaatgcacaaaagagcatactagcatagtagcataccgcttctattaaacaaagtgagtgttcagttcatacacatgcataattatctttaattatttatgaacatatatagtgttgaaactaaaaactagagtgctgaaacctttttttcttttactaactgcagtcatcttaaatattcagtattccttctagtttgaaggtatgaattcgctgattaggaagagcaaggatgaggaggatgaggagattattatgttctggttgcctgccctatatcttttaactagtaatggagggatagagaaaagagtaaggcatacttcaagtcagtacagtgaagaaaaactcagaaatattttagagggacatgaaaagaattgccttgttgcattccgcatggagcctaacatatttagagcaatagtgacatatcttcgaacagaacatctcctacgtgacacgagaggtattacggtagaggagaaacttggacattttctttacatgatatctcacaatgcgagctatgaagatctacaacatgaattccatcatagtggagaaacgattcaccggcatattaaggcggttttcaaggtaatcccatctttgacctatagatttatcaagcaaactactagagttgaaactcactggaagattagcacagatcaactgttctttccttacttccaaaattgcttgggggctatcgacggaacacatgttcctatcaccatttctcaagacctgcaggccccatataggaatagaaagggtaccctaagtcaaaatgtgatgttggtttgtgattttgatctgaattttttgtttataccatctggatgggagggatctgcaactgatgctagggttcttaggtcagccatgcttaaaggattcaatgtgcctcaaggcaaatattatctcgttgatggtggatatgctaacacgccatccttccttgcaccgtaccgtggagttcgataccatctgaaggaatttgggcgtggacagcaacgaccaagaaattataaagagttgttcaatcataggcatgccatattgcggaatcacatagagagagcaattggtgttcttaagaaacgcttccctattttaaaagttggaacacatcatcgtattaagaaccaagtgaagatcccagttgcaacagtggtgttccacaatcttatacggatgcttaatggggatgagggttggttgaatcaccaaggaagcaacatatctccagaacagtttattgatgtccctgaaggtgacgacgaatatagtaatgatgtgatgtcccttaacagtcaagtagatgatggaaacgcggttagagatatgatagccctaaatatgtggaatgactacagtcataactcgtcataataaatgtgagtcttaactggtctcatgaaatattttacttctgtatttgcatcatgatgtttttgcatgcttaaatttgataccagtttttttgtattcacagcaacaatgtttggaagagggccattttcatgactgcaaaagactctacacgactcaagtggttaagtgcaaaagactctacacgactctacacaactgtgtaaatctggtactgctccttccgtcttgttactgtctctatgaaactgatgaatatatgaattagtactacactttagtcatattaaacagttggattttgtttgttgtatcacctaaaacttcaattcagtgatgctcagcaaaagtattttttgggggtaaatgttgagcagattggcagatgatacatttgtagttttcacattgtagcatcacctgagatgtaggtgtactatttatgataaaaatgatgctcattatgccttacatattattcatgctctttttgttttttggggagtataaacttttatatacatatattctaatatattattgttgctctcttcgggctctaaaagcatgatctgaatttgctgaatttggagtgagcttatctattcaaatttgaagatgcacagagtgaatttgtttaaatatactacatccgttccaaaatataagcatttctacttgtttatcaaaatatagcttgtaaaatgcacaattgatttcatcttgctccaacttttcttagtccatcagtgctcgtgtcctaggaatttg

SEQ ID NO: 64986 - DNA, 987 bp, Oryza sativa
atttttggtgtggtcaagattgctaactgctcaaaatcattagacagaaagtgatggtggatttttgccttccgctgttgcagattgacagcggaagctaactatactaacctagagggctccaaaataatgtgcatgcgcactctctttttcatttttgcttctagtgggaactccactactgacaaagctttagcttatgaagcacgaagttgtggtgggaatgcggaattaatttcagaaatgatattcaaggcactaatcggatcaaatggggggattttatgccgtagggtttaggcctccatctcggcatgcatggatatataggatgcatgctccactttgcgatacgatttggtcaaaaaggttgtactcctatcttggttggagctaaacctacctgtgtatgtcatcaaggtagaaagcaagtgtgctccaaatccaatctttctactatgtgtcgatgtccctaacctgattggctaaagttttcctttctttgtttttttgagatgtttgcctaagttatgtctacaatgttatctcatctgcccttccttttgaatcctttaaatctagttaggatcaaataaaagtgttaactaatgtgtgtaaaggttggcaaagaaaaggggagagagagagaaacattcttgtacttcttctgtacagttccttttggttaattcaattcaggtagagagagagagagagacgtggggttgtccatgtcatgtttctcgtacaaaatattacttaaagtaaggctgtaaaatacataggtttgtccttgaacttcgcttgaagtctgtttttcattctaaactacaaaaccggttgtgctttcactgtaacttttaaaattagacaaataacacctagtaacatagttcttttaaagtagtttgtttgaaatggacgtgtttttccttgttcatatactcttccttggtattcttataatgtagatgtcagttcataatt

SEQ ID NO: 64987 - DNA, 1925 bp, Oryza sativa
aacgaacatgtgcaagagagtttgttgcatctttcgacttcatatatatccacatgatacattgcatttgaataaattggatgtatctatattttatttaatagaaatgacaaacaaccaacctaatggacattatgattttggatctttttgggcaaggcaatgcttttaaatatacaatccaagaaaagaataacttgtcttgttttgcagtgagcggtcaccatagctataatatgagacatgagccaaacataatgctgctcttgcaaaatgtataagaaaattccttgtgtgcctaagtcttcactccatccttctatacatgctcctgattctttctttattcctagataccaccgagtttacgtactaatcacctcaactcattttgttactattcgatttttacaaaatatctatattgcacctcgctcaaacatatctagcttcatataaatattgaggttaaaacctttataaaaaaaatgaatgacacaaaattgtttgacccaaaatttgaaattcaatttcgaaattttcaaatgtattgaaacaaaatttgatgaaatttcaatacataaattacacaaaccaccatttttctatttctcctcttcttcgacaccaaaacaaatactccctccgtcccaaaatatagcaacctagtatcgaatacacaacctaatagtactataaatctggacaggacaggaggtttgtccatatttgtagtacaagtttatgttcgatccagtactagattgctatattttgggacagagggagtatctttttaatcaacttcaaccaaattggaaaaaatttccatggagataagtgaatctactctccaaaaaaatcaccaaatttgattgaaactcatttcaaattataatttttatatttcaaatttggggtcatataattatatccccttctatttttttagaactgaaacaattttcaccttgagaatgatgctttttatgaagcaactcacccaatgtgtatagaggggattagaaaaaatctagggcatgcaagacaagacaaagctcaatggcatggaaaggatggagcaaagactcaggggaacataaggaattttctaaggtatagcttggtgatcactacaacaaaagtatacattcatgatggctcaactaaaatggtcgttgatcattgagtaccaacagcaataccaaacaaaaactaccgctaataatttgactcatgacacaaaaggcaagcacattttttagactggagcatgtcaccaaaggtcctcacttatgagtcgaggtacaggatcaaggaacacggaatgctatttttgaaaggttttaaaacaaggctgggatgggacgatgatctgaggacaagcaacacggcataattccatgttttggctgacttttgactcatactccctccgtcccataatataagggattttggagggatatgatatatcctagtactacgaatctggacagggagcctgtttagattcatagtactagaatatgtcacatccctccaaaattccttatattttgggacagagggagtactgcactaataaacccacctacttttctttggagatcatattagcccaaacaatgtgatagctcaagaagagcaatttatcaaatttggagattcaattaataaatattggagtttaaggacctagcatgaacagggcaagttcgtgatccggctaataaactgaaaggatttcaaaaggtaaatttgatagtgaagtaacgccttcatacgtccaccaaatgcacgcagattatagtatctgcttcttagttcttaagaacaaaatttggaacaaactggcagaacttttgtaggtactagctaaatgttcgtgctttgctacgctaaaagaaaatatatcataatat

SEQ ID NO: 64988 - DNA, 1583 bp, Oryza sativa
atatacggttttcttatttaattcgtatatttgtatgtattatgaagatgagatagcaaaatgtgtatattgatgcgagtaataaccattaactactcacatcggactctcatcattaatttttctcttcatttaaaaaaaaacattttatggtgaattattgggggggggggggggggtgattgtacaggccatccccccacctgaaatattgggggagatatatccccccatccccccgggatcgacacccatgcatggtacaatccttttttctttaagccaataattgctttgtcatcacgaattaaatgaaactcatgaaaagcactttaatataagtaaaagttattagttattattataaaaaatgttacggtctcatctgttaaagggaacattgttcagatgattgatagtggtgcttatgtagtgacttcaatgctagatgtacaattaaaaataatctgaaaatttgagtgaaaacggactattattaatgatacaaattgggaaaaactgatctgatcgataacttaattctcccaactatattgcattttaggttaatgtaaatcgtcacacagcactaaattggctctacatatcattccagacatttaagtgttgacagattttcaatagcctgttttatgtcttttttcatggaaaatcggtttggaaaattcaaaaatggttgggagattttactgttaatcactgttagagggtgttgaccagcgaaacattctcagaaaaccattaatatctttgtggtttgagatttttttcaggattttttgcatgttagagggctagtacagtagaaggaagatagtaagtaacatttcatacagaaattaagcaatttttttcatcaactttcaactatgttaccgagtcactttaaagtggctttaacatcttctaatatattcacatttgcttttatttccgtcctaccttgttcactagaagcttggcaaatcgtttgcctttctcgaagttttcaagtccaacactattcgacgcatcaaacgcaaagtagatatccagggcggaagagtttgatagatcgattgtacgcttccttcgtctactaccggagtttgaagtggtgttattgaaacccaccccgaagcccccgtcgatggccatttcgtcgaaggcctttcccaggccgctcgtcactcgagcgaattcgtcgaactcatcacgaccttgatgggaaacagtacatttatataattaaaaaagtatatatcgaggggtcagtgacacaaagacgtaattctattttggccgttttgagaaaaagtggtttatgtgtccctgagcacttgggccttaaggagttaagtctatgcttcactagccaatgacttcattgggggtattgggtggaattaagtctgtgtgtttcctggaaagcccacatttctctgaacattttaatatcaagtactcattttggcaaaatatggagttaagtctttgtgtcactgaaccctcgatatattttacaagatagggctgaatggtgcacttatcagtattattcatcaacgtaaaaactctttcaa

SEQ ID NO: 64989 - DNA, 16780 bp, Oryza sativa
tagtaaattactaatttacccttaataatgaacggatcaaatcatttctaccggtagtataatactactagtacaaaacactagagcatcactagcaatggcggagcacacccagatctaacacgtcggttgtttattgctagggccacggttgatgagtgacaacacatggtgaatgcgtgccaccctaatgtttgggaccgtccctaagactttgaggtcctgtgttaaaaatacaaaataagaagtcttatatatatggcaaatacaaatttatagagtaaattttatttaaatccatgtacatggataaaaattacatgaatttaacatgactaatgacagctagagctagctatacaagagctcacctgctgataaaggtggagacaatttgcctatgtaggaactaccgaactagaaagaagaatcatgttctgatggagtgacttagttatctttgttaagaaaaaaatggaaccttaattgcgtaaaacatacgttcacatcatcatcacgagtttcaattctttgtggctataattatcatcgaacacttgttatacctgagcaaaacaaacccgttctagctaaacaaatgaagagaaatagaaggtgatccactctgctttggggggctccgcctccgtcgaaggacatattcaattcttcatgttagttgtatataaggtgtcctttgaaacacgggagttataaaaattttataggattagttcaattctttaaaaagattttttttcagaaactttgtattccaaataagcgctaacatgcttatataaaaatgtcagatccaaaggtgcatgtcaagattcatgactccatcatgttccaaacttacaactcctgtatatatttataacagaaggtgtacaaaatattggaggagatgctgtcgatcagaccggagagaatagcctcatgcagagtaccgaacgaaggacagcttctttatgttctctttattagttatcccgcgtttaattggaaactttaattatcacccggaattgggggaataagatccatgggaggatcatgcatacgtacaaagtccgtgcatgtcatgaccaccaatctttcatgtggtttgccaaatgacaaattgccaattgccggacgaataactaaagttctacgcgtaatgcgtatataggtgttttacaggtaaactttagttagcagctgaagccctgcctgcgtttgcgtggcccccatttgatctcatatggtctcgcaataatgacaatcttttgccaagcttctttgtgttgtgccaaaaggatgctagctagccaatttgctaaattttctatgctttagtagctagctgctagctaactgcagcttggaagattgtatttgtcccctgacggatgcatatttgcattggcttgttttctctttttttttttcatattattcaccggattataacgtcatgctgataataacgtcaagctgataaaaatatactcccaaaacaaaatcttcttcgattacacgacaaatgcggatgcatacacaccactatactatacatgctcaaatagatgataatcaacaacacatctctgatctcactaaaaatatattgaaagcctaaaataatgtgtaatatttgtgggtactaggattcgaacctctgatgggtaaagtcatgcatgcacccacgactttactagcacatcattggacattggtgctttcttaaaaaaataagtcttctactgtattgcctagatcacatgttttaaataatttgttaagtttatttatcaaaatatttaagttatccttatagtcaacaaaataattcgaagaaataacccgcttaataatttgcttcaaattaagccaagtttaaaggcgtatcataatattttggtctagcttgcaagtgtttgattgaatgtggcattttgactaactgtatttgttagacctccatcacatatagcatatattttttccaagctttgtttacaatcgtggctaaaaaattgttcaccacgccttttgtttcacgccatactttggctaattatttttagcaaggttaggcttcaaccggacatcctctaataaagctaaaataatatgctaagcttctcgtcaatcacctttaattacatcgacttttcgtgatgtagcaccgctaagtgtcttacgactattcccaacccaataactaggatggtgtctatagcattaaataggctgccatctagaatgaaaaatgatgtggcaagtgaataaataagaaaagaaaagaaaaccatgtcttgcatgagacatagtttctacacaacattcaagacatcatgtgagataagtagcattaaatttaagtatgaatagtggtgtttgcatgggaagagtagtgtctagtactagtttcttgatgatgtggagtttatgaaaactatgtcgttttgggttaggaatggcctaagagcaagtttaatagtatagcccactactagctccaaataatctatagccgatgtaatagccaattcatacaatagttgcttacttattaatacatgatcccacctgtcatacacacattacgtcttggagtccgtgctgcagctggctatagatctgtaacccgctgctcttctctcttcctttatttctttaaaatatatttatagctgacttatagcctgctattgtacctgctctaatacaaaacattgtactttcacgaatattttgatattaaagctaaaatgtccacgtagaaacatataaatgtacgcaaggcattattttccattaactcgacctttaaactagtttaaagctaatgctaccatgaggttcatgaccaagtggtgccttccctccatagaacccaccaccaccgtcttttccaaagcaatattggaaaacccaccaatggcggatcgacacttgctcgtgacgcctacccgctacctgacatgtgtgtgcaaaagccatagaaaccattcgcgcctttttctctcccttttctgtgcataatatttgccgatctccgagaacgaaccggcctcgagcgctctggtccaccgtccacgcgcaatggcggctcacggatttgtggagctttggctctcctttccgcggagcaatcatagcgaggcgttcgttcgttcgttcgtgcggtgacggccggtgcagcgagctaggcgaaggcaagaggcaacgattcggtcgggtcgcgtcccctcgcgcgctgcttttttccgagcgttttcgctcgagggccccctgcatgacgcgcacgcacccggcgcccgcgacggcttcggctttgcgttgcaccgtggcccacgggggggcgggggggggggggggggggcaacggccaatggtggtgcggttgctgccgctgcgtggtgtggtgcgccgtgcgcgcgtctcgctcgctcgcgctcccatccaaagccacgcccacgcgcgcgatgatctcacttgagagggcgcgaggcgcgacgccggcaggatgggatccacagggcaggtggtgacaggctgtgggcatgggccgggcgggcggcctttcggggcaggtgcgttgggtttacgatgcgccgccgacggaggccgcgaacgggtgattctggaactggaaggccgaataacagctggccaacttgtgcttgctccatccagcagagccaaatattagggcacccgcaatggttatctataggctctctacaagagatctatgtcagcatattttcctacttggaagagattaaatgaagagagagagcaaagctatctactaatctggagatagtctatagaaaaaaacgaggcaatggattagagagctatagatacccatgtagacataccattgaagtggtttactattaatttagtctattgctgagatgtacatgttttataaatagcaccttactttactattgcgggtgctcttagtactattattttagtgaaggggatgccgggatggtcactcgtgatgcttgtcaaacctggcttcttccaggatgaaacgatgccgttgctggatgtgtggcagtgggacactatgaccaccgcaaagggacggacaggttcggctgtttaggtattggtctctgaaactgaatgctcgtctttcaggttcaggagtgtgacgaacgaacctgaggtgtgacacgttgttgggtattggatacagcgcaacgggaatcaagtgacacggcgtgtaggagagaacagttggagcccttgttttttgacgagccctttcccacagagattgacggtggaagtacaatgcgtgtgctcgagaactttcgcatttcccagggtgcagctgccacgcctgactaggatcgtcgatggcatttgcatgattgcatcttcatccgaagtctcgccgttgctgtccagttgctgtgtcgtatactcatatactcctgacttgccgtcagaaatggaggtcaatttgtccagttgctgacttgctgtgtcgtataatcgtgtgattactaaaaaaggcaaaacatcctgcctcttttttatcggaacaaaatatcttgacttgttccatcatagaggacaactttgaattgcatctcgtcatgccaatactatgagctacctatccacaggattgaataaatcaaaacatgcatgcgcaacctgcacatcttgccgtataaccatgctcccagccttgcaccatcacatttgcaccggggagcgcaaagacaaatccagcacaatttctccgagaaaatcgaagagaccaaagcgatccaacatacaagtgttagctgaatgtttgaggtgcgaacaaattggagggaagatacaaaaaacttggcaagtttctgggctagaaaattgtggcttctaaatctaaataagaaaatgacagtactatagcaatctctacccagtaaatgtggcagaattgtgggagctcgacagcccgtagttgcatcgtcgttacggcagcatacaacgtgtgttaaaaaagcatacaatcaacaagtatttgagctacacaaatcgtgaaacatattggcattaatttacattagactagatgaatcccaatacgttattgtaagagtttattgtgataacaataagtaaaaataatatgtaagataatatagacaacatatgcttacacaagtttaagcttacataagttgatgtgatttattaaatttaaatattatatagaatgatgatttaaatgtaaaagtaaaatgatgttgctttacgagagaacaaaagaaagacgataatttagaccatacatctaaaggctaaaaaaatgagataatatggcttagcgagagaaaaataagagagataatttaaaccatagattaatcatctaaggactaaaagcaattgatgtaatatgacttaatgagagaagagaaataacattaactaagtcagcatgaactatataggtatatgggatattatagaaaatgatgaatagatatattaaaatattatgtgaattatgtgggatgatttaacatacttgtattttaaatctctaaaattttaaaattataaaattatagataatatagcatgcttacataatgtttagatgtaataattattagtggatgataatgtgacatatttacatgttaagctttaggatttagtggatcataactctataataagatgataataatggaacaatgatccgttggagggcatttcagcattcaattcgatgagtttctttttcacatatttttttcaacattttccaggaatgtgttatatccaagaggtacattaatccaatacaactctatgtagagaacatgaagccattctgctaacaaagatgtgttatgttccctgactacagtgggaacacggaaggcataaccgaaccttacagcctgccaggagctttgataggataaagcttagatcgggtaacaagaagaatggttactgtatatatgctttggctgcaaagactaacatcattcctcttaagcacgcttcaccggcctctgaacataagatttgttcggatcctcggtcttcagctttgggggtttgatctcacctttccttgcctataaaaggggtcagtaagttacaaattaatgcataacaagatacactagctcaagtgcactctctaaccttctttcctgtcttcataaaatccctccagctagagacctacaggccataaataaattgatattaggcagtacccatggcaggtaatcaaatctggagaaaaacaaactcatctaaggtctcattcttacattgtaaaatagacacgattagaccacattgtactggatttgggtgatagggaatttagggcagatctacaaacctagcataatggatgcataaaaaccactaatgcaactcatggatgcagcctcatgctttcatacgtttaagctgagaaaaaaacatccacggtatcctgtgtgaaccgtatcagatggaataggagttcacaagatcaactccttgaacacatcctaaagttacaagtggatctcatggttgagccacactatgcggcagcagcagggatttacaccagcagcaaggggcagagcactaatatacaacagtgggggaacggcattgggagatgagcaggatgaactggtgctacggcaggcctaacatgtgcaacagccagctgctgcgtgtggcaagcgggagacaatcatctgatgtgagtgggccttgtaggcaagcacatagatggaagggcaccaacaggggcagaggcaggcctagggatttttggctttgccactgggcaccaacacacacattgacatctgtctgtgaggccgagcatgaccttgggcagagattagtagacaaccagccagcatggatagcaaggcaatcaaataagctaaggtcccctttttgtgaaactcgattggattttgaatctttttatagaacttgacttttttttcacacactcattttctgtattccggaacagaatagaaacctccattttggaactcaagttttatattagaaagtaactgaagcactaaattatgaatgtggaacacatgacaaaaatatcataagggtgaaaacatgattatcaaattaaacaaagaactgcgagcttactcgttggtctctggtctcttcccacttctcttcatgctcccgcttcttcttccacatttcttttgtttcctcttcatccttcttcagtcttccttcttcctctgatatctgtaggagcacatgggcatagctcatatcgactgtcacaatcaatgatatttaaaaattttaaagcactttatttaccctcatctgcattttcctgcgacgccactctttgtctgtcaaaatttcacgaactttaattattagctgcttctgaaattcttctgatcgttcatactgctcttcatattttccctactcataggcaaaccaatcagtggacgttctcaatttttcaacatgaatgaggttcaatatgatgttacaagtgacttgcaaaagtcattttggcaacatagaatcacacattgacacatatgttgtgcacaaaggaaaacatctgatatccaaacgtacatagctgttgaaattccagcagatggctctttcatgatacatataaagtattttgtctttctgaaaggtttttgttctttatatatctataaagttcaatcataagcatgtaatgactcctaaaagaatctattactgaatgtggtcaacaaacatgaagcatggaactacaaagtcgtcaaaatttcagcaaatgatctttttgtcagagtgcgcatagaagcttctttctttcagaaatttttatccatattaagtaagaacgaagtcatgaacatccaagctcataaaaataaccttccgcgggaacactaacaagcagtcagcagccaccaaccaggttgaccattgctgactgctggttaaggaaatccctgcagagactggggtttcaaacttcagatagtttacacttcagagttggccaaaaccaaaaattgttccaaattacaccaattcaggtttagcatattattattacacattgatattcatatggtactcagcactaccaaaaaaattacgattaaagtttacaccaccttgcatgagattgtcttacctcatctacttgggactttatctttgacgcgctgtctttcttcagctcctttttcctctttgccctcagctcttctgaaatttttaacacgtaagatcatcaaatttgctgcaccgtgccctttatatttcattgaacgaattacgaagctcaaatagtatgaattaatagtgtaatacaagagcaatataaataaaatcacattgcaccttttgcagcagtaacttgatcaagaatatatcctctctcctgtggatcaagtaggagctgctgtgcttttgccagagctgtttatgacgaggtaccatcaattagatatacatccattgagcaagtgagaagcaaaaaagatgtgacactggaaatcatatgagttgtttaagagcaaaaaagtggctgagtttagtggtagaactagctacagaagtcaaactcctcagtaagagatagtgtaggcattgcattttattgtttctttttaaaaaatatctcttataagaatattaaaaactaactccaaggtgattctcagttactggcaaagccaacaaaaagaatgtattcatttccggcaaaaaaaaaattccatcaaagagtgattagatttgacatgcaatgatgacactcccaatcttgatatgtagaattaccagctaactttgtttattgtcggttaaattatcccatgactgctgtttcaaaatgaacccaaactctggcctatagcaatacagtgcaatgcttcttcgatacatgtatgataacacgtactattatcattggacatgctacacagctacgcaactggtgttaatggataaattgcatacctgcgaaagcttcttgtgctttcggatgcttgcatttatcaggatgaaccaacaaggacaactacagatggtacgaacaaacaacaattagatctaaaaaaaggattggaagaaaagaatcctttcagataaatggctcaataccttcctatattgcttcttcacctcatctgctgatgaatcaaatgacaacttaagatgctcgaaagggtttaacttgaagcaaccaagaatcctgataagttttgaatatgttaggaagtgcaggcagatgtatttttttttaaataaagtaaatcttatgtcaaattcatttagtttttgcactgataatttccacgagaagaaaaggtattcaagaacacagaaagcgtgtagtgtcgtcacagtgcaggtttatttttctttcttttgcaacatactggtttccataaagggaaacatgaaatcccagctaaaatcgacatccatgagccactgaattcgagagcaggatgcagacaactgattatggatgagagccaatcgtacgactctaacctagggttcaagtggaaccagctggatcccctaacccccacggaaattcagcaccgaggctgcttctacatctgctgcatcacacgccgaacaattccggagcgaacagtgtagcacggctggggatctgaagctacgccgatgcggacacggatcgaaaccgctctggccgacgaggggggaaagggagggagagagagagggggggggatttacctgagcacttcgttgtcgcgttcggcctcgctgacctcggcgaggaagctcttgaggagctggtcctcgtcggcatccgtcgacgccatggagggagggcgaaaggcggtcgctccgggaggacgacgagacgaaacgagagagcgcgtcgcgtggagagagagagccacggagaggggagagacgggagtcggtgacggaacggacggtccagatttcttgtgctcggaagataccagagacatgccgggccgggcggccggcgaccgctcacatgtacagttcagcccagattggggacggcaatgtactctcctgaactttttggatggcccaaagtagtgtgggaagaaagaggcccaaatcctcgacaaaaagatctaaacaaactcccttcatttcatatactagcaaaatgactgtgtgttgcatcgggtgcaaaaaaaaaattaatacacagttgaataagatgatgcctcacaaaaacaaagtaggaatcatgcaggtttatgcaatctttgtgtgtgcacgggaccctgcgcttataccagaacttacgctctatttcgtatcaacatgatcttcgtgatctaattttgttagagcgacagaagaggggaaaatgctacatttctactccctccgtttcactagcatttcccatatttatatgtttagattcattaacatcaatataaatatgaaaaatgctaaaatgacttacattgtgaaacggaggaagtagtataataagtcaattatgcacataataaacaacatattaatcctttttattatttgtctattgttaacgaccaaatttggtaagatgtgaaccaggttcaatattaagatcgaggcggattcgatgaagagatcgattcgaataacagagtatgcattggctgcgaagatattggctggggtgtacatcggctggaatggatcggacagaggatagccgatacacccgatagaggtaatgcaaccgattacgatgaagacggtttcaaggttgtttctagaatcgttcaaagtgctttatagggattgccatgatagagataaagtttaggcaattgtatctattaattatgatattttatgtaatttccctagagatatgtttgggcaaaagtctgccgcaaagacttgtggtatcttagagcttcttagagataagtgtcgtgtccggcaaagacatattttgtatcttaggtataaatagagcccgaagctatgtaatcaaacaacacacgttcaatacaatctcggtgcatcgccaccctttttactttcgtttattttcgacgagttcttgctttcgggttgagctgcataagtttcgatcttcaactagaggtaaagcttgttatggcggcttgcgttctcgggattagtgcttccatctttatgatactctaatcttgtttatgtaattcgtcgagttatcatatatcctatataatcgttgacaatatcgttatttaaccttcaatcagctaacatctatcattggacggcagccgattaggttaaataccaatgttgacttagattatacaggatatccaccatcctatgaaacatccaacggcttgattgtctagatattatccttcttttcatacttatagctgcatcagttgagtttgaccttataagtcgtgattagaatctcaatctctagcctgctttttggttgctgattagggtagtattggagtttcagccgatcttacttgatttaactcttttatatcttatatgcttgattgacatgttaaatctgccctttatgttaagatcttgtcgcatttaggtatattgagcatcctgtttgatatattttgcttgctttaatatcttaatatagagtagtatcggagtattagccgatacatgttggatctgtctgatcggctgtgctataaatgtctataatcttctcattaatatatatttcgatctattgtctcggtatggcgaccgatctatcccaatcacttgatttaagtatatatcgatgaaagtattatataccattgatatctatagccgatcgaatatatttaattctttcttacttatttatgactgtcgatcgaatcaaatatgacatcggctgaaagataaatgatacgtcatcggcgactggccgatcggctatcgtttatagatttaaccgcttttttcctgtctttatttcttgttgattgtaggatcaaatcaactggcacgctcacgaacctaaaggcaagattgttggacctgcactgaagttaagcagatcttccaggccagtatgtgtttttcgcatcaacacccgtgttacaaacatcaattagtcacatgcccttaaacacatagggctggtttggttttataccaacttattgtcctaccaaaagtttggtaacttcaatagtgaaaagtgattgtttggtttgctactaaattttacctacattagttcaaattcaatacaacctaatttagtagtgccaaaacttgttaatgttttggcactaccaagattttggcatggcaaaaattggttccaaaacaaacaagcccataacactattgaaatcataaccaccttttgaatcccttcgaacaaaggtcacacaacgaaatttctcttataaatacggatcagccaaaaaaaaaactgataaccggtgccgttgatatgttgctttcaaacttatgtttgaactaaaaagcaaatatagcaatgtatttgacactatatgataccggtgattacatgcaacaatttttgccataacaaaaaagtatttttatagacccacaaatagataataagaatagaaaaatgcaaccaaccgtaaaaacatttctttcaacctaaaaatgataaagacttaattttgttttaatatggttccagtccttctgcctatcagctaggattattcattttgtatttttataggaacttctatttttgcaaatatggcgacttactccaggatatattttcaagggttaattagatacatgccactaaaaatttatcggttttaaaataggaataagttcatctgaggtcccttaactttacactgaatccgattttcgtccctcgatcggaaaaccagacacaacgggtccctcaactattaaaaccggtgcagattagatccctcggcagttttaagagcggttttggctgacgtggcgcctatgtggctaatttgactcggtctttgtccgacgtggcattgacatggcgcttacgtggcaattcgacccgtgggacccacatgtcagtctcacatagaaaataataaaaaaaatttgtgggtcccacatgtcagtccaactcacccccttttcttcctcctctctccccatctcactctcttcatctccctatctctactctctctaggcgccacggaagacaacggcatgcggcggcgtgcggccggcgataggagaggagggagcaacgcgcaaagaccggcgaggcgggcagggagggaggacgcagggaggccggcgatggccgagcgccgtgggtgggggcttgatggcgacggacggagggagaggtgcacagccgacggtggccagcgggagagggagcggcgaccgccctccaccgcaacctgcctccaccaccgagcttgtcagcgatcgcccaccggagcaaggaggacgatagccggcgacgggtgaagaggacgaaggcggcggtctggagcagaggtcggagaagggcccccagccgccaggatggcgcacgatccgccgcgtttcaccaccaccgagctcgtcagcggcagcccaccggagcgaggagcttccgcttccccttcccccattgacgccgccgctgcagcagctgaggcgccgctccccatgccgccgcttctgtggcgcacgccggatgcggacggggacgccatggccatggacgcggacgacgtcaacgtcgacctcggcatcctcggcgactcccagggcccccgcaccgccgctactaccgggtggagcagcgcacggcggacgtcctcctcctccggctgccaccgccacacctccccgcatggctgcatctcctcctcctccggcggccatcgctcacgccgccccttctccccgccggccactgcccttctcccggccgccactgccggatctcgattgccggcgttgctccggggggacctgctgccgcccgggtcatctgttccgtccaccgccgtcgccgatccccttttatcaccccggctttctcctccaacttgctgctctcaccggtgggcgccggtctcgccgcccccctccaactcgccactctcaccggaagaggagaggagaggggagagagatgaagagagggagatggggagagaggaggaagaagaggaagggtgagtttgagtgacatgtggggcccatgatttttttattattttctatgtgagactgtcatgtgggtcctacgggttttattatttttccgggtcgaattgccacgtaagcgccacgtcaatgccacgtcagatgaagaccgagtcaaattagccacgtaggcgccacgtcagccaaaaccgtcctcaaaaccgttgagggacctaatctacaccggttttgataggtgagggacccgttgtgtctggttttccaatcgagggacgtaaatcggattcggtgtaaagttaagggacctcagataaacttattcctttaaaatatgccattactatttcttgctgtacaccctgaggccccacctggggacaaacagcccctacggcatggcttgcgacttgcaagcagcagcgccagatcgaggcccaaacggcctagctccagactgaggcccaagcggccgagcgtatgtacgctcgctgacttctatacggacggccaacaaaactattccgtgtaagaagacagaagtggcttgacggatgaaaaaaaaagtatatagaggctatttagatcctctgataaaatttttcaccatgtcatatcgaatatttgacacatacatgtagtattaaatataaacgaaaaaaataattaattatacagattgtgtgtaaattacgagacgaatcttttaagcctaattgcgccatgatttgacaatgtggtgctacaataaatatttgctaatgacggattaattaggcttaataaatttatctcgcggtttataggcggaattggtaatttgttttattattagtctacgtttaatacttgaaatatgtgtccctatatccgatgtgacgtgccaaaactttacgcccatggataacacccccataaacaatgtggctacagaatcaccttcatttgttttataacagataagtggtttgactttttttgtcaaacttaaaaaagtactaatatctattatcttattaaaggaatagaaaaagagcctccacgttcgctctcacggcctagaaaatctcatattaatcggagaaaaagaaaaacagagtccatatagaaatataatttagaaatagttgaaattcggaattaaaaaataagaaattttggaagaggagactgagttcatatagaaatacaatttataaataactaaaattcggaattaaaaataaggaatattagaagaatagtatagagtccatatagaaatacaacgaagaaataatagaaattcggaattaaaaataaggaatattagaagtagggtatagagtacagaagtagggtatagagtccatatcgaaatacaattaagaaataatagaaataaggaatattagaagtagggtatagagtccatatcgaaatacaattaagaaataatagaaattaggaatttaaaataaggaatattagaaatagagtatagagtcaatataggaatttaaaactaactaaaattcagaataaacataataaaattaaaattagagtttagagtccatataaaaatacaatttataaataactaaaatttgaaattaaaaaaaatatgggaagaagagtctaaagtcaatataggaatacaatttataagtaactaaaattcaaaattcaaaattaaataatattgaaagatgagtttagagttcacatggaaatacaattagaaataataaaaactaaaaattaaaaataaataatattggaagaagagcctagagactatataggaatacaatttacagataacgaaaattcggaattataaaaaataaatattgaaagatgattctagagtccatataggaatataatttacaaataactaaaatttgatattaagaaatattaataactacaccgtatataaaatgcaatattacacattattagtttcaattcataaagttagtacaaaatttaaaattatgttgtcattttaatatatttgaataatacatggagaatatatatatgttattatatgagagaaaatataatgatgctagccgcgcaatctgcgcgggccaccatgctagttttcaataaaaataaatatagtaacaaaatatatttgatgttaaatataatgaaactaattttatgttgtgaatgttgctatttttttataaacttgaccaaatataaaaaactttgaataagaacaaaagtcaaaagagatataatatgaaacagagggaatagtaaagtttgctattttgtggatgtccaccggatcatgatcgtccggatatgcctggaatgttaaactgtgctcagggatcattttacttgtaccgttgtgagattcgttattcttaattgatatatagttcagagcgatgcttgaaaggttaacactttgacaccacatttccacgtattttcaatgagcctcactacggtgctctttgctggtagtagaaagtaatatgaaaaagtacgaattaccctccccctcgggaactattgcgagagttcgatttaccccccctaaactataaaaccggacattcgacaccctaaacacataaaaccggat

SEQ ID NO: 64990 - DNA, 2098 bp, Oryza sativa
actaataaacccacctacttttctttggagatcatattaacccaaacaatgggatagctcaagaagagcaatttatcaaatttggagattcaattaataaatattggagtttaagggcctagcatgaacagggcaagttcgtgatccggctaataaactgaaaggatttcaaaaggtaaatttgatagtgaagtaacgccttcatacgtccaccaaatgcacgcagattatagtatctgcttcttagttcttaagaacaaaatttggaacaaactggcagaacttttgtaggtactagctaaatgttcgtgctttgctacgctaaaagaaaatatatcataatatttccaaaataaataaaagcatatctttcatgaagtatattgccaccttttttatagagaatactcacttccgtttaattttatatgtagctaaccatttagatttagatgttatgtgatcttaagaagttcaaggggtaatatgtaaaactacaatggaaataggtggggtggcagatacaccgccaccaccattggagtccttttaaatgagtatagatatcagcgattttctatcaagttgctcttccgaaagtgatgcagctataatctaaaaacaaaactggtggttactggtggcttactagaaatggaaacaaacagttttatgagttcacgatgaacattcacaagaaattacttgcaagcatgtgtcacatggttctaacaatcctaacaattgaagaggaaatttcaacatttcatagagtttgtcccttcatcttcttgctatttattctcttctttataattagacttgactggtttcctggatgatggccttgcattagaaccaaagctacctcaaaatcaaacagctatcttttctcgtttggaccacttgcagaactttccagattgttttttttgttgggtgatgggttcatgacatcttcacttctaaacccaagctctgacatatcttgctttgccatcaggtttctggaacaaagatatttttcccaaagatataatacacaagaatagcatgtcttgaatttataatggaaacagcagcattaaacctacaactgaaaaacaaactcttcaatgtttcgacttgtgagcctgaataggtaggttggaatatcgaagttcttaagcactcttaacacagcaagaatttcaggtattaatagaactgtttgatttctcttaaagttggctactacaagcatcaaaatatcccccacaagaccttttgcctcgaaataaagagaaaccttcaagacatggaaaacagattgagctaaccattgtatggtaagagtaagtcatggatctgaaattaatatgtcaaagtatcacctctccatcctacattccaggtacttcttcgagaacttcagacatttttcggtttacaatccagttgatttaacgcacgcaacataatctgtcttctcctgttagaacgagcagttgtcacatgacaagttatgacaccaaaaaaatcggggcaaaaaaggtgtgcaaacttaccaagtcacactcgtgcaagtgatccagtgggaacactcccttttcgggaggcacaggcctcacgccccgatttccaccaaacgcaccgcctgcgagagcccacaaagttattccgaacttcacattagcatcacttaacttgggagattaagcaggaaacagtcagtacacgaatggattaatggaacccataagttcttcacggttgtgacatacatccagagcaaatcaatgtagaaaaaaaatattaatagaggacaaattcaggatcagcacacctgcactcatttccaatggtgatactttctcagtgctcaaaccgccccaccagaacttcccagatgagtagcaaccaaggggggaaatgcggattcagttgaaaccctaaacttttgtggggaacaagcaaactgttacttgtattaaggttaaggctctgaaattaagagaagagcttcttccagatctagaagagaagctagggttaacgcaaagcaaattccagacaagaagtacttttcccggttggagagagagagagagatgaatca

SEQ ID NO: 64991 - DNA, 15579 bp, Oryza sativa
gggagggtatccagatattgatgaggggagggtaaatcttccctaacgcaaaagaaggccagattgtaagtatccttgatgtctttgttagagactcgctgtgttagggagctgttagtttgatagtcatctggtagtgattttgacaccttgaaataggaaatttcccttattctaatacactcgtacgtcatcagagaatcagccataatctcaaccagtggcgtagcatgagtccacccatttagggggctctccaatgatatgggggtggggaaggggcgtctccggtcttacttttttacaaggttacaagcttagggggtttgggtgtttactagatgagaggtaatggtgcgggaggttgtccgggcgtctttttataattgtcctgttccttttctgtcttttcccggtcttttttcttttaattttacccttcaacagaggagggaacacgtgcccgctgtagctacgccactgatctcaacattctttaggaacttcgtctctcttgttcttcttactcatgcatcttggcatctctccagtccactccccagaaaacgtacacatcctctcttcagaaccaaccatctcgtaaccaccgttacatcgaaaacggacataggtgttcactctgtactgcggaatggcgactttggagccgtgtatggggttccccaaggcgggacagtagtactctgtcatgataataaaatcagttagtgggccttaacattataccgcagtcacattgctaaactacttcaaacctaccgcagaccgaccagttttggccgttgacagtaatatatattttgttgctgtctgcatttttgtcggcctcgttggtgtgactgaggtattacagttataagacaaagttacgaatcaaacaaaaatttgatcctaattttgaatcttctctttatcaacgcaatgtaggctttaagatacaatcgattcctttgcaaaaaaccgagctaaattcatctagatcagatctgttctgcacgaaatacagctttatcatgaacgatccttaacacccactccatcaattttattcttggatgcgatcaggtaaacgactcaagtctgcaaaatgtagaacaaatcgctatctgaaatcctttaattattccctgttcaataagggcttacaccaagccacattaaagataaagatgagttctggtaaaaaaagaaaataactgaaattctcaaagaatcaaacgaaacttacactgaatgttcaagattacaaataaatgtcatttgccaaacaattttggtaaaaaaatgtatactggctgagtaatgagcatagaaagattaggaaatcaaggttagtagccccgacaccatttgtgtagtcccaaatacaacaagtttctgtgtacagtgcttgttactttaccaagactgggccaaattgattatgattttgatgactccagaacattgcagtacacaccaatacttacatgatccattccacaccttttctttcacaatgcaatcggatgaccagaactcacctttatctttaaatacgtcaataattgttgataagagtgtaatgattgtccaaatgtaaatgctcatattttgtacaagtcctgtcatgccaatcgacactgcaaactaatgcgaaaagggtgatcttgataattaaccatttataaagctagactaaagtttcccctctgtacctgcttgattcaacagtctctgattttcagttggcctctctctttctcagaaccctgttccaggagatgcaaccacacatgattgaactttctacaacagccgagtaaaagagtttcagatatgaattttcgacatggaaagacttaaagcccgtctgcactaatttatccagggggattagacctccgtgcaaggtcactgacaggtggttacctcatcaaataagctctcaattaacataagaaaaagaggatcatggggaccacttcaggcaccgattaggcattgtttgctatatagagggcgcaagtagctattagtagttcagtggggttttaagcttcctcaagaggtggagactacaattatgatggacatctttactttgttcgtcccaacttaatttgttgccgatcagaatgccgagatacttatcagagacctttaaattgttttaaagggatcaggtaactttgtgtcagattctgaaacaaaatcctggatttagctcatgctgcaatgataattataaacgtttaggtcagtcaggaaccccatgaattttacaagccgatcgcctgtctgattatcaaggtatttatgattggacttacaaattatgaaaaccgtttaccaaacggttttcataacactacagtctattgggggaaaaggagtattgtaaaaccggtcactcaaagatgtttacttttttgaggcacttattgatcattttgaagcgcgatttttagggcttcaatattacaccatatcacagacactgataacacgtaggaccgtgcatctcatatttaacattgctaaacgatgcctttaacccgttgactactgaattatcatattcccatagacttaacacagggagcaccaggtttcagtaagcaatgggttaaacatagaattgaatcatcactttgaagttgatttcactatgatttggagtggattaaatctgaaaggaagtaacaaaggaaataatccctccgcaaatgactcctggaaaaaaagagaatttccggtaacagagtaaaaataacattatcgcaaagactatacaaaaaacataaaggtaatgcaatttcaatggccttgtcacctattcaactggatgaacatgacaatgacgtattatgtaatcccaacatgatttatattggttatacaatgtggtattatagttaccaatgagttgattttgatttgttcatagttcaagtttttatttccacatctgattttaaaaaacacaagtacaccttatatgcatataggcaaatcagaggctatattttgtaaggactttaagaaagttaagggtagacaatacacttataccccattcacagtggcctcaaacaccgcgacagcagcgggtgatttgtttacttacctatcactgacctcttttctccagcaatggggaacataaagtgaatagaaataaagtaaccagtggattcaaattgattttattattatgtagatattataattatccaaataaaaatatttcacacttcaaaaaattaaaatattctgactggaagcaataaaaatgctagttttttaaaaagtaatatgatcgaggatacaaaaagcaacttgacatgtttaccttttgcaagagtgtgtaaagtacagctagcgcgcgcaatttcaagcgatcgaaaaccccgcgctgaagtatttccggtcatatcggggtcactcgcgggtcatgagccatgcatacacgtgtttgttacggaggtaataaaaatcacccgctgcagcgtgaatgggtacatgatatttatcccgctgctgcagcgggataacttttctactgtgaatgcatttgtagcggtgttatggcggtgtcgccgctccgctacaacgccgctacaaatttcaaaaccactgtgaatggggtataattgttcttttctacaagtccctaatccagagtgttctgacgtacaacctagtctgctactttgctaatgctacaaaaattgaccagaagaagctcaataaacccaggaaaatagttcaacgtatactagggatagacttgccactacttgataatctgtaccaagagagagtttcatctaaattaagacaggttatgcaggaccccacccacccactcaacgagaactttaaatttaaccgttcaggcatacgtttgtgcgcaccgcgcacacagaaaacccgtttcaggcaatcttttgttcccaacgccattcaccacttcaatgcacaagcccggaggtctggaactcaaacttaaatactggtctcaacttatactttgttctgaatttaattttcgctagggctcataatattaaactcacctatattctcaaataaacagcgagcttaatgttcgaatttttcacctggaatgccatgtttatgttatactgcaatcatgtattcgttttgttccgtttccattgcaacaatcactttcaaaatgtaactacgtttgtaacgatgtacatttgataattattgtattatgtattgttcctgtattatgtatatatgtacaaagactgttaaaccagtgaaaaaagaatttcccgtaagggacaataaattttcaattcaattcaattcaattcaatataattatagataaacgttaaaatgaaacatcttcaatttaaaccataatgtagtgggggaaagaacaaaggctaatagcctatcaagaatattcccagagataattacatttacataaaaagtttcttaaacgtactaaaacgagatagaaatacagagattaaaataacacaaagcaacattatacagaatttaaaccagacaaatccattacaacaaaagaaaagaaaaggaaaggcatttatgtaaaaaaaaaaaaaaaaaaaaatcctagttatacacattcatttaagagatctttcttgagctttcttttgaaaattgatactgttgggtattttgttccataattttggtccggcatcaataattgttgtgtaaatagtaacaaatgacaagcgccggaagaaaagtcaaaccgtcagcaacatcagcaagcaatccgtgcttttcacacccacaacaaatacatcggtttaattaccttcactgtggcatgacgtcagagtaccattccagtgaccatcaggttgacacaccctctcacttgaccccagcagctctagatgtgaccgacacctgagggtcatcaccgttcctacgggccaagaattcgtggcgccttgtccgtttctcggcgagaaagaaatctcgtcgttgtcaaggtgacgggaacccggatggggacacctggcgactacatcataatttaaagaaaacaagaagaagagttaattcttacacctcaataggactccatactgatcccaaacaaaacgatcgattggcaattaatgtattaatactattattttgttcgatcttttgttgatgatgtgccagtctcgtggatgtgactgaggttttactattaaaagaatagtggaggctcattcacagatcaaactaaaatataaggagtaatgtacgtaaaagaaattaattctcattatcaataagagtatcacaaacctttgcaggttggtacgttatcggaccatattccattgggtccaccgtgactctgacatacttgccagcttattccatcgacgagatacccttcgttacattcatattggaccatctgtggataaagatggaaaatactcattgaaattgaacttctttttattgcaacaacaacacaaaaaacaacaacatcgaagcacatataatgaaataatgaaggtatggacgcaaatatgtgggggaaaaaaaatcattttcaagtgatgtcgcaaatctgattaaccactcaataaaatgcgataaaacaaccgaatcattaatcaactaacttattaagaataaattcagattaaaaattatattcttgtgaacccaaaatcctgatgaactactcgataatccggttttaactagtcaatcaactgattaacaaattaatcaaccgattaattagtgaataaatatctaattaatgtgtcaagggattgtcaacgaatcaagggcgagatgcttattgacaaaactactgtttaaatcaagcatgtaaccctcaaagcattcccccaatgaatcgtacaaacctaatcaaacaattataataacatttattttaaaaaatcatcaatcagccaaaaaaagaattgacagtcagagtatcaagcgattaaccaactgaacatcaagtcagtgaacgcatcagataaatatataaatgtaatattaacgaatccacaatccattaagaaatgctcaagtattttgttgttgacattaataagtttgatttcttttgttccccaaataatgagagacacctaacgacttacttctccaacatggtaggtcctgttctcaatattgtgtgtaccattctctatgggctccaggatgggtggggcacagatgatccctgcaatattcaagttcaagtgcaattttatttccacttgaaaaacatttacaaatcattaacatatacatatgaattataaacgtaccaacatgcgactcattgattgagagttacaggtctatacatgtactgggtccgtaggaaagagagtggctcccgcaccaacccccttttttagaattaatatacatcatttaacgtttttgttttgccgttttgcctaattaatcaaacaacacattagaattggtgagtgatttttttttaaaacctctccttttgaaatgatttaaagcttatctgccatagtttacaggagggattagaccgccctgcaaggtcactggacaggtggttatctcatcaactcagctctcagttaacataagaaaaagaggatcatgggggaccaatggtcaccgattacgcatcgtttgttatatagagggcgcaagtagctacaagtagtgcagtgggcctttaaacatcaactcacacgatacctcacaggtggtatggtaatttattgccactgatttaaaccagtagggggggggggggttggctccattggttgattgattgattcttattcgacaagcttccaacctacaccaatatacaatactaacagatcaaaattaagtcagcttgaacaggagaaagattaaaaggatgaaaaataataatgaacccttatgcaagttacactttaccaacaaaagaagaaggagaagatgcatccctttattttacgtccgtaacaaattaaacatttgatatgattccaatctcatttcaatttgtcaaaaaggacggggatgcagaggtgcccctacggtgtatgaattcacccgacctatttttttcgacgcccctccatctgcccatccgctacccgcgttttgcaaaatacagagcccccccccccccaagacagatttcaatcaatttagttcaactcgttaatattatattatgtacaagaaaatgaacactgaaccttactgttgcattctgggacatccgcatccgcttcccaggtgccattctgacacgtgattgtgacgtccccggttggatggtatcctgtttggcaggtatagttgaacactgtgcgttcggtgtagagatcaccgcgtttgattccagagttttcatcaagaaccaaggctagcatcccggatggttcgtttgggttagggcatgatagaggtcctagaaatttcaagaacaaaatttagacgatatttttagaatattagtgaaataatgacgggcaaaatagcaagatgctttaatgatgacaaaataccctcgttttttttgcaaacagtgatataactacattcattttctctttaccaactgcccaatatttaaaatatttcatacagtattgagtttagaaaatattgcggaaacgaagggagcaaaaccccgaaaggaggagctcaattgggaacaccatatggacaattcaagtaaggcttacgttgaataaacattgttatatgaatatgttttgtacaagtcaaagcaaagaattcgagaatttagaaggagattcaattcacgaggaaaaagtataggagaaaattgacatgcacagaccaatgatgctatttaaacggatatcactggccatattgttaaaagcttattctctagagtatatgagttaggccagcgcatggtaacagagaaatttataaacttgagtcaaccccaaatgtgcagatttaatcaatttccaatcagagataatattgattatcgaaaaacagataacatttaaacgtttatatagttacgtttaatagaaacttactgaaacatcgaggtgcatctccctgccaactacccgtagtctcgttgcagaccaccgttctttgtccatggagctcgaaaccagggttacagcgatacacagcaatgcttcttgcagatttaccacgcatgcgcacatacccgttgacagggctctcgggaggacgaaaacatactagcggagctggaataacagagatattatatagaaattaaaattaaatttaaatgaacagctgcaacataaaaatcttatgtcacatggttttaaacgaccgtgtcttattaaaatcaaattgatatgaaacaattaaaacgtacgaatcgtatgttacatggttgtaagcttttgttatcaaaattaaattgatatgaaacaattaaagcatacaatattcttaatcaaatattgaaattcattcgtaagtaactttataccaaaattttgaaaagaacaagaaaaaccttaaaatattaatgactataaataacttacaggatagacgaaagaaaaaatggtttcccatcttattttatgccagaaacactaaactgacaaatgatcaacttgctaatttatttctccaataggggcctattgcttatatcctcacgtcactatgtgttactcgaacattccattcaggattgttgcagcaatttcatctttttttctcaaacaagagaagaagaaattgttgacatagtacgttatataaaaatgattaacagttgtggttttgaagaaattatctatcatatatcttctcttctttcatatatttttttaaattttctgtaaatacagggaatctcactaataaatttgaaattaggaaattattccagtacttaaaaaagatgaccgtcaatcattttcttactatcgaccaattccacaacttcctttgcgtttctaaaatacttgaaagaatcatttatagcggatttatttcccattaaataacatttatctgttaagtaactctcagtatggcttcagatgtaatcactctgacttgtgactctgctcgtattacatgacagatttactaataatattaatcacaaacttcactctgttggaatatctcttgatctttctaaagcgttggatttagttaaccatgaaatcattttgtccaaactcccagactttggaatacctgaaatttgtcttaattagtttaaagaatacctatgtgatcggttccaatacacttcatgtaacatatacaattctcctttaaactaaagtcaattctcattttgttatatttcaatgatttatgcactgtctcatcatttcttgatgttttgttatttttgcagaagatactacattgatgtatttacatagtaacttaaatcagttgatttattttgcaaatattttaactgtgtatagatatcagatttgttcacaatgcaatgcaataatagtaaactactcaaaatgcaatgtgtgatgttatcaagttagaaattaatgatattcaacttattacttctacttccacaatattcctttgcgttttactggataccgtactgaacattgtcaaagcagatctaagaatgtttatatattgttcaaactaagctacattctatctgaaaggcatttggttatgttgtgtgactcgttaattctcccatattatcgcaatatttgatgagttagttcatgaaattctaaacctgaacccattcataagttacaaaaaaaagaactttgaatttgtttctcatcttccttcctgtcttcatcaaatccaatttttaacaatctaaagacttttaatttagtaagacatacacgaatgtcaaattgctgtatttatgtttaagataaaagaaaatacagttccaaccaaaactgcaatttcttgttttgttaatgtgaatataagataaatatacataattatgatacttgatcgggttgcaaattacatttgaaaaaagcttattccaccaatttgttacaatccttcaggcgccaaggtcctcgaatttggaattaacttgagaaagtaattaaatctgctacaactttgaatacaatcaaagacaagtaaagataatatattcttgtcaaaagaataaagtttcgaagtcaattgatataaaatgatcatgccatttatgtacttccacttttctgtcgtttaaacttttgtctgaattccccacccctctctctcaaccgcgaaatcattcaagcaacgtcctggagcagggcaaattcagcgattggggctggtgtgatcaccacaccatagtttagtacgaaatcgtttggaacctgcaaccttgacaacttggccactatgacttcatacttaggtactatataggcgtaagcattgaaatcatccatagaataaacagtggggcaacaacacaacataaggaaacaatacttccgttttggctggtcaaacttcctgattttcccggattttaatttgagttttttttcccctcctaaattccttgacgttcactgactgaaaacaaaaaggagaactatttttccgagataattgtgaaccctgtgaaacaatcgaacccatgcatatatttcagggataaatgtatgttagaaataaatcttcagtttgtaactctacgacggttcgagggaaagatgtgggtattaaagataaactttagtactggaaataagattgcattgtgaaagaaaaggtgtggaaaggatcagaaacaaaataaattcaagaggaaagccctcagtagtgctccgtgctattgtacatgatcagctggaatttagaacaaatcttcatttcttagtatgtttatgatatgcctatacatttaaaggcacactgtcctacttgtacatgtagctacttgctccctctatatagaaaacttccccaatcggtgcctgttggtcccccatgatcctctttttcttatgttaaatgagagctgagttaatgagatagccacctgtcacagtgacctcgctggctctctgggtggtctaatcccttctagctgaagtagtaaagcctgcctttaaagctaactcagtaataatatcttggattaaattgaattaccgtggcaatatgggtagtcactccactttccgttgtcttgacagataatgaactcatctcctacaagcgttgcgttaggctcacactctgcgcgcacgatgtaattcacagggagatgcgtcaatccatagtctgtactgttctgatattcgtaacgtcctttccgtaaactcctcggtcgacgacagctagtaccctctgaaagaatgccaaatacaatgtttgattattggaaaagaagcatgcggacagtttaaataacataattaggaatgtgatattcgatccatgatttcccatattctacacaattatttttttggaataaagtaggcctactttcaatgaacatcaaacttgtcaaaagtggcgacatatcgccatcttaatattcacattctgatcggcgaagatgaatattgagccattatcattttataagaatagttttccgctcaaatccagccagtgtattgtcatatgtgccactgttaaacaaatcagttgtgcacttgctaccaggttatttgttgatgcccgttgtcaacctttttactctaagttcccctttttttcttttatttccccctttcttcgtctattattctctttctttgtggtgtattgttctaaggcgtatccaacacaagcctatgtttttaggatatataccgtctccctttcattaaaattatttgtcgtcttaagaatggttatgttaccatgcatgtagaaatgtattaggctacttgagtattactagttgatatgaaaaacagaaatggaagaaaataaatgttactttgaattgaatggaattgaattgatggttcagtggtagagcagtggtctcgtaaccggaaggtctctggttcgaaactaataagtcgatgcgctatagtgccctttggttaggcattaatcctcattaccaagtcccttggagaggactcaaggccgtcaatcccctggccacttacttacaagcatacacactgttttagcagtcaggtaaaacacacaatactaataaacactgttcgaccataattatgtaacttgcagccttttcacacacagctaaaattcaataaacatgattagtataaacgtgtttgaaacgtgtttaaactaatcatgagcctttcacacacagaaatttcgttgcgatcgttaatcgtttcgtgattaactactgctcgtaaaatgcgcagtagtgccattgcgcattgaaggtcaggtcatatcaaacagagcggtcgcttcatccagtttaaacacgtttaaacacgaaaaacctttcacacacaaaatgtcaagctctttagatacgaacttcgtatcggcagcctgcttttaggggcgtatgcatcgcgacttcgtatctatcccaacatcgtataaacgatgttcacactgggaaaatttttctataaacatgtctaaaactgttgagtgattctaatcatctctggaaacgatgaattttagctgtgtgtgaaaaggctcactgtctcacccaactatgcctcgccgtcaaattaaacaaacagctaggacttttagaattgcacaacgacatcgtggattgctacggtcgacgtccttttaatgcattgccttgaattggacgtcacacgtttcagtccacgcaaatctaaaagtccctaatatcccaatcacaccgacgggaacaagcacccgaccgactatagcccgaaccaccccgaataacaaagaatcattcgggttggagtcgggttgtagtcggtttggagtcggttttggaggtttgtggctgggttctaattaataactctcacctgcagaggagcagaggattcccaagatggcggctacgatgatcgccaagaacttcatgtcaccaatcagcggatctccttctcagctaaacaaactccagctgtacaatacacgaaatcaacaaatgaaatttagaacgaaatcaatcgcatacaaatctggcaatgaaaacggggatgatgcactagttcgggtgggtgaacatggagtgggcaagttggcttccaaagccgggctgaaagatcaaatttgaaagctggtaaaagcttcttccgagaaattaaggtcaggaagtttaattgatgttcaaagaaagaccttttatatccatgatgaaatatgacggtgggaaattagaaaaacatttggtatattttgtccttgagttgcgaatacgaatgcgatcgttgcagtacgtgacgatatcgcttagtttaatggctatagtcattccggtgatagatttggataaaattattctcaaatcatagactgatgggtaaacaaaaagaaggaagaagaccaaaaaagagaaatgagataaatgtatcccgtttgttagccaaatccctcaaatgcaacgcatgtttagatataattgaatagatattatacaacatgtacaaagtcactttttctccagattttatattctcagtttatcatcaccaggttcatgagtggttataccaatcattatggacactaccatgtcgtttgtaaaagtaataatagtctaataataataagttggtttcatttacccagagtagccacatcagtattgatgccgctttttcctggatgtcctgtggcccatgccattagtattacccccacattaaagggtaaaaaataacataaaatatatgatataatgtacatcaaaaagtctaaagatatgtgatgtatacagtattacagatcaacaaaattcaacatgaatttgtaatttagtgaccctttaattgtcaggtgcccatttacacctgtatggagtagccaagaacgtgggccaaaacaccttgtctaggatgtaagcaccgaacaaggatcgaacgacggacctctcgtgtgagagtaaagagccttcaccgatatgacgtagaacttgaaacctcccctatacccccccccccagggcaatgttattccgtatcctcaaataatagctacaatctgttaaaagctataatacctataacagaatttaaacggaaagcggggtcaagccaagagcagagatcaataacatcctgagtatcctggtttctttcctgttaaactcgtaaacgtgcagattgatcttttaaactttcacgaatgcacaaacaatataagggaatttcccgaatgttttggaaaagtttcatatgcggggtttcttccgttgacctctgcatgttcgtgatatgaagacaaaaacgaggcggttcaagggatttaaaatgggggatggtaacattccgaataacaccttatgatcttctcatttcagcttctgataacgaatgtatggccctccctcatcctgaatgttctgatccagctgaaacttgacctagaccgagcaattttcatgagtttttaaagaagtagttgagatctgttactgcaatttctaagagaacgaaaccgtctcggagcaatggcgaaaggttgattatgtgtactgttaagttttggaatcatgacaagaaattgactccgccgcctcgctgaaaaacacgtgcgccaagaactgaaatgagtgtatgggactactcaaagatatggcaaaatagtttggtgtaaacatttaaatcagcagtttctcgtcatgttttgagcacaatccctctaattgttcccctcccccttttctcctttttcccgacagcaacgcaattgtaccgacaatatcctgacaggtaagggggggggggggggtggtcgcattcccactacccaactttcagcgacgccccttgttgttatcccattattcttttaacagaaatgcaattcctcatgctctcgcacctctcttctatcgttgtttaattctctttaattttttcctttctctctttcccccattttccatgtcctttttgttgttgttgttgtttttgtttttgttttgttttgtttgtttgtttgttttgttttgttttgttttgttttgtttttttttttttggggggggggggggggctatacgcctggcaagaaggaccctctattatgcacactgcaaaagtgcgtggctcccgcccccttctcggtaaaaaaacaccttcttataatatcattcccctttctttttcccccttctcattattctcctcttcccccttttctgttctccgtctcttcccctttcttcctattccgcttgtctcccctctctccctcttcccctttcttcctttacccctcccttttcacctcttcccttttctctcctccctcttttcttcttttttctctcttcccttttctttctttttcccctccttttttctatccccctcctttttctccttttctccctttttcttttttcccttccccttccccctttttaccgggggggggggggca

SEQ ID NO: 64992 - DNA, 2221 bp, Oryza sativa
cgttggaactggtcatcttgtaaaaaagtcctcgattaacttgataattactcttacgtccctcaccctatgttcctgtgttttgtactctttcgtaacagccctcaatgtcttggtatatactatgtgaaggagacaaaattctagatataggaccgcgctctgaaaaaagggaaataagtgtgttttctgcaaaagagaacatccctatcctatcctctccattcccctgaaaccctacacatcactgttctcccgccctttctcttcctttcccctgcccttgcaccgccgccgccttgccttacctccccggcttctcctcgccgacgacggctttcccctcacgctctcccgtaccctcctcctctcttggcgctccctccatcaccccccttccagtagagcaaggggatttagggactggatggcgcaacgttggatttgggtgcggtgatggagtttcgccggcgacggccttcccctcgcgctcttacatgtcctgcccatctcttgccgcaccctcaagcactatccgcccgttttcatcgccacccgttgcagcagttaccctgttttgtgttgggctccacggagctgtgacgacggtagcttcggccaggaagcgacccatggaccaatggtgggagcatttggcaaggacacactcactcaagaaccagacattggcctgcgatgggaaacaagctcgaggatgccaggttcggtcgccattgaggtggttcccctttttatatgcttttcttcagtttttactcgctttgcctaccgtgagatagtcttgatctggttttttcctctatgtcagatggctacagacttgatccttccactctcacagccgtcaacaacatcggggcgattcgttttgctgcctggtgggctattgtatactgctgtctgcttgctgctgaatgaagcagctagcaaatattgttccaaactaaaagttgtagtggtttggtgtgatgaggaagccagaaaattaatggttaggattcagtggcctttcattttatctttatataggaattcattcccctaaatcttgcctttatatattgattttaattatgcagattttctgtacaattggcactggacattctttctgtatccaattggcactggacattctttctgtatccagattcattgaagcatgtaatatttcatctttgtaccatgcttctatttaagaggtgtgcagactctctctgtttcgttagaatatgccaaccatcatgtttattttgcaattacctacggcactagatgaagcacttatatgtaaatattactgcagagtgtttatcattttgcttaggttgcttcttaaaatctagcgcaggtgattggaagaaggtttagctgatcttggatatgttaggattattagaagctaaatgtttccttgattttacttaaagtagctgtttgccgcttgattttagcgattaaagtttctggtctgaaagaagttagggtgtgtttggttggtgggatatacccggataggacatggccaccgctttttggagggtgtttgggagtgggatagggcggcccagaggagaatatttcctccagatgctggatagagggatccggttgatttggccggatgcaaccgcccgaggctcgggcgagccgggcaagcgagttgcgtaactcgcgtcacccctcaccaccacgacgcgagcgaggcgacgagcgcggtggtcgccgagaggggcgacgagcttcgccgcccggcgtgggcgacgagagggggcgatgagctcggcggccggcgagagaggcgacgagcgcggcggccgccgagagaggcgacgagctcggcggccggtgcgggcaacgagcgcggtggccggcgagagaggcgacgagcttggcggctggcgcgggcgacgagtgtggcgggcggcgagagaggtgacgagctcggcagctggcgcgggtgacgagagaggaaggcggcggcgggaggaggcgagcctcggtggtgggaggaggcggccggcggcgggaggaagccggcgggaggaggctgctagcggcgtcggcgagcccagatctggcactgcttttttttcttttttcttttttctttttcttttttctatgtgtatttataatggaatgtgtatttataatggagtgtgtatttataatggaatgtgtattatgtattaatttg

SEQ ID NO: 64993 - DNA, 15055 bp, Oryza sativa
  unsure (1)..(15055): unsure at all n locations
ggggggggggggcacgtgcccccccttgaatccgccactggtatagttgtgttatgtaaagttgtatgatagtggcatgcctggcccgccatatttaccttgaccaccttttgcccccccccccccccccccaactcagtgttaaaggggaagtccaccctgaaattaagttagttttaataggagtagaaaaatgagagaaacaagtcagtgaaaatttgagcaaattccgattaaaaataaggaagttaggattttttaagttgtgatcaatcaaacacaaattggcaactctatgacgtatcatgcgagcaacttccatttgctcagtactaaaaaaatctaaaattttcattttccctcaagaaaaatttcaaccatacatgcaccctaaatataataattgcaaatatgtttctatactccccctgcaaggaacaaatatatattccgtcatcaataacgaagaaaacatgattttatggaatattatgcacaaagcaaatgaaggagagctcgtataataagtcacagagttgccaatttgtatttgattgatcacaacttcaataattcataactttcttattttcattcagaatttgctcaaactttcactcacctgattttcatattattctgcctctatcgaaacaaacttattttgggggtggactttccctttaattagggtacgcatatgcgtgttcccagcaccccaccccgcccttttcagcataagtccggtgtgtaaagtcaatatacgaggagacctttttcttttgttatacgagcctttcagcaccccccttctgcataagtccggtgtttaaagtcaatacgggtaaacctttacgaaccggagattttgagaacacacatgcggtccctccgtttccggggtgagggggggggggtgggcgggaaccatctctttaagataaagacaactcctggtcatacgattgcattgtgaaagaaacgttgtggaatcggtcagaaaaggttgatcatctagcttataaatattgatgtgtactgcaaggttctggaatcatcaaaatgataagaaatttggcccagtcttggtaaagttacaagcactatacacaaaaagatgtatatgggactacgcgacacgtgcgcgatatctatccggtccagatagatataataatttaccaaatatagcaattagtataggcggtttcccggcaaaatgtgtatcatcacatattagtcaaaacatattctttcacatgattgagattccattatcatattttgagaggggggcgtttccaaaactggtctttactttaacgcgacctttaccctagggtaacttttctctgtctgaacaagactagtattgaactgtaggacctctcgtataatagtcaagtgccctcaccataatataccacggtactgaatactgtctgagttaagtttttcattacagtgttctctggatcgctctaagtatgtaacaattaaacgagtgtacaattaagacatttcaagtggcttattttttcctgaattaatagcggaaacatctggaattttcacgcggaaatccgtgtaactaacacccactgaggaaaatgttgagaaaaaaaatagaaatcactttccagtgtaattgtggttgaaatgaaatatccttagacgggctttgttttgaactaagaagtaataagtttaaaatggagttaattggttgcaatgaatgataacctgagcgcctgtgtgattcctccgagttcaaaatcctgcaacaaacatccggctctttgaaagtgaaaaatccctacttttcacctgaaatcgtttgaagatatcggagatcacctgaacagcaatgtggctgctaaaagagtgtaatgattcaccccgtcctcatttggtgaagggtcatgacacatcggcattgcaaacaattgcaaaaaggttggtcgactggactttgtttctgatctcatccgatttccataaaatcatgaactaaaaataaacgtttattgatcttcggttaaaagtccattaatcaacaatttttcaagaccattattaggtgcggctattggagatgagttctggtcattcgattacattgtgatagagaaggtgtggaaaggaacagacacaatgaatatgacggacaaagaaagaggacaaaatgtacagttcctcaggtagacaaaggaacatcccttcactggtattatgtaaaaatgtgtagaacaggtgtcacatgcagatcacctgttctacacattgtattggtttgtactgcaaagttatggagtcatcaaatcataataaatttggcccagtcttggtaaagtaataaatactgtagacagaaagatgtttatgggactacacaaatggtgtcggggctactaaccttgatttcctaatctttcaatgctattactcagccagtatacattttctacaaaaattgttcggcaaattacatttatttgtaatcttaaaaattcagtgtaagtttcgtttgattctgtgagaattcattttctcctttttgaccagaactcacctttatctttaaaactgaagatttcactatagttgagtaggaagatgtttctatatacccccactatagttacgacatgaatcgcccactctctaccaaagtttaaaaaaacaaagaaccaatctctacttcttggaattgttccaagtaaaggagaaaaatacgaaaaggagaaaatgttgttctttcacatttgttgagaatacctcgctgcacctcaagctacaggagggtaggggcacgtacccacacaaaaagagagaaagaattaaagaaaagtatgtgaaacttgtaaagaaaattatatgatccactcccagaccccaaattaactcttatgtcacgttctcttgtattttacacacatagttagaccaatgtccccccacatcattgggcacgtgcctcatatatgaatggcaaagccccccccccccaattgcattgtaaaagaaaaggtgtggaaaggaacggaactttttgatcatgtagcatgtaagtattggtgtgtactgcaaagttatagagtcaacaaaatcataataaatttggcccagtcttggtaaagtaacaaatactgtacacagaaagatgtatatgggactacacaaatggtgttggggctacttaccttgatttcctaatctttcaatgctattactcagccagtatacattttctacaaaaattgttcggcaaatgacatttatttataatcttaaacattcagtgtaagtttcgtttaattctgtgagaattcattttctcctttttttaccagaactcacctttatctttaaaactaaagatttcactatagttgagtagggagatgtttctatataccccccgttatagttacgacatgaatcgcccactctctaccaaggtttaaaaaaacaaagaaccaatctctacttcttggaattgttccaagtaaaggagaaaaatacgaaaaggaggaaatgttgttatttcacatttgttgagataacctcgctgcacctcaagctacaagtgggtaggggcacgtacccaccaaaaaaagagagaaagaattaaagaaaagtatgtgaaacttgtaaagatatgatccactcccagaccccacatttactctaatgtcacgttctcttgtattttacacacatacttagaccaatgtcccccccaccccccccccaaaaaaaaaagataggcagagagagcgaaaataactcccactcccaaacctttcttttgcatgttttcttgcatttcatacacacgattggtgccccctttaatgactaaacccaggctgcaccactgccgcgacggcctaaagaatagatttagcgatttattgttcactttcacctcacgggctgctgaagcaagacgtgtttttgttccgctgtctggtctaccattcgcttcctggagtaagaaattatttctcttctagtttgattgttggtgccttttttcttcatacttttattattttggtatttgtttgtttggggtgttttttttttcttggacagttattatgcatttgtttttgtcgcttgaaccgaataacactagtacaaaaaaaaaactgtatattaatagcgctcctccagttaaaactagctgataaaagcgcttcatagtgttatatcgaattttttgttttaacattccagaattaaattcaagcttctctaaagtcatgggcgccccaaaaaattgatagcagaatttcacttaaattgcatcacaatgtgaaagaggatgtcatttaagacacatttctgcaatgtgtttgaagtagaatattgagaaaagcatacaaaatgttagttttctgcgtacaacagaaaacccaaagtacgtattctgttatcaatattatttttttttggtgggggaaagaggaaatctttgcagaatcctgtcttatatgccattccctttcacattatgatacaatttaagtgaaattttacaatcaaatttttggagaatttgggtctcccagctttagaggagctttaaacggtctatttatgatacatgtatgaaagtagcatacacatgcacatgtacccgtctgacattcagaatgttgaaacttctatttgattcttagttttaatggtatttactactgaaaccaattctgtgttcaaattgtatctaaaacttgattttcagacagaaataggtcaacattttccctaccctgggaggggcgggggggggggcacttgagcaggcgctccttcaccacctctgattattgccgtctttactttgactcttgctcctttcttttttgagcgtccctttctcttttgataagtgcccctttttcctctatcaatatgtgcccctaatttaaagcgactaagagcaactttttcttgttatgctatgctcgctcgcatttataattgatataatcatgctcttaaccatttgacttttcgtctttataagatttaattttccgcactgcgacatcaaaaatcttatatatattcaaaccatcacaccaaactattgaatcatcatccgtgataatgtgatcaccaatgtctcaaaagtgtaattttcgcgtcgaggcttcccttccaaggtgtatttttctctctctccagaaagtgccctttttgatgatgccccctccactttgaaagacgctccgccaaccctggaggagaccccctccgaaactctctccttacatggctcaaaacaccctcgacagagtcctctttaaataatatctttctttcaaaatgtatccatttaaaaaaaatcaaattcgtcagttttgttagcaagtatactaacctgcctctcatttatgttactattcctgatatattgctttattgtctggaaggacggtatgaatgtttggattcgagaaaaatgtaattgttgtttaatcaaaattattatacggtttaaagcatcgttacgtttctcaaggaaaccaaataaaacatgtatttattttattctacagtgtgttacgatgtttaaccagtcagtcaaacgactccaaatcaatttggtcacgtaacagaagtaaaagagtgcaccatatcttcttcttatcttccacgaagggaacagtttctatttagaattattttaattttcacaagatccttattcaaataaattatcctatttaaaagtctgtactgaaagtaccgaaccgttgtatgcattgtacagcgaaacatcaccctgaaataatattgcatatatttattatcaaataatataccatctgcatgccatctattacataatatattcaaattatcgtccctttcttttaacaggatttggtatacagtgcgtccaagaaaaaacgtaaccaagaattatcgatgttttatcatagcttaatcacaattataattaataaatgacacatatatgttaagcttagatcctcctctttcatttgatgcaactcatacgatgcatattgcacgcctgagtgattaaaatcaatttaaagagagggaactaaaaagtcatttggcggaatgtatctgaatttcaaagacaaaaatcacatttctagaaagttcagtttctgcccttccataagacacctcaatcagaaaaagatctctttgtttaaagttatgcttgcatttccaaagatagtagagttataattttcaaattttgaaaatgtgaacattttccacaaacatatgctgcgttcaaactcttcattaaatatatgatatcaataggaaccttgtcagaattacgaagagatatagaaattaataaccgaaaagagctcgttgcccaagctcgtgaccacttgatggttctgtggtggaacgcagggttagtaactatcacatacatgcatttctgagtttcattggttgttctcatgtatctctgcagcttgctcggctagaatcacttcagtttgtctgagaaggcgatccacgaagtgttgaaatgaagttttcggcgatcatcgttgccgccattataggattcatctgttcctgtgcaggtaacaaaaagtacaatttatttgtagttatcgtccggattaaacaaaaattataacgaagaggggattttcttctcttttttttttaaatatgataattccaattatgcaaaactctttctaaggatactagttgttttcgaccatggtgtttacggaaatggcatatcagaacaaaacagactatggattgacgcagttttgcgtcaggcaaatgactcctcgtgttcaatacgcatttgagaatactgtttttcactatttttccatgggcctcggtcccctggacccacctaacgtaaaatatgtgttttcaagcatgtttcttttccaattatttcacatttttcagagggtactagctgtcgtcgaccaaggagtttgcggaaaggacgttacgaatatcagaacagtgcagactatggattgacgcatctccctgtgaattacatcgtgcgcgcagtgtgtgagcctgacgcaacgcttgtaggagatgaattcattatctgccaggacaatggacaatggagcgattacccatattgccatggtaagtgaaaggtggttctaccttttttttctttttcaaaagcttgactaagtgttttttttttaataagtgacttcacgacagcgtttgtccattgttaagtcagttagttgcaattaagacactgttctggtggtaaacatcttatgccaatccattacagacagaccgtaaatgatgtattacattttttcaaaactgaaacacatgaagcacatgaaataaaggtgttgtggtataatggatgagtcaccggactgcagatcacaaggttcgaggcttgatttcttgccgcgccattaacttggcaatacatgaatctacgtttaccacactcgaattaactcgacccgtgtgtagttagtgagtgcatataggattaatcccatgattgcaatgagcgctgtactattgccggagctcgagccgtggtaataatatccaaggtcctctagaagcgggtagaaacattataatgatatcatatgcgctacacaagaagtaaatattacaattatcgcaagatttgcatgctcacatgttaataccaatgaattgcactttcataatttgattcactttctatctcttcatattatattttgtaatcttttcttaacaaatgttttgctaatactatcgtctttttgtcttccagctccgctagtatgttttcgtcttcctgagagccctgccaacgggtatgtgcgcatgcgtggtaaatctgcaagaagcattgctgtgtatcgctgtaaccctggtttcgagctccatggacaaagaacggtggtctgcaatgaggctacgggtagttggcagggagatgtacctcgatgtttcagtaagttactaatagacgtaactaaaaagtttaaatgttatctgtttttcgatagtcaatattatctcggattagaaattgcttaaatttgcatatttgaggatgactcaaatctattaattcttctgttactaccatgcgctgtcctaactcataatctctagagaataagcatgtaacaaaatgagctgtaatatccgttagcataattggtctcagtgcatgtcaaattttctcctttacatttttctcgtgcttgagtcttcttctaatctctttaattcgttactttgacttatacaagacatattcatataacaaagtttttttaatggaagcctcacttaaattcttcatggcgtttccaataaatattgagctctccttttggggatttgcttcctgaaattctgcaatatttgctgtactcaatactgtattaaacatttaaaatattgggcagttggtaagaagagttaaagcatcttgctattttgtcccatcgctatttcgctcatcattttcagttataaatatcgtccaaattttgtccttgacatttccaggacctccatcatgccctgacccaaacgaaccatccgggatgctagccttggttcttgatgaaaactctggaatcaaacacgatgatctctacaccgaacgcacagtgttcaactatacctgccaaacaggataccacccaaccggggacgtcacaatcacgtgtcagaatggctcatgggaagcggatgcggatgttccggaatgcaacagtaaggttcaaggttcattttcttgtacataataatgttataagttaaacacaatagatcatttttattttgggggtatttttttgtaggggggaggctttgtattttgcagaatacaggagaagatggacagatgaaggagcgtcggaaactttggggaattcatatacagatgcacttctgcatccctaccctttgaaaaattgaaatgagattggaatcgtttaattggacttttgttttggctcccttggtaaattttaactttattgaggattcattcgattatgttgctttcatcttgtcaatttttacaaattgtatggcgtttgaacccccccccccctcacctttaaagtcagtggcgatcgttaatctcctatcgcacctccgatgaattattttgaaagttgtttaaagcattttaggagagcttttaaatgtttaatcttatttttacaaatagtaatgtcaaaacgcaattcatcacgcaaaaccgtaaaacatacaagtgtaacagtgtaaatcattaaataagttcacatataatgtaaatagtttttcattacttactacaataatatcttaaatgtttaatattttaggcgttatgttcattttgatctagtttttaatttgttttagtttttaatttgttttttcttcatttgatataaatttctcaatctcttatggtatgttgtttatataatgtctttgttttctattctatttttttgtaaatctttgtatgtacatggctcttttgtaaagcaggcctttggcgctgaaaaaaattaccatgtttttaaataaaactgaataaataaataaataactgggtgtggattaggacctttagacctttaggttcttaaaattacctcaaagatgaaggctctatctttatacgttagtccatttggggaaaattgggaggggtcgcaacctctcccatggaaacggtgcgtgtataatcctgtaattgcacggtcattcgatgagctgcatgttggtacatctttattcttacaatgcagagatcatctgtgccccacccaccctggaacccatagagaatggtacacacaacattgagaacaggacatacaatgttggagaagtaagtcctaaagttgtttttcattatttgggtaacaaaaacaaaaacaaaaacttatcaataaaaatccaagatcattagctaatggatagtggattcgttactcccacaatcatttattatctaacatgttgacgcataatgatgatgatgatactaaacaaagtaaataatagaattaatagtagtaacaacagagggaatagtatgattttagggccccagggataacagtattaatactcatgaggcttccctgagttatcattgttatcattactagtatttataatatcactagtattatcattataatttcacggacttgctatttagtttactgattgcaattacactctgactgtcaatttattattgctgattaatgattcattatttaatattatttttcaataacgtaatcataatgtattacatcagaagagataatatcttaagaattcactgattgattaagacagtagttttttcgacaatctgctcgccattgatctgtttagatagttatttactaattgattgtttgactaatttgctaataagttgactgactggttaaacttagattatcgagtagctaatcaagttagtggttaatgagtccatagatttgttaatcagttaagtaatttcttgataagttaattgattaatgagtcggttgttttattgcagtttattgattggtaaatcagatgtgcaacatcactcgcaaatgttttcttccttacatacgcgcattagtacccctatttttgatttcatttgcttcgatgttttttacttcaagaagttcatatttcaatgggtattctccatcttcgtccacagatggtgcaatatgaatgtaacgaagggtatctcgtcgatggaataagctggcaagtatgtcagagtcacggtggacccaatggaatatggtccgataacgtaccaagctgcaaaggtttgtggaactctcattgatgaaaagaattaagtccgagaaggatataagtcatttacatgtattcataaataaggctgtgttctttttgcctttttctgcctattcgaaaattctccatattcctttttgtaaaaacttttgttcagtaccgagtagtcctttgttttcgtttttcattgctttcgtgtactgaacatgaagtgaatattatctaaattgttttaaatatacatgattgagcagcgtccgagtaaaaagcctctgcgttgtagcatgtgggacccaactgaagactgcaccacacgaatgtctggtagaacagcttatcttaatgcagatgggttggtgattttgacaacgggtccaggttttaacaaatgcttaggtttgtgtatccattgtgtaaattcatccatggtcgaaatagaatatccctgttgtcactatgctatattaaactattcgatctacaaaagaagaaataatcgagtatcagctgtaataataaaatataaaacgtccgatgcttttttcgtatctttagtcgcaaggtgtccccatccgggttcccgtcaccttgacaacggcgagatttctttctcgccgagaaacggacaaggcgccacgaattcttggcccgtaggagcggtgatgaccctcaggtgtcggtcacatctagagctgcttgggtcaagtgagagggtgtgtcaacccgatggtcactggaatggtactctgacgtcatgccacaatgaaggttattataccgatgttgttgtgggtgtaaaaaacacggacggtttgctgatgtgttgttgttgaggatctagcttttttttaaaatccactcctcgtaaaatttacacaattttctcattttatgcacgccatagacatctacattcattcaaagagacttgtggagaacctctcaaatcaattcattgctttatatgggatcaaatattccagtttagggggcaacgaggggtcttagaaaataattgaaccattggtaagtgtgctggcgagcgacaagaagtcagcggcaatgttacacaatcgtgcaaaaggtagaaatatctaatttgtggtgtaaaaaatgtgaatgaagtgaaaactatttcgtttacatgttagctgggctaaacattattctcatttctaggtttgggctgattaagtggtaatagatcttaggtgttctcataaannnnnnnnnnnnnnnaaanngnnnnnnnnnnnnnnnnngtcgcatcttcaggacagtgaagtcacaggacgggccaagacgaaaaaagttctcatcgactaattgtcattagtaaacgtttgaatgcgcacacacgcacacgcacacgcacacacatacacgcatactcgcacacatccactagcacaccggcgcatccgtcaacatggctgtaaatatacatgtataaatgacgcggcattctctatcagagacgatatttgttaggtttataaaataactgattccttgtacaacatattcttctattgtcccgtatgttttgaaggggacgtgtgtgtgcgcgtgtgtgcgtgcgtgtgtgtatgtgtgcgcgcgtgtgcgttggtgtgtgtgtgtgtgcgcgtgggtgagtgcgtgtgtgtatgtgtgcgcgcgtgtgcgttggtgtgtgtgcgtgcgcgtgtgtgtgcgtgtgtttgtacatagtcgcggagttacatgtggtgtacctgtattgtgaaccacgccgttttccggtacaccactttcatgttgttattttcaccatagagtacgactgtccagccttggggaaccccatacacggctctaaagtcggctctccgcagtacagagtaaacaccaaggtcaattttcgatgcaaccatggttatgagatggtgggttccgaagagaggatgtgtacgttttctgaagagtggactggggagatgccaagatgcatgggtaagattaacattttactttttttcccgtgaaggtaggtgtacccacgtagattatgtcgaaatgcgcaagtgttcacgcatcgtaaaataaatattattaacataccagggggggggggtgtttcataaagagttagtaaagttacgcatgactttacgaacgacttgtatatgaagtgccagataggatgcccaaagttttttctgatatttccaataacctcaattaaattatggcaaaaatatactttgcattaaaaatgtttgttataataagaatgttaatctacatctgcacagttcaacttaatgaataataatcaagaatgattgagcatcacatttagcttttcatatacaagtcgttcgtaaagtcatgcgtaactttacgaacagctttatgaaacacccccctggtacactattttacacatcccccacaccccccccccccgtaagaaaaagaaacaaaaaattgggaaaatgaaatttgtattattatgattcatattaccgactaaaagtgtttccattttattatgacattaaattcactgttaaaatctcacgactatactctgtacaatctctcggaaggaaaatgtaggtttctaatttcaaatttctctgtctgtcatttgacacatcatacttcaacttgaaatttctgctgatcttaggggcgcactgggtgggttcttagatgatgtacaatcattattacccatattcggatgatcttgtagcagaaatctcctctgttcaaatttaaggtcgtgatgagttcgacgaactttctcgagtgatgaatgggctagggaagaccttcgacgaaatcgtcatcgacggcggctcttgggtgggtcgaaatgacaccagctcgaactcaggtttgcgaaggaaacgtacaattaaactctctgatggtatggatatctactttgcgtttgatgcgtcgaatagtgttggacttgaaaacttcgagataggcaagacatttgccaagcaactagtgggaaaggtaagagaagtataaagcagaaataagaaagtaaatgtccatgttcaagaggaaaagagttgatagagttttacaaatctttattgatgatgtctttctaataataactattagaatatagatattacctatagaatttagttaaaaattatcgaggataaacaagtcacacactattaaggggcagtggcggatccaggatttgccaatagggggggggggggctgaagtttgaaatcgcaacgaccaatatttcgctcagtggggggggggggtagtgtgagcactaactacaacaaattaccgtcagaaaaacatttttctttttttcccctttttttttcctttgataaaaaaaaagtcgtcggcacccttccccccccccccgtggatccgcgcctgctgaagggaaaaaatgttatttgctaattttacatatttctatgccagtgttatgtattctaaatcaattggtgaatttttattgttccgagtaaacgaaggcatagtaggggcaaaattcccaatattccttttttcaaaagtaattattctggatttatagcacttaaacctaattacccgttcatttttactattactatatgcatatgcctaggattcgatcataattatatggcgatgtattccgccacataattgtttaaagtttaaataaacgatgactgcgtgcaacaaagttcgtgcacgtattcacttagctctgtatgtgttataagaaaacggacatgaagcgtaatacactttacgtcatctctaaaattataaaaaaacgcaacgattttgcagtgtcatatctgaacggccctttagaaacctacgtttatatagacacacaaacattaaaaccattcaactattccaagcagtggcgtacgcaggattttttcaaggggggggggggggtttaaaatcgagtccaaaatttcgcaacgactcaggaaaatttgaaaatcgcgccggccaaaaagtcgctcagtggggggtacgaggacactttttttttttttttttggtctcgaaatttgaaaatttgacattttgctctgttggggggggggggggtaaggtcagattttttaggtcaaccatgggaaatattattattatatatttttttttttaaatgcacaaaaaaaaaggaaaaaaaaaatccaaggggggggggggggggggggggggg

SEQ ID NO: 64994 - DNA, 23630 bp, Oryza sativa
gatcgatctagaagataagaaaatcaggaaaagaaggcaccttgtagggacccatggcgtgatttgttgtgggagagatgagaatcgaactggatgtggggaagaagagaagagaagagaagaggatcggattggtggtgataaggacgaggagagaagaaaggggcggccttttttgtagtgcaatttggggacgaagagaaggggggtttcgtagcgtgctagtatgcttcttgccggcctcccttctcttcgtccacgtcgtgtttgtttattaatggccgtcttggggtgtgtggggcccacaggcagcgacacaggtacctgcttcggttggtgcgcgtgcttgtcacgtactacgaacatggatcgatccaaaaaaagggatcacgaggagataagacttttttaacgcgaaccaaacggattattattatccggactctaggattatacgtacgtactctattttgttttggagcttactagctcgctcatcgtgatcgatcggatcactgcttttttcgtttttgtttaaaaagaaagccagagactgggaaatcaggaatccggccggcatcccaaatgctaaatcctgtataatttctatatgtgttttctcaatctcaaaatataagatgcaaccattcctaataaaagaaaaacattatagttgctcttagtttacatggtaagttgagaccattgctaggagcgatcttcaatgcttgttgcagtgatcttgtgctcgagcgagtaggtacatacttatatctacatattattctctttgctttaaaatatacaaatctaatgtaagatatttagatttatagtatttttttttaaaaaaaaatgggatgggtagagtagccttcgcgatggatgcggcaaactaaactgaactgacgtcgccgtcagtcgtcgtgtagtatagcagtgctagaatattatgcaagtggcaaagaatcacggtgtgttcatacgacgtgcatgcatgtgggccatgtcccatgtggctgacttgctactaatactgtactcgctccggttcgatattaatcgacattttggacgagtttgatatcaaacttttataactttaaccattaataactttaataatatttagtttaaaggaactagaacaacatatatagatttatcttttaaagtactataataaaagtaaacatatatttatttattatatatattataatggaaaaataagatcaaagatgtatcttgtagaccgtgtcattgtccaaaacgttaattaaaatgaaactggagggagtactattcaaccattgcaaatttaccaacaacatactccctccatccaaaaaaaagacaaaccctggtttccgtgcctaacgtttgaccgaccatcttatttgaaaaaattatgaaaaaaataaaaaagaaaagtcacacacaaagtattaatcatgttttatcatctaacaataataaaaatacgaattataaaaaaaattcatataagacggacagtcaaagttagacatggaaacccagggtttgtcttttttggacggtgggagtaagttagcccaataactaattaaggctcacctctccagccttcattgatcaactttttagcccaaaactataatagtaatatatcatccaattaattttatttacaagcatgaatataaaaatattagaatagaaaaaacacatagggcttgtttgatttgataccaatttattgccctaccaaaactttggtaacttcaattgtagcaagtgtatgtttattttgctaccaggttttgcccacaatagttcaaatttaacactacccaatttagtagtgctaaaacttaccaatattttggagctaccaagattttggtatggcaaaaattggctccaaaccaaacaaccccaaaaatataataagattatatataaaaacatagtattggaaagcacagaataaatactatagcatgttgtctggaataagggaatagagcaaaacacatgatttttgctatttaagtattaaaaatagtttttattgcttgatgagtgcttaaatatgctcatttaaggtcacatatattgatttgtctcggagttctcaaaggaaaatgaaacagtggttgctatggaattcctataaaagcattgggtgaaagaaaaaaaaaccttcatttttctcatatgatatcatgcacatttcctccaataatccaaatgagtgaataatatttatatccaggaggaattgaatccttcaattttcctctaaagttcctacgctccgagaaagccttaaagccatccgtgtaatgttacactatttgcctgctcctagttttatgggcttatataattaggttgtttttagttcacgtcaaaattagaagtttgattgaaattggaacgatgtgatggaaaagttggaagtttatgtgtgtaggaaagttttgatatgatgaaaaagttagaggtttgaagaaaaagttgggaactaaaccaagccttagtccgggccgttcctatgtacactattcattctttgtttagtagccacttgagtccatcatgccctccctctctctctcttgaatgtcaggctgtgttcttctcttctttctcaacttctactcgctcatttttatccacatattttttaaactacttaacggtatgtttttattaaatttttatatatgagagttgctttaaaagaaatcacattaatctatttatcatgtttttagctaataattaatcaatcatgcgctaataaagtcacctcattttttgtgttaggagaaaaatttccaaacactggttcaaacacagccttaatatgttatattactagctactatcactatgtgaatgccacatcaaaattttagtaaatttactatgtgcatgttgccatagcaatttttacatgtacatgttataggaaattcagtttattagacctatgtcatggcaaattacaactgtaagggtttgtttgtaaatatgtttacaaaatatttatttctatataaatttacataagggtctactataatcagttgtacttaaggtgtaaaccataagatgttcacttattcctttgttgcttacacatatctttctttaggttctttttgaattgtaggaatgaaaaaaaaaggaggaatatgaaaaaaacacatgattctgtcacgtatgcaagtgcaaaacggatgattgcaaaacacatgaataatcgtttgattggaccgtaggaaaaatatagaaattgaatgagaaaaataaacacatgaattatcatgttggcatgcaattaatgcaaaataaaaatattatttgtaacagaaatgcacattcattttgaacatgcaattaatgcaaaataaaatattatttgtaacagaaatgcatattcattttgaacgaaaaaattccggtctgatatgttaatttacagtagtgcatatatacaacacgtaaaattataaataaacatatgcaattgaacataaatactacaaaacattactagttagtattcacatgagtatatattttgcaatttacacagcaatataggcaaaataatgtgaataacctgggagcgggcctttccagcctttcggcctatttggcgtggacatgatggatagggccatcgtccttaactttcagccaccagcccacttcatcagcgcccgccagcccatgggaaagagaaggcccaccatcccaacaatggtcttttgacatttcggccgtaaagctacagctgcaggtacgtacgtgtacaccacgacgacgacgacgactatacgtacgccattacaccagcatagccggagtgacgacgcagatggatagatagatgagatagatgtgaagctcatgggttgacctgcttagagctagctaaaacaaaataagccgttgattagagatgtactccctctatcccatataaaatctaatcctaacatcccaatgcaaaaatagtgaagggtgaaaatggctaaaatgctccccattattaaaaaagtagtggtggtgataggtagttaaagggtattgaaggaataaaatttctcgttttatgtactgagggtaggtagaaagatagaagttagttttttatggaacaaaatttaaactctagaagttgattattattatttttgggacggagtgagtatatggcaaagaaagcctttgactgcgtacctccattgcatgcccctccgacgacggacaatcgatcctctcgtatgcatctgtctcaagcttttctatggttgtgttcgttcctccaggttgggacggacaattctaccctagagagcgaggtcatgatgggcaggttccgcagagtgtacgagaagataaatatggcactggactggatgttgtacggtgagctgggagtctccacccctcgcttccactggtggagaaaccatctttgatcggtccggcaaaatccacaatagtcttggatccaaaaaaaaccaggagtaaagattgtttttagtcccggttataaaatttttgatctttagtcccggttcatcccctgtcagatgtatgtcagggggccgaggatctttaatcccggttggtgtcaataaccgggactaaagatcaccactttagtcatggttggtactatcaaccgggatgatctttagtcccggttgatatcaaccgggactaaaattaaacacgtagtatataatccctatcccttatcctctcctccacagttacaacttaacagatcgaatctcaccccctctcctcagatctatcctctctaactctcttctccaactcctccccttccacctatcctcccccttctctccccttcctcctccccttcccggccagcctccccttcccatctggcgggccggcgggcggcagggccgcgtgctacggcggccggcggcggccggcggggcggcgcccagcggggtcgtgcccggcggagggcggcggggcttcgggcggcggggccgcggcggcggcgggcggcggggccacgcccggcgaccggcggccggtggggccgcgcctgtcgttcgtggcgaccggcggcggcagcggcattctttttttttttaatttgtgatgattcactgagatgtatttgactaagaagttacaaatttgtgattcattgtttggatctgtgatgtatttgagtaatttcttaggatattgtgatgtatttatttgtgtgtataagtaactttgatttgtgatgtagatttgagatgttacttcgatttgtggattgggggtttgatttgggatatgtatcccacttgatttgggagaaaataaaaaaaaagaaaaaggggatcatctcactgccgtaaccctctctttagtcccggttggtgttactaaccgagactaaagatctatttttagtcccggatatttaaaccgggactaaagatagcgaactttagtcccggattggtaatcgggggttacgaaccgtgactaaaaagtatttctccaccagtgtccctccctacccccacccccacctcaccgcgtacacacacccatctcccgcacacccacacacatgctcgcccccttcacactaaaatattaggcacacattgtagaatcttttataggttaatctaaaagtgttgagcacacaatttaaaatttttcttaggatcatgtgtcagaggcgttatatgtatgattgtattttctaccgattaaaatcttactttaccatatattatatacatattaatgccgcatgaacaaaagtgtagtttgatagaaatgtatggatggccgtcctctcgtagagttgcaacgttcatatttatggtaaggtgcctaatcaaaacgttaaaaataaacaaagaaagccataagtggcaatgatatcggtaaggcaaatatacgatgaaggctacacaaccctacctacgtaaaaccgttttagaccattgaattgagtggatgttccctcgtttatatacgctcaattagttatgaatttttttaaaaaaataacaacattcatacatcatatatatagcacttcataaaattccagatccaaactcaactcacacattgagatataaatcatacctagattttttttattgtttttcagtgtgtagatcgaatttgaagttaatttttagtagagtgctaaatatcaatatgctctatattgtcaagtttttataattatttgtaattgaatttaaaaggaaaaggaatcagaatacaatccctacttgtagtctgtagacgacgatgattatacgccatttaacaccagcatatatagctggagtgacgctcgctagctatacacagatggacgtgaggctggggtttggggagactatgaccgggaaggagactaattagtacgtagtgacaacaaccacctagctagtactagtaattaggagtagtaatcagctagcttacaagtgtagctggagtgacgcgcgcctagctagcatgctgccgcaggccggcacaatgcttatctcttgtgagttgtgacttgcttaattagagccaactcttaccctgctgtgaaaagaaaagaaagggtaacgttggacgagaggactcacatgtaatgtaagcaacaaatacacttgcttcgtcttgctcttgcgtgtttggcattgtgcgaattcatatctatctatctagcttggaatttacataggcggggtagatatgtgttgcaaatttggttatttagttgtatataatttttttttcatttcactgaaaatgtcagctatatgtgacacttttatatcttgtattcttgtgcatgactctgctagctagtgtagtgtttattttggacgacctgtgtcaagctgttgacattattgaaagtgcatatgcatgccatcttagtatacctcacggtagttcttgttttttttaataatgaaatagatatatcccggcctttactcaacagagttacagccaattattacaatatgtcactcaacaaagagtgtagttcaaataaaattaaacacacccaagcataatagaaagtgaccacactaggataagaagaacacaattatttaagtctatttgttaatctccatccatagttggcaaaaagttgcataaccgtcgtttcaagcttacaacatacaactttcagaaactctccatcattatcacatccgtgcagctgtgcccaaggccaaagtcaataagttgccctgaaaattacttgtatatataagatatatggtgaattgtcaaaaaccaaatcatttctactcaaccacagagcccatcatattgtagatgctcctacgagaattacgcggtagttcttgtgcatagttggttcaattcgggacgatgaaatgaatcttgtatgtttttttttcttgaaaacgtaactagctagttatatatctatggcatatacataaactaatctagccttaataagctccatgctcgtactcgatcgagcgagctaatagagagcccggtctgcagccatgagctcgccggacgtcgtcgccggcggtggcaggcagcggtcaaagggatggatcgacggccggggcgcgagtggactcatgtagcgcatgtacattttggcatcacatcgatcggctggtagctagctgcagcttggtgtacacgtgtgatgagtagtacgccattacagcagcatagctggagtgacgctactcagctgtacccaccggcgctgcgccgcgctatataacaccggtacccccctccgtgcacatccatccatcaggtcttccacatacattttgctgtctcgccaccggagacaggtagtatagctatggccggtcaggtgttcgtccatcacctcggcggcggctccggcggcgacgaccccacccacccatggctgtccctcaagtcgtcccatgagatggacgacgccgtggcgagctggcgcgagaagctggcggacatggccgccgccgacgaacgcgccggcaggtacccgtgcccgctgtgcgaccgccacttccccacggagaaggccgtgcacgggcacatgcgcagccacccggggcgcggctggcgcggcatggagccgccccgcgagccgtcccccggcgacctcgccctcgccgccgacgggaagcggtaccgctacgtgtgcgaccgatgcaaggcgccgttcgagacgcggcaggcgctgggtgggcaccgtgccagccacagcaccaagaagggctgctcctggcacgccaagcagctcgccatggccaagccgcccaagaacgacttcgacctcaaccatctctcacttgaggccatccaggcggcggcgcaagaggaacaagctgctcaagaggggaacaaggatgaggagcctaagaattaattaattaggaataattgaacttgcttagggttcgttcggtcggtcgatcgatcgacttcttgtgcttgcgttgcgtcggtctgggcttgtgttggttcgtagctagccaactccatggctcatgcagcatatgcacatatgtctctttctcttctttttcttttttagtttttgtttctctttgattttttgtaagctcgatcgatcgacaagaaaaataaacaaatattgcaacctggatgatatatgtgcatatatgttcatcatttgtgggtgatttgggggaatgtgtgtttcccacattttatatgaatgtctacacaatttgaggtatatcgattggacctgtttgacaagaacagttcaagctatatatgtcctgcgttttcagtccggcctgttttacaagaacagttcaactatattggtgcaaagatcgatcgatcgtatcaaacaaaaaattgctactctaggtgatgcacttctcatttaccatctcaaaaatttatgcctcctacattgtttttcaccctgaatggtccctgactccatgccactagaagaactaacatcatcacggccgttcaaccgatgaacaaacgttccggatttgtggttgtacccacggttttgtagaaaccatcctggttttcagtttcacctttgagaaaataatttacttttttaatatattttttcgtcttagcgtgagtcaatagagcattgcacaggtgtgctgtacattgtcgtccctagcacttcccagtgtttgttcttggtggtcgaccggcatgactcaacttttgaactcgatgtcaagagaaatagagtttactacgagtcttagtttatcttttgacttttgggtagagaatcgacatgaattttcttgttaaactatgcgtacacaccttccccattcaagcaacaaaaatcttcaccattcttgtgagactgtttttgcccttaaactagctaagtctttcatgtacttagaccttaattttacaatagttatttatcttctttgaataaaaaactatcatttactcatgcctgtaaatggctacttggaaaaaaaatctagttagctacatgtgtagtatatgcttttttatatagacatgaacgaaaataccatgtaaaatgctattaattagtaagttatagttgtcagtcactaacaaaggcaactgataccgcctaataccctaacgtacgtgtggcgcttatgagggcgcgaaagatcacgtgcatgcatgcatgcacattcggctagccttcgtaacgtccatgtgcataggcgcgctcagcctatattaattaattcttgttggtatggagaaaggtggacttaactttctttttgccaatgaaattttccacccaataaatttctattcatactacaaatttttccatgttacttcctactggcatagtgtctaccagtagaaaatagtagaaaactctgctcgaagctgttaatagtacaaactttatatggagaattttatgcggcggcaaaaaaaaaaaaaccttctatacttcaaaacttgttataggagcaaatatttctgttttgctcagaaactttccagtccggattaattctttttttatacaaaatatggaattttgagttacaagctactatattctagtgtgctacaactatcacgaattttcgtgactgatccaatgaggaatggaagtgtagtaaattaaaccaaaatcattttagatattcatattcacgcatctgcaattgtggtattctgttgggttagaacctcaaaatgccaaggaacaagtggtataccatcaaaataatattgattggattaatttatactatactaattggggaagcatcaatgatgtggtggaataatatgtcccgatacctataaatattacatatatacaattaagtgaactttcagtatgaatttaataagattataaatgtgccgttggttttttttagcatataagtttgtcatataatttaaacaaaatatactaccggtcactactaataatatcatgcatttatgcataatggacgttagcatgggagttactccagtatatggtttttggagaggctctttcgaaacccacagctttctacaaaaccacactggttttcagtttccctttgcaaggaaaatagaatttttgtttttcgtatcttgcagtgacgacacaattacagagtcaaagagtcctactagcgctgggaccggagtcaaccttcctcctgcgatatacatcagcgaagaacagcccagaatttaataccatcatgattcttcttcttttctttgttagagaattgatattcttttctgaaactacaccataacgctaggtggatgtatgagatatttgttgagatttactagcaaggaagcatgcatgatgccacagttatgtatagtataatatgaaaactatcgtgggataaagaaatggacatctgagatttgtctacatcattatgagtaaaatttttactcgcaaattaatcatgagtaaaagttttactcaggataacgtgcataaatatcatacgtttattttagctatgtacctacccactgagaaggcagggtaggtacgtgcttcaaatttgtttatttagctatttttatttttcactaaaaagacaatctatatatgacatgtgatgcagactctactggtgtaatgtagtgttaatttggaatgatacgcgttcagccgttgacattggaagcgaatgcatgtcatcctctagctagcactccatatctcagcagtttctcatatattctgctcatgttgtctctactagctaattaactgactaagaccagtatctgaagattgaaaacgatgattttctttttccttcgaaatgatatgaatcactcatatataagaatccttttggaaaaaaaacgtaacaatatactccagtataagccacacatacagttcattgcgcttgcttgcttcttgcaatctaatcgaggcgatcgaatgatatgaatatatatatagcgcatatataggttttctttttgaaaagaaaaggtaacataataactaccttagctagctagcatggcatgtatcaataatctagcctttaattaattaaactccagtgaatgacaagctgagcaagcgagtacgagatatctcatgagctcgccggccgatatcgagtgatcgacgtcgtcgtcgccggcgctggccgcggccagacatggccggctctagctaggggactcatgtaaggcattatgcttatatacggtagctagctagagcgaacaatacagggtaggtgtacacgtacgacgacgactatacgtacgccggccattaattaacaccggccagcatatagctggagtgacgctagctagtttttttttaagtaaatttcaaaaaactacaaatgcttcaattaaattatcccaaaactatatatttaactaaagtgatgtattacaaaactatagattttaacaataaatttatttcaaaattatatgtttaatgctaagtatcgtaaaactacatatttaacaataagattatcacaaaactatatatcttggggtttaaattcttagtactaacacctactatgtttgagttataaatgtccaaattttgttattaaattgacgctaaacatgtatatgtacgtagtttcatgataagtttgttactaaatctgttgtttaatttgcgatacttcaccttaaatataaaatttagtgataagtttggtgttaaatctgtagttttttttatacatcatcttaaatatatatatatagttttgtgataatattctaattaagtaaagtatacacagtttcataaaatttactcttttatttacagacgctagctacacagatagatgtgaggctggggagccggccggtgactgggaaggggatcgactaattagtacgtactgacaacaaccacctgctaattaggccctgtttgattcagtttagaattattataatctgaattattaagagtaagctgaaataaacaagtagattattatgatagattattataatttataagccagattattataatctaataatctcctctggaggagctttttttagattattgggtggctaaagacccattacccttagataccttcaataatccagataaacaaacagctcgcagtttattctatgttagcttattataatccagcttaaaataatctgatttaataatctagattataataattttaagctgaaacaaacaggaccttactctagtaaccagcttatgttgctggagtgacgcctagcatgcttgctgccgtaagtatatatctcttgtgacttgcttagagccaacaaggccgttgattagagatgtagcaaaagcaatattcctttgaccacctacctgtaatggcccttcctccttacgcatatgcatcttctcaagcttctatccaagtgtcacatactcggccctttgttaattcagcctgatgacccccttccatttttcttaattgattcgaccgggtgctgaataacattttattccttgacgtgatcagcttaattattttggttaattaattctcaaaacttacaccttgggttaattattagttcttgattgtaaattttacgatcaaggtagcatttaattgattacgtaccaacttttcatgacttgtaaacaattgtgtacatcgttatgaactagcactgaaatatatacatttacctttttcttataaaaacaatcaaattttgaaccaataaacttctatggaaccgtcaaagtattcgccttattaattttctatacataccccccctcccctcccacacacgtatctcccgcaccccccaagccccacacacatgtacgcgtgtgcacggacgccacacagcaccgcgtgtgtcctctttcacactaaaaatgttaggcacacaacgtaaaatttttcatagattaatctaaaatattggacatataatttaatgtttcttttattcatgtgccgtaggcattgtatgtacatcgtattttctttcgattaaagccttattctactttattttatattaatgccgcatgaacaaaagtgtagtttgatggaaatatatggataaccgtcctctcagggagttgcaacgttcatatttatggtgcttaacgaaaacgtcctggggtctttcgactagctccataaggtggtgggctagacgacctgggtttaaagcatcaccccttctaattatttgatattaggtcctttctaatattcgccttttttaagttgatttttgatagagtgctaagctagatgtcactatactctataatattatagaaaagttgatttttggtcgacttcgatctcaacgatcactggtggagaaacactttgttgtcccagttggtaaccctttatagtcccggttcaaataaccgggactaaaatcgatttttagtcccggttggtgactaaaaatatggtcccggttgttgttaccaaccgggactaaaaagttttggtttttttttcttttcctttcatcccgttggtcttttcccttttttattgttttttagctttcgctcgtggatcgaatgaataaaatcaacaacaaagcctaaatcaatcatagatcgaatgaataaaatcaaacaacaaagcatccatattgtttacacttgttcagatctacaacatctcatcacagagagcattcatcacagagaacaaagaaaggaaaaagaaagttcgcatctacaacatcttcagcattcatcagatagcacaaagaagagaaaaaaaaaattctcctgtcgccgccttccgatcggcgtcggctgccgccatcccgaccggcgccggccgccgccatcccgaccggcgccggccgccgcctcccgcccggcgccggccgctgccctctcgaccggcgccagccgccccatcttgtcgccccgcgcccaacacagccggccgccgccgcccccgacgcagcccgccgccgcctccatctcgccgccccgcgtcgggtcgccggcggcggcctccatcccgtcgccccgcccggggccgccgcggccggcctccatcccgccgccccgccggaggggaagggaggggaggagggggaggagagaggggaggaggagatagggtgagagaagaaggaagagaaggatgggaggagaggagagaagaagataagatggagatggctgaatgggagaggaggagataaggatggaattaataggagactttgcatgcgcgtgtggatagaggttttgtttttcctaactttagttccggttggtaacaccaaccggaagtaaagatcaccgctgacaacatacgaaccgggactaaagatgatctttagtccaaagatcaaatatgcccactgtagctaccaaccaggactaaagatttttagtcatctttagtcccagtttttagtggaaccgggactattgtggattttggtcgaccgaccaaagatggtttctccactagtggatctgtcactgaagatccaggcaacacaggagtgaagaagctgttgctgctgaagaggggaagaaagatgatgagacgaagaattagagagagagatcaacaagtgaagtgttttagggttcgttcggtcggttgatcgtcttgctggtgtccatgtgcgttgtgtgttggtttgtactccctccgtatcctaatatgatattttatttgcactatttgaccacttgtcttattaaaaaaaattgtgcaaatataaaaaatgagaagttgtgcttaaaatactttggataataaagcaagtcaaaaaaaataataattctaaatttttttgaataagacgaatagccaaacagtgcaagtaaaatattaaaattccttatattacgggacggagggagtagctagctagcttcctactccatggctccatgcatgcagcgcgcctatgtgcacatgcccttttctctttcttctttttattagtttttgtttctctttgacacttttggtcctgtcgggactttgtaagctcgatcgattgacaagaaaaataaacaaacattacaacctagatcatatgtatgcatgtttgggctccgcaatttaaattcttctctcctgagtttcttatctgtttccatatctctctctctatatatatgttcttaatttgtgtgtagctagtgttggggaatgtgtgtttcccacattatttatgaatgtctaattttttaggcatattgaacctgtttgacaataacagttcaagctatgtccagcttaattttttcagttatattttataacagcagttcaagtatatcggttgccctaaaaaaggtatattggtgcaaagatcgatcgtatcaaaatggaactatatgtgattttctaaatctccactttataatttaccatctcaaaaattttcaacctcctacattgttattcacctgaatattggtccctgcttcccgaagaactagcttcatcatggccgttcaacgggtaaacatacgttcaggatttgtcatttgtggttgtacccatagtttttatagaaaccatgtggctttcagtttctaatttgagaaaatattttttcatcgtaccgtgaataaatagagcattaatgcacacgtgagcggtatattaccgaccctgttagagcttgtatcagatatgtgtataaaattggtgacggtttagagaattgtaattataatatgtgcagaatagaattagagtcgaactttactctaggctcttttttaaataaagagacacgtataaccatatgacgacagtagtatagatatgggtacgattagccggtggttagctgtagatcgagggtcatactacctggatacacagtaagttgttgttgttgttgaggaggggaagaaagatcaagaggcgaagaattaattagctagagatcaataagctagcttagggttcttttggggtgtgtttagttcacaccaaaattgaaagtttggttaaaattggaatgatgtgacggaaaagttggaagtttgtgctataagaaagttttaatgtgatgaaaaagttggaagtttgaagaaaaaacttggaactaaactcggccttggtcgattgacgtgttggtgtccgtgcacatctcaaaggcttcatttttaggtttttttttctaacgtttgaccatccgtcttatttgaaaattttatacaaaagtaaaaaaaatagtcacgtataaaatactattcatattttatcatctaataataataaaaacactaatcatagaaaatttttaaataaaacgaagagtcaaacgttatatcaaaaactgaaaaatgaagctgtgggacggcatctctctctgtgcgtgtgtgttatttctctttggcttttagtctgaacttcatttaagtttcttagctcgatcgatcgacaagacaaatgatataattaaatatttataaactgctaagctcatatatatacatgtttgtgttaattccttgatttcaactcttctcttctcctgattttcatatatgttgcctatctatatatgttcttaattaatttgtgggtacctagacttggggaatgtgtatttcccacattttgtatatatatgactgcacgcagtcaaaaaaaataataatttgaagcatatgggcctgtttttataacagtacgttcaatgcatgtttccctaattaatcctcagtgttcactacttcgtgcataaatcgtccccatatatatgaggctaacaattcatagatttcatctagaaagtacagctccagagagctattgcaagagcatcaaaattttgatcgagtagagcaaacggcacgcgacgaaattaaacaaagtaccctagctagaaaaacatcgagagggaagggcgcgaggatcttgcgagagaggaggctggagccgaggtggagaagcgtatgtctccctctccaccgtcggtgcgcgcgtcgcggcgattccgatccggccgggagaggagacggaagggaagtccctcccggtggtcggacatcagaggagaggatggcaacgacggtgagatagagctgggccggcctgtgcgagtaaggaggttttctacttgtagttgggctgatgtgttgttagttgggcttctttttttcagtaacctcacaaagggtctgtttgggagagctttagattctgagaagcagctgtttggtagccagcttctgataatctggaaaatctctgaaacccagcttctggcttcttagttcattttttagaatctgtaactacagattctcagaagctgtggactgtttggggcagcttctaacagaagcagcttttggaaaaagctgcagctgggacaagctcccccaaatagggccaaagtcactgtcaatgtactgcgaaactagtactaataatttaacctgaataagatactagtaaattaattttgcttggtttcctattaaaacaccaacaacgacttctcttatacatttaccatagcatagtatagagacttaattacaacaaaaattgcagtaatgccaacaaacaattaatctttgtaatttctcacttacatgttagttgttgtacgtgtgtgtgtgaacatgacagattagctatctactattgatccaaaactagtggagtatataaaagaataattactgttgcggtttctgacagttggttcgtattaactcgatcttcttcttctcatgaacacttgcgagctagctggatgagagaattggccttcctctgcgctctgctggtgccgttcttggcaatgtcggccagatggtcatggagatcgaagccgagggcgtgcgccatgagggcgttgttgctggagcccagctcgagaagaaccgagaccgcgcactccttgttcttgggagtcccttccttgatgatctgcaccagcttctccacgaaatgctccgtcccaacctcgccccggcacgtagggttggaggccagcaggaggaagatggagagcgcctcgtcgaccatggcggccttcttgtcgtcgagcagcttgagcagcgtgggcaggatgccggcctcgatggctctcagcttgttgccattgttgagcatgaggttgaagatggccgtggaggcgtccttcttgcctctgacggtgccgttctgcaggaggtccaccagcggaggtatgcctcccagggtcccaatggcgaccttgttctcgtccaccatggacaggctgaagagcgccgccgcggagttctcctgcccctccacgctgccgttcctgagcacgtcgatgatcaaggggatggccccgcccctggcgatgaggagcttgttggcctcgtcgatggagaggttgagcagcgaggtgacggtgttctcctgcatcttcttgtcggggtaagggaggaggccgatgagcgccgggatgccggcgttgtcggtgacgagcagcctgttctcggggttctccttggacagcgtccggatcttcttgacggccttgcgctgcacgtcgaggttgggcgaggagaggtccttgaccagcgtggggatgaccaccttggggtcctcgggtggctccggcggcgggtcgccggagtggatctccaccttgttcttgtcgcaccattgcatgatgaggttcttgagggcgtagttgggcgccagggagagatggcccagcggctgctgcgtcttggggcacgtcctctgccctgcgtccagccatttctggatgctgcggcgttcataggtctgcattatttgaatccatcagataattgatatccatggatggatcgaggaagaagatgatgatgatgaatagaatacttgcccttccggtggcgatgatgacgggatcggtcatgatctcgagggagatggggcagaggaagtcgttggggatcatgagggaggggcacttctcgaggtacttggggatgaagacgtcgccgaggatgttcttctcgtcgacgccggcgatggccttgaggcggtggaggaggtcgacaatctggttggtggagtcggactggtggtcgttgatgagcttcttgatggccatggtctcggcgcggaggtcggcgaggctctggagctggaggcgcttggcgaggcggtccaggatggggcggtcggcgttgttggcgtcctgctccttgctctgcaggatcatcatcaggtccatggccagctccatgtcctgcgtctccgtccgcttcttgctccgcttcttcagctgcgcgctgatcagctccacctgctccttcacctcgtccgacacccccagctccgcgtacggcatcccctccagcgccatgttcatcttctcgtacacccccctgaacctccccatcaccgcctcgctctccagcgtcaggtagatcttgctcccgtcgtggcagcaccggaggagccgccgcgccgcctggaacgcccgccccagcagggccagccgccggtacgcgtcgtccgacagcgccggcgccgactcccggagctcctggaccagcgggaggaggagctgcagccaccgcagcaggttgaagcactccttccgctgcgactgccggaactcgtggaacgcgcgcgctgcgttcgccgtcgacaggagctcctcaagcaggtcgccgtcggacagctgccgccccgacggctccgcctccgccaccgccgcgcccatccgcagcatatccttcgatcttcgacccttgcctgtacgtgcttgatggatcgtcgttggagatgagattcatttcattgtccctgccaccatgcaatacttctgcatgcaacaaactaacttaattgccggcttcacctcaattccaggatcatctacctctatttagcatttcactacatgcatatgcacttcaacctcatactacatgttggtattctttgagtttgtgcctttgtggtgatctcaattttttttcttttactaaaaaaaattttattttcgtccttttcagcactagcccaatatgctacctcttttcaacccaacccacaagtgaagctgtaggtccagttggcacatcctactaccgtcttcaacctttgttggtagttttgtgcccatgagatgccggagttgatcctcccaaatccggctgaatttttctcgatcttccaaaattgataaaggacttttgatcactaatctactctttccattttcccaaaatcggagcgaatcaagctcaccgattgggcatcatcggcggctgttaaatagagattaaattcagcgaattaaagccgaattgaaataataaatcatggataaaatgatgatggaggagtggggaatagatatttatgcaatcaattggaggaggaaatgtacgggcgaattgaaataatacatcatgggtaaaataatgatggaggagtggggaatagatttttacaatcaattggaggaggaaatgtacggggaggtagattgtagtggcaacgatgctaggatttggcccgatagcggctgcggcgtgcggatcataccggaggaaattgaaaaaaaccagacttaccacatgcgcgcataaaaaaccgttctaccaaaaaaagaaaacggcgaaaaaaacggaatggaccagacggactttggtccgatggcggctgaggtgtacgaattggactagaggagattgaaaaatatggacttaatgcatgagggtaggaaaaaaccgttcggtctaaaaaaaatggcaaaaaaaacagatggactaaaaacaaaatcagaagccttacttttttttttaattattaggtatagacttacctagtgcgcgcaggaaaaaaccgttcagcctgaaaaaaaggcaaaaaatcatatggaccaaaatcaaaatggaatctggccttacttattttttaattagatatagacttatcgcgtgcacgcagaaaaaaaaatcaatcggcctagaaaaaaaaggcgaaaaaattgttcggcctagaaaacaaaggcgaaaaaccagatagacacaaacaaaatcgaaagccttacttatgttttaattaggtatacagatatagttgtacttgtatacatatctctctttttggtacagcacgatactactgacacactaacgattgcaggcaaaaatgttgttctggtgtcccagtaaaattaccaaacagtaagtatagcctgaacttttactgtgaccgtgatgcttctctacctaggaaaacaaataaaaatggtggagacataacggtaaggactggactgaacaggaggaccatgtggacccaaaaagcaacaagaaaccaacggcattattaagccgtcactaggaaaaggacggcatgtagcatgtccctcaaacattcattcattcgtttttcccaatcccacgatatctatactccttaaaaaaaaagtaaaaaatatattttcttcattcaaatataagtggcagcataatatagatgtgatatatctaaaactatgaatttgaataacagtctattcagatttatagtcgtagaatatgtcatatttgtagtatgttgcatttatattggaacggagatagtagtaatttatcccacaatatttatattcctttaaaaaacagtgatggttacagtaaatatgttatcctacctactctcattttaaattttgcaaataaacccctaaactttaaatcaaatccaaatggctagccccataaaaaattagagcaagacgaatattcctatacatattaataaattttcttttatccatagcaaagaagggcatttagctagtgatcatgatttctcagtcattttcctttgatttacttcaagctatgaaactatactgcatacagtatgtgttaagtgttaacgataatttaatttgcctcatcttttatatttcactcattctctccatgacgcatgggcccgattctccttttcgtatagacaatatttgagggatttccaaattttagtggcagaaatcgatccaaaatacatctgccttgtgcctacacgtgcatgagtgtctatcagtctaattgtttggcctacgtacagctaatgtaaaatgttttatcggtaaaaaaaattatgggtaaaacttgtgtacacgtcaacaaagtcaatgttgaaatatatagtatgataaaaagaaactctaaaattaactccaaaatcaaaattttaaaacttaaattttagcagcgccttataagcaaaaggcacacgatgggaggctatattttcaccccattgccacacaaagcaagtattagtttccatgaaaataaatggcaagtattacttttcaaatattttatttcctgatatgatttatcccattaaacttggccacctcatattgaacaaaatgaaaaaaaaaatcaagctatgatttaaaccatttgggccaacctggtgtatacttaaaaaataattaaaaagcttccttctatgatttaggtcattaagtcagccacctcatattgaacaaaatcaaaaaaaaaaatccagctatggtttaaaccatttgggccacctagcatatattaaaagtaattaattacagaattccttctatagtgtaggtcattaagagtcagccacctcatattaaacaaaatgaaaaaaaaagaatcttgcagttaatggtgtagcccactaaatcacacattaaacaaaaatgaaaaggatatacacaaacaggccgacgccaaccaccgttgtttttgccgattccgctagcaatcttcctagtcgtcgaccaagatcctttcatcaactccatctacttattcatccaagtaaattgcaccaccatcacattggttggtgttgaaataccctagggagatagctatgccaaccacaaccctatgtgttgttgccggtttcgctagatccaacagtcttcttagtcgttgaccatggtcctcccatcgctccctcaaaataccatagccaccattgagaggtggccatgccaatcgccattgttgtttgctgattccactggatctagcggctttcctagtcatcgaccacccctacatatgccaccgccacatc

SEQ ID NO: 64995 - DNA, 1896 bp, Oryza sativa
tcgatgtaatatatcagaaaatataagaaaacacaataatacaacatattagatttttccacatggtatcagagccttagagaccaacgtcgttcgatccccgcgtcgccctggggagatgagatcaatcttataatctccctggggcgccgcatctattagctccacaaattatccatagattagattttaccaatattagaattagatcaatttatttttttgccacatcgaaccctacgatctccaggagccaacacaacgatgatttcgtcgcaagccgtcgctcaatagcatcatcaagcagaaggcgaggccgtggcgtacagcaccaccgtccaagtcgccgtgaagcccgagcgacgggaacaccagacgtcatcaagccatctactgttgcatccatctactcaattgagagaagcacatggtgcacaggtgacaggagaatcaagcgtcaagacaccaagcaatccgcatcgatcatcttcgccaagctcctatgaacggccgcgacgcaagccacaactgcttcctcctctacatcagccatacatttgtcttctccgacacaacatcgccgatggtcttcatcaacataggaacaagcgcgccgccgccgactcgtccacatagatggacacctcgcgtcctctgacagattaatctgcaagacgcttcatcgacgacatcgaccgcgtcctctacgacggcaacgaccgcgtcaccgacgacggcatcgatcacgtcatctacaacgacaacgactgtatcaactcggcatcattattgtgatgaccgcttcacggcgcagaaggaccaaccgaagtggtggcctcatcgccaacgacgtcctctgacatatgcaagacgtccccaatggcatcctctcatcctctgacatctacaagatgcaagatgctaacaattgcagtttttgtcttcacaccatggcgtgaattttttttttttcgccttcggctatttgcggctacatcaactaccatgactaccatgaccacgactactatatgattggctacatcgacgaacgtctacaacaagaatcatctacgacaactccagtcaaagcgtccgtgtcatcgctatcgtccatgacactcccgctatgactgcgggagggaatagaggatagtcaagggacgacacagaaggggacgcagccaccaggtggaggaccgaccatcagagatgcaatcgatgatgatgactcagagagatgaagaaatagaagatttcaaatccagtcgcaatcgttcgcttcgctcccgttacgactgagggggaatgttagaagtataatatgttaattagagataagagtcaaatacaaattatagagataagatatattctagagatagaatcctagagataagatagagtcctagagatagaatcctagagataaatctactcttacttgtattgtactccaagtctctatcccctatgtactcctatatatacctcatgagagggtcgatgtaatatatcagaaaatataagaaaacacaataatacaacatattagatttttccacaccgaggccggcggcggcctgagtaggctacgctgatcctccatcccgcgagctaagcagggtggcgccgccgttgtctgtccatctgctgcggctatggcgagcggcggcaactgcggcaggacgccaggccggtgacgggcgttgcgggggcggtgatggcgcgcggcgcggcccacgacggcgactacggcgagcggtctccccccctctctctctgtctctctgtggcgccggcggccaacggcagaggtcttcccccacctctctctcctcttcccccctctctctctctctctctgtggtggcgagcacggcaccccggcgttgg

SEQ ID NO: 64996 - DNA, 540 bp, Oryza sativa
ttcccaatcttcttaatcccctatccctcaaactcacccttagggctcctttggcagcccaggatcccactgggatcccagcccattccctgggagaaaggcccacgggggaaattgtcacgggttttattccatgtccatttggaagcccacgaggcagggatttcccggcccaatccgcggggaaaccctagggaaaggaccccgaccttcggaggtcgggaatttttcctctctcaatccgccgctgcttctcgctcgcgcaacaggagtcccttctctctcgtgcgaacaacagcgggcgccgccgcgccttcttcttcggcgagacccgccaccgtcgggactcctcctccggcgagaagggtaagcccttctcctcattcctctcctctcctcctgctagggtttccgttctcctcctcctctagggtttccgcctcctctagttagctcccaatctcgctctccggccttagcgcttgcatcacaggcaccgacacgtgggcgcggcgggtggcaccacggcagccggggtaa

SEQ ID NO: 64997 - DNA, 672 bp, Oryza sativa
atgaaaatggccttggcctccaaatatctaccatggtgagcatcgccaagacccttgcatagcgtggcttggtctcaggcatgcccatgacgaggggttcttgttggactccctggtgagcatcctaagctgcggtcaaggtcagcaaattgcttgggtgttggcttcctagatgttggcacgatcattggcctagctagaggccaaggaaagaaaggatcaagaggaaggaaaaggaagaatatgacaagtagagcaaggggcatatttaaccttgcatattgtttctctcttagttagtcggaaatggatattttaatggacataatgtccaatagcaaataaccatttcttgagagtgtccttcccaaagattgatttcttagcaaaatttgccttttatatttggagtcgtgcaaaatattttgtgcgtatagatgttccccgtgtacccatctccctccgtcgctgcaatgtgtaggatcaagatgtcaactagagggagggtgaataggcgatttaaaactaaataacacctaatcaaaactaacctaagttgctaggctcggcgagggacaagtctaactaagcaactaagttatattttgcaatcctagggtgatatgggctcaaatatgtatctacgaatgtaaattgcacaaatctaaatgt

SEQ ID NO: 64998 - DNA, 723 bp, Oryza sativa
cccttgcttttttctgaaaacaatgtagtctattcatctttgtcttgggaagtattaaaaagttaataacaatatattttttttgtctatcacttcttcttttgcaaagagaagtacaactgattggttttttataagctattctagttaacatcacgtagtgtttggaatgttttaagaccttaccaaccaaaagtatccacaaataaaaataacatgtactccctccgtcccataatataagggatttcgggatggggcgcacactggtgcgtgtgtgtttttccacatgaaccactagtttctgggttcttccccttgcttccgaaaccgtcacaccaaacaccattattttatatggaacacattaaattccttcctagaaaagggaacccaaaactgaataaatacgccaacggagctagccatggggagcataagtttcatttgccatgtgagtgcccgtgagtttttccctttctacaattcatcttccatagaaactgtggtggatggatctcaagaggagagatgaaggagctgaagaaagctttgtcaaaccactgcaacttaaggtgaaggattaccctttacttggagtccatatctcggaatgccagatctatgacctagagaaccacatgatctgttaccaggtgagcaatctctttagcttctatggttcactatggatctgtttggtggtttttattccattcaata

SEQ ID NO: 64999 - DNA, 2365 bp, Oryza sativa
tttaacccccaaaacgcccccccccccctgtgtacgcgcctgattccaaggcttctgaagacaagtgggtttaaacagagctttgaagatatcgacaggttagttcatgccaattgaggccgtttttttaaagtttttaaatgttaatgtttttaagatatgggttgataaaataatctgattgtgtatctgaatatacatatattttgttgcagcttcaagtgaatacctcgcctggtggaacgcgtgtcggggcagtctcctactcgtctgaagcacgcagattgttcaacgtcaacgattttacgtctacagttgatgtagttaaggccatcgaggcgaatgtcaattacacaagtaaatctaagcgacgttcagacaagaggcgacaaactgcctcaaaaacccgctaccgggcaagaatggcaagagcgggcgcgattctagcagaatattggggctggggtggggaagctgaatggggggtgggggggggggggagggggacttttgacttcttgcattaaggttttgaattcaagggcgatgtgagctggtctagcagcactttcacttgttcagctatatgtcttcgcctacaaactggctcaggcgcgatcccggttcgaaactgagtcaagttattcggacggtgacgttaaaggtcggtccccttacgtaaaagatcacatctgattgataatacacacatacacaattctatatgtgcatcgcttaaattcattaatatggtttgtttttgttaggagagtagggggggttcagcctacaatgcagggtgaaaatgacacgtagctgtgtctaataatcctcctatactataaccttcctctattatctctgtgttatactatgaacaagtattaaattgatatatcatgtcataaaccgccaatctggaaactgtacatctaatttgtcaaaactgcgggctaatattcgcaattgaccactatacgtcaccaataacgcttaatagcggaaatatcgctagggcaattattgttctaaaacataaggattgcctggaacaggatatgtgctataaaacaaacacacaagaaattctttgatcatcaatattcttgcattaaatagataccatttaaaataggggatgcggtttacttttactcaaattctgtgtcagggcttaatatggacactgtatactatacaagctaaactccgggcaaagattttacccatgcccccaaagcagtgactatttgtgcattatttcatttattcattttcattttttgctgtggcagttctttgaagcggttgactgcctcttgtctgaatgcatctaaagacaataatagtggttgtattgtataaccaaggaccatttagacagctacttccaatatccgtggaagtccaataaccatttcagattaaccgtaaagaagataccggaaaacacttaaactcagaaggatgggggggggggtcggttcgttaaacaattatcctttttgatgttcgccattaaaaaatatattggcgattattgtgcattgttgattagtcaagtaaatattgtcgctttaaaaaatacctcgattggattggattgtataatcaaatgtgtctcgaaacattttaaacaccatcctcgcaaagatatgtaatagaatagaatactggatgtctaaagaagttaaatataatttttcttagggatatttaatgcattcctttataaacttcagaggcatgctgcaaaggactgatcggagaagaggttttttcgatatttatatcagaagtatctttgcgagacttttgagagttggaaatcgtcagtagacctgcgctaaaatgtatactcgatacccgatcctactttcaatatgcctctcgaatataatttacaaataaacatgaccacaaaatatcaattatttctttttgcttacaaatagagacaaaaacaatctattaatgacttcaaaatcaaactgattcaatattgacataaaaaatgaattattaattgaaaaaagaaaaaaagaaagaataaaatatgaattaatgaatctttggctttcttgtgacagataaaggaacaaatttgcccgctgctctcgagacaatcggggtaatgattaccgaaacagcggatgaatctgggtacagcagcaggaaacgcattctatttatcataacagacggtaagctcagcttattagtgtttgttaaggtaaaaattattcattacttttcatacattcgttgtttgtgtaaaaacaccatagtgggcataggcttaggaaccggaggcttgggtgaagagggggagcccccttgtattttctggtgggagggggggggg

SEQ ID NO: 65000 - DNA, 6973 bp, Oryza sativa
caggcacaaaaccttacccatgggtgtgctatcgggcataattctcacccatcgggtggaccgggtccaatagcgttctatagtcacccgaacccattaacccgtaggttaaaaacaaccgcatggcctagcccatgagtgtaattggcccaaggcccaacaaggaaaaaaaacccctagctatataagttgtccacccaagcaacactaagctccatttctctccctcctctaaagccgcacacagtgggaatggggatagcggcggcgggggcgggccggcggctcgcgtcacagaggccgtgaggtgcaccagcctcacgaacgctgcctcctcctcacgagccccgctgccatcgctgccacgcgagacgctgttcgcgagctctgggcctcttgtgccgctgcggcctcctcccgtgagcgccgctgttgctggatccatgcgtatccgtgaccgccgccgccgccgccgcagctcttgcgacctgcgtctccttgctgctcaccgagaccattgctgtagcatgcaggcagcaacacgtgcatctccactcactcgccatcatcatctcgcccactggcctacctatttctgttgtgcttctcctgtttgtgatgttaattgatttgtttcatccaagtttgatatggcggttgggttcaattgtcaaagccaagtagctaacaatagcttatactgtgatctggaatggtttgctaatactgtggttgtatttatgtcaattgaggtgtgatgtgctctcttaaccgtgccactttttatgtattatcatctgacatgttgattttgcaatgtggccatatggttttcctggatctgattgttgcacaatgtttaactactgtaatgggtatgggtacccgtttacccatcacttgcgtgggtatgggtatggggaaatttctcacccgacagcaggtgtgggtaatgaaatgggcaagttcactctccatgggtgtgggtacgggggaagagaacccgatgggtacacacctgttgccatctctagtcgccaccgtggacgcggtcgccgacaaagtgcttcgcattcgccgtcgccgctcgccctcccaggcgcgcccgccgtgctccccagcggatgagagaagagagagagagagggggggtgaggtaggatgacaagtgggcccaaagtttttaaatatttttttaaatggattgccacctggcgccacgtgtgtgccacgtaggagcaaaaccactccgggttgagctgggggggagggggggtaatttgtccggtttcaatagtttagggtatcaaatgtccgtttttgaggttggggggtaattcgtactgtcgcgattgttcaggggggtaattcgtactttttctaaagtaatatgaaccattgatcttatttgatcgaagggttcagatctatctatgctaccaccctagttagtagtagaaacgtaatgtgtggatgggtataatcatcatttagcagtggctaaaccttttctttagctttttcgatggaatatgaacgatgccaacacaatggatgaccacatatcgatctaactaggaaaaaatataaatgacaaagttactcataatcaatgtattggtaaattactgatttacccttaatactactggtagtattatacaaccaatagagagcaccagggtatcgctcatgttcaattaattatatgggttccaactaaacgttgaatggtacatattctggcaaatactgaatctaccgggtccattgaagtcaattagaagatctctcccatcttgaattataagtcaaattagttacaaggtttacatgttgtagatgaaggtttggtgttattctcacttctaaacgtactagtaatcatgccgggggcccgggggggggggggggggaggtgcccattgaggataaagtattggatctgctggttactcatgcaaagcgtatgaacgtgttgtgcgtgatgaaaggaggacaactccacgtttatagtaaagatgaacaatcgaaagccaattttgcgagctggacaaaatatgtgaagggttggtgtggtgatggtgcttagaaagcatgtgtttgccgacaactaaactgatcaacgcccgaaagacagtgctctccttacacctctacgaccttcgctcacttcggctgatcagtgattagccaattgtggacaaaacccaacaataagcaatagtgcacagacctgtcccgaaattatacacgaatagtgaggactcaggacactccacaaaaggtgaaactaacaagactgtctaccaataaccaaccatgttccatttaataatttcttttttttttttgtaacatgttccgtcttattgactaacagagcataatgttactcctccccgtcgccagtggccaacgccattgccgcaccaacaaccgaggtccaatgcctacgcctacgaaccacaggtggtccagctgccagcaagcgcgcgcatgccgcgttctggttgccgcaccgccacgccacggccaccggtggacgccgccgcgcggttttattacctctaggcttctttgtactatcactgattcactgtacagcgtgtgtatgtgcgaaacgtggtggctagctattggccgtcgtcgcgcttgtggaggatcttgccggcgaacacggccgtctcgatgacccccctgatgacggacgccgtctggccgacgttgcacttgttccccgggaacgtcgccccgctcacccggtcgatgcagctcagcaggttctcgttgcacatcgtgttcaggtagtcgtctgcaaaaacaacaggaaaagccagtgagtgaatgagtgagccggagacgcacatgatgtgacgaactgacgatggacgatcgatgtgccatgggccatgacaagtgtacaccaaattcaccacatgcacacttggggggccttcggcgccgcgaggtcaagcttagtgcgcgtgcacgacgtcggcggcgcggctcatctcatggtcatgggtcgagcaatatgtggctagctttgcagcggcggcgactcgtgcaaaactgcaaaccgtgcgctttgcaataacccaatcgctggtatactaacaccgctggtttttgagacatgatttgattcgttaggtggcgcgtcgtctcgccagcatctggcatgaggttgaggcctcagagtcaagggagaccttttgtcccccctgctgcagtgctgctggtggaggcgtccgggcgaagcaaatatctagtatctcttctcgatcggaaggaagttcagagttcggagagtgaagagagagacagagagatgataccgttgtgggtgtcgacgcagtggtcgtgcaccatgcagcaggcgtcgagcgcgtcgcatggcctctcgccggggcacccgctgtagaggatcccgcagtacttgccgtacctcagcagaggtgcaactttcagaggtcgtcggttgcatcacggacacccagcaaaaaaaggcaaaatgcgtgtcagctccctttgccggacggccggaacaccaactcaagaatgcatatcatgttcagtcaaattaacggtgacacggaaggattcaaagacaagaagtctgcatctaatgccttggctagcatcatatgctctgcttgttttttttttttttcatttcagaagcagggggaagagaagccccagaactgcaaagatttctctgctctgtaggcagtatcagcctgtcagattattagtaagaggagtggcgtactacgtacttgtgcaaaactgggattcgcacgtccggctacatccctggtccttctgcgccgaaaacaaacaaagccaaaggcgaaaatcaatcaactgatcaataacaagtaactgcaaaaaatcagacttggtcagctagctccacgctggttctcaccgccggcgtgctgccaagcaggtcgccgatgttaagcccccgcgacgccgtcaccagcaagaggagaagcagcacggaacaccgaggagcgagcttgaggaagaacctcatctcgctcgcctcgcccgtcgtgtttctctttgcgcgttcaagcaagagcgcgtgttggatgggccgagaaagaaacgggtggagaggtgatgatctgcttccggaacaggcaccagctgagctgattatttatactagcagctgcgatgagtgatgaaaagtacataaattttctgaagagatattatagtatttgtgttggtgagagctgcgaacttgaggtgaagaagcttcggatgtgcctgtcctaccaagatatgaagacaacaacaccctgatcagatcaccgagccgtttcctatcccttcgttgtggtggttggctgatcgtagttgcacttgatactagtatcttaaagcaaaaggagcagtatcatttctacaaatgaaaagtgaacactgcaggggcaaacgcttgttttttcttaaaaaaatgtaaccgtgtaatatcccaattaaatgagactaatcctgattagtacactaaaatactaggatagcaaagttggttgcagtgataggtacactccaatctcactgagccaatattattattgaaggcatatgacaatgccattacttgcaaatgcagttcaagagttgccgtcagcccgtcacaggagaacaccagacaagtggctgcagttcttttgtaacttctgacctatacgtctatttggcatgcaaatgttaatatgatcagagttcaggatctctatcctttttgccatctcaacttctcaaggcacaccaaacaacatatagaaaaatgagacatatttcagtgtttgaccacatccatatggaaagcccagcctgcaccagccttggttacttaaatgctacaagaagcggtatcaaactgtggctgtttgggcgtctctctgaagaaatgacccggtaaccgcagagcccacccaaccgctgcacatttcaaattgtttgggcctagagtacaggctcctctagaacgaatggaacgtttcacccagccacccaatatcaatactagttgaaagcaagtttacgagcatagttcaggtggagaccggagatgcttcgacccaactcacagtttcgtgtaaatcccatctcatgtttcgttcgatctctatctaccagctagagttaaactagtactatatatgtattagtacactcatgttagagtgattatatgttcttgtgctgttgactataatctgatacacgtgtgggaatataggttgtgtttagttcagcgtaaagtttagattttggttgaaattggagatgatgtgactgaaaagttgtgtgtgtataacaggttgatgtgatggcaacagaaggagctttcagctacctctcttttagccaagatcaaggaagaggccaaaacttaggctttagcaggagcgagaagttttaatagctggtttttttttaagttagctcggaccaaaggtcttagcttctttctttttttcctttcgctttctaaagttctccttctctattcaatgaaattggcgctcattgattcgttcaaaaaaaaggttgatgtgatggaaaaagattgaagtttggatccaaattttggatctaaacacagccatgtatgcagggagttgagaaaacagagagctaatgttgtgtgatgactgatgaattgaagtctttggatcagttaagacggaattgattttgcgggtttgccccagcaaggctgtgtttagttcctgaaaaaagttaaaagtttagaaaaaaagttaaaagtttatgtgtgtaggaaaggtttggatgtgatgtgatggaaagttagaagttaggggtagctgggggtgaactaaacacggcccaaattgagggacacgtacgtagcccccagttctactccgatctagctactaggccgtctgggaaagtgacggcacgagtgcacgaccacacgaggccgtgctccacaaacaaaccgaggaagctccgaagctaggcatctcagtctgcactccacatgccaaaaactggagaaatgcaatgaagctgggcatgtacaacttggcgtctgcacagtccaaaaactgtggtgcaggttgcagtgaagccagtggcacagtgcagtctttggtttcagaaatcagaaacagagcaaaaacgaccgggaggaacgcatcatgacactgttccgctacatttattcttcccttccacgaactgtgctttcttcgagatagatataatagtatctcctcacaattttatgtatgcttcatcacttcacatttcctttttcttcagacaacggtacaccggctcacctgtccggctcccactccctatttactcccaaagtaaacactaattgacaaactccatatgcaaaatctggcgaggaagcggcaaatagtgtatatggggtgtgtttggttacagggcacactttactttttttttttaagactcccaaagtaataacaaattgacaaaccccgtatgcaaaatctggcgagaaagcagcaaatagtgcatatggggtgtgtttagttacaggtcacaccttacattttttttagagaaggtattttttacctgacctctatatccaaccggatatatgtagtctttttaaattataaacttagcctatcaatcatggaacttagccctcaaataactcaatctaaaatttgctcctatagagatttgaactcaatcttagggtgctactcaagtcactgtcagcactaggctacatgcacttacacggccgcactttaccattactaaggctaggtaagttgtggtacccataaagtgtggtggataaattgctagccacaagctcacaaagtgtggcaaagttgttgacaataaagttaagtctatgatgaataataaaattaagtctatgatgaatgggacatgttattgaaaaaagtgtggcaat

SEQ ID NO: 65001 - DNA, 3903 bp, Oryza sativa
caataattaataaatagaagagaagagaagatttggcttcaatcggcctgcgaccgagacccccccctaatcctcaacaaatattcgttagcctataatattacattcaagatattgctcttgaaatacatcatctaaattggacgagagatagttaaaaactttgaactaaatttcggcgccccatgactgctgtacgtgtgtagtcccgtgtacccgaatatgtgtgcattatgtattcactgttttgactctcagcaagataagttgaattacattcattttaattctaaagttacaatgcacatctttttaaccattccttatccttccctatcatcttgttattaatatcgccattgtcatttgccctccatttaatctagaacttttccgaaggttaggtgtttaaggaatacaattaagttcgtaattataaaagccgaaaatgaaataggttcaacatagtatttttcagtacagaaaaattgtaatttgaaaataatgtagtttctatttccttttcgctatcatgaatcttctgaaaaaatgggagggggcaagaatttcttgtaataatgttattatgtattgtaatgtttatacttatcaagataacaaatgaatatgtacatacattttgttatactacctgtaataatatatataaaacattgtttatcttacttttggaaatgaaataaatacgaattgaatcggattgaataattattaattctaattcaccaaattcacggctgttgttatctttcaggtttcagtaacgtcggtggtgccccatcgaaaagcgctcaaccactaaaggaagatgcggccctcaagatacactgcataggaattagcaggaacacggacaagacagcacttgccgaaatcgcctctccgcctgtcagcgaacatgtattttatctctcggattataatgagctggaacgcgccgtggaagccattacctctacaaacagatgtgagtaatgcaaaaaaaaacatttggtccttcaatttccatgaagaaaaaaaaaggtactaacaacacacaaagaatttatttaaaaaaaaaaaaaaaatttggtcaataattgaagtagccttgatataaccttttgaaatcatcactataatgtactatgttagccaaacgtggtttctaaaattgccctgtgttgatttcttggaagtctttatgatcttttctgcgtgaagattaatgggtatgcctatgtaaaacaagaagcagaagaaggtcttgtgttttcaaagtgccttccaagtttttaaaaataagctgacttatattttaagtgtcatattgccttttaatttacctattctattcacagttctacctctcacttaacttgatgagtagcattgacaaaactttgttatgcttttattatcaggtatacacgtcgttgttgtcgttgttgttttactatgtttctgtttttatttgtaatttgttctctttaactgagtaggcctatagattcggattcggattctatcacctcgcgactccatgggcatgcttttctagacagaaactttagaggcccctttaaaaaaaaatcgggtccattgaccccctccccttcccagccccaggacttacatctgcccaaaactctcaacaaaataaacatttaaatttcgcatgtggtgaattcctggaaaataaaaaaaagggaaaataaacaaaccttaaatctatttttattgttttcttcaggtattttcttattcaattattcattcgtttatttattcatttgtttattcatgtcatttgtttacttattcgtttattatatgtttatttattctttcatacggtcattcattcattaatttatttatttattcagtcattcatttatccgcccattcatttattcattcattcatttcttataacttttaattttttcgattgtttttgtttggggaggggggttaaaatcaaggacatgtgcgattaaaacctgtacgcgtacctgtggtcatgtggatgttttgcattaactgtaaagtaacctattattgaaagtaaaaaccggtagttttggttataagaggactttcatgtacttggcggtcaaaattataataggaataacattaggaaagatagaagaaaagaataggttaaagaatattaaaaagaaagaataacacaagggaagcgacagaaaggatacaagaatcaaaataaagaaatacatagggaattatccaagaaaacatgaacggagggagaaaaagagctgtaggcccactgaaacagtcacagaagaaagaaaaaggataacaacacaatatgagctttgagtgtgttgcatcgcttttagtgatgggcctaggtgtaagctatagtaacacctaaaaatctcaaattttcaacaaaataaattaatagatacagtatataagtagcaccaaactgtgccaaagtaggggaaaattaacacacatgttaatggaagtaggaatttattccttgaaatgctagagcgccgtatggcagccgtgctaaagccagggtaataatcgggagcgccaggagggtcaaatctgactgacatgagcgctatacaagaacccactattattattattattattaagtgatttaaatcaccgattaaaacaaaaaatcgggtaatttaaatctcgccaatcacgattcattcatttctcgaattattcataaagtggtttccttatttcttagcttacgaggaatgtggaaagtcaaaacatccgtcggggacgtctcgcattgttggtggtagtgaatcccattcgggggattggccgtggcaggcagccctttacgatgaagactcaaatcaagtaagaatgcctatgtctcatatgagaccatttgacaaacatttccaacgatagcactaaatattaataacaataacaatatttataaagcgtaacataaatgcttaaggggcatacaaataattaaagtttatatcaagaattcgacatacgatgaaagaaatattaactgttaacatcattacatgtaagttcatcatggcatcttaataatacaattataattatttgttattttaatattaaaggtaaaatattcaaattgaccagaattcggtctaggactatggtctagggtggatcttaggttataaacaaaacgtatactccgcatgtgaggttttttctgtatgaatcaggacggaaggagaggggtgggggaggggggataggctcgagactataattattcttgaaaagtgtgcagtccctcctccaccgtgtaaaatcaagatcgatgtttgtactataccgagtgataatagagatgacataaataattgattgattgattgatttttattcgacaagcttttgtgcgggggctctctcattcacaagaactggattttgaccgcagcacactgtttcattaaagaccgtactcccgtactgagccagaatggaacaactgtttatcttggtaggtctattgttttgcaatgtactgtattgtatttacttaccacctataggggtggttgactgggggtggttaaccgggggtggatgtccagggagtaggtgtccagatacgcagtgatacacaccaaggaattctgttcattaacacatatgatagttaatacacaatattataccgggaatggatagagacaaatatttttaatgtataacagatctaaagttaaacaagatgttagatgaatgcaactgtgtctccaatatgcccccgcctatgatttctctaattaacgattctgtaaactttaacatctcacctcatacaccaaaactctttctatgctcatacataattgagcccaagttggttgaatttaattc

SEQ ID NO: 65002 - DNA, 13084 bp, Oryza sativa
tgtttatattgaaatatgagcacacgctaaaagttttgcgtatttctcagtaaatgtgctaagtgcatgttgatagcaagcaaataagtaatggaatttgcaatgaacagctaaatgtctaggtgaaatccaatgatgacaaattgacgagaacatgcctcaatgcgttggctcctttgatcatgcagattgtacggctagcattattatatcttctctcatataataataatattatatatatatataatatatatatatatatatatatatatatatatatatgagtaaattgcacccacggtgcattaacttggtaggtaggtgtaatttgatgcaagaacttgagaaatgagcgttctagtacaacaacttggcaggtaagtgcaatttaggacaagaactttataagcaatcgcataaatgcaataacttgcaagatatgtacgattttgatacaataagttaagaagttatgcaaaaacttaattatctggagcacttttttaatacatatttaattttcaagtacttattttgacaatatactagcgtggatttgtatataagcatatttatatttttatcctaataactaataactgaaaatcaattaaactgtatgtagaaattattatatttcggttgagatttggaaatgtgaagaaaacaaaaattcttaaagataattggatgtaaattggatgtgcagtataaatcttaaagattaaattcaatattgtaaagtaatatccgtaggactgctatataatagcatattgatatcgcgaaaaagaactcacctagcatatgcttagctaatttgtcaagttcttacacaagaacgcacccacttgttaagttgttacacttgaacgttcaattttcaagttattgcactatatcacacccacccgccaagttgttataccgtggatgcaatttactatatatatatatatatatatatatatatatatatatatatatatatatatatatatatatatattaatttacctatataggatacctatatgggactccatggtgcccgggcttcaaggtataaaacacacaaattctctcaaatttttaaaaattttcaaattgtgagtatatacctagctatatgaatttgattcatacaaaaacctaacaacaaaacaactcaaactaaactttatttcacaattcattattaaatacctaacgaattatatgtttggatgttatatacctagaaccaaaatctaacaaaaaaaaaagttcaaactcggttcaaacttgtttgaactaacgtagtaaagaagttaaagttcatatctaaacatttaaaaaaattcatactcattcaaattaagtatatactcaatttgaatcttggagcccatactccatgtagcaccagttaatttacctatatatatatataatttattattaaaatatattaaaatgacaatataattttaaattttatatgaactttatcaaactaaccaatgggtaatattcatattgtactgcaaattgtatgtacgtgatagtattaattattttttaataccgaattttagttatttctaaattgtattcctctaaggactctagatttctctaccagtattctttatttttaattttgaatttccagtatttacaaaatttatgcctatatggattctaaactttctttcaatattttttatttttaaattctgaatttcacttttttaaaaaatatacttctatatggaccatagacttttcttccaatatttattatttttttaattccaaatttccgttatttgtaatagtatttcgactctagaatattcttcttctaatatttcttatttttaattctaaatttttattatttataattatatttcgatatggactctaaactcacctttcatcattccttatttttttaattctaaattctgttatttgtaaattgtacttctatatggactctaaacttacctatcaatacttttaaaaaaaaattaatttcagttatttttacactgtattcctatatgctctctggactcttcttccaatatttttttttcaaaatttagttatttgtaaattatatttctatattgactctaaattctaattttaatcttattatttttcattccgaatttaatttaattgtaaattcctttatggacactaggctcttcttcaatatttattttttttaattcctaatttctattatttctaaattttatttctatattgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtaacaaatatgaatcatagcaatccttaaaataaatagaggacttatttaccttaacaccaacagcagcaacaacagcagcggaaccaacggtctaacacccaacaccacaggcgacggctgggaaccaggacgaaaccctaatcttcacttcactttatcttctcttcagggcggaggaactatatatatatatatatttatatagagcaagggtgagtactttcgtactcagcaagtcacgggaacttaggtggttaatgcaagcttggaagagaggcaaggttgttttgcaaatcttttgtttgaaatcattttgaaaccactaagtgatttatttctttctaagtttgggccgaaaagagacttgcgtctcgattcgactttaagagatgtttttcaacagctcatttggtaatgtatcgacctcccgggtcagatcattacttctcggctcccagagccattccacttgattaatcggctcccagagccttttcattttctcggactcccagagtccagctgcccagcagcacaacaatctgcttccactcgggaagcctaatctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctattcgaatagttagttaacctctgcagaggggggtacactttacccacacgacacgaacttactccagacactggccggtgtcagaggttcgcgacaaagcctttcccaagccgacccagggatacctcatgccacatagaaggatcaaatcctcacataaacataggccattttaggcgttcacaattcaaactccaaccacctcgatcggtaattcagcaagcttctcattcttgtattaccaggaacccggtttggctccaactgtcacgcccaaaaattcacgaaccagaatttctaagctgaatgtgcattaaacccctgtccaggaccagccagggtacacaaacgataattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttgaaagcagtaaaacagttgtagtatttaatccatattaaccaatcactgtccaacgttacaccacgttgcaacaggcccaaaccaccacatgaactaaccagttccaaaagctaactagggtgaaactaatcacggtgaatctggttgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcagtatttaatagaaatgcgggatatttgtaaattgggtacaatatgatcaattgtattgcatgacttgccttgctctcgcactgatgagaccacagcaacgtcttcgagaatccgcgaatcgacgaaacggccgaactctacgcgacaaacaaagcacacaagcaaaacatgctataagactactgaaacatgaagcaaaaccatttttaatggattctatacatttttatgaatttactgagacttgaatggatttaatcggagctcggatgaattagttatgatttttagaagattctctgtgtttttactataaaagaaaaactcttaatcaatttattgcgcaatattgccccagggctgacgtcagcacaaggaggggtggcgccgacacgcgggacccgcgggtcagtgactcaaggagagagaggggcggctggcaagcgggcccactgggcagtgtcacaaggggggggggaaaaaggcggcctggctcggctcggcttcaagccggccggccggttatggcgagggcggcggcgcgcgcgcacggttgccagcgacggcaaccggcgacgggaggcggcggcggacggcgcaaagacggcggcggcggccgaagcggcggcgcgagcgaccctagcggcggcgctacgcggcgggcggcgcggcaaagggagagagaggaagagagggagaccgatcctcaccgaggggctcggccggcgcgagggaggagcgacggcgaacggcaacgatgagagacgggaggacgacggcgacgggctccgggaggacctagagagaaggttgggaggggttagagagagggaggcggtccatggcgcacgacataaccgatcgaaggcggcggcaatggtggaagctcaccggagtgcgaggagatgcgagctccggcgatggaattggacgggagaacagcggacgaggtggacctcgggatggcggacgcggcggtgccgatggcggggtgcggcggcgaccctagcggctgctagaggcggccggagcggtggagatggcggcggcgggtgggtgcacggtgctagggcgatagggagctcgggagcggacggcgaaagagggaaaaaggtggagagaggcgcggtggtcggttatatagaggtgggggggggccggacgtggccgggaacggcgcaatttcgccggagtagtggaggaggtggaggaggagagagagagagaggcgggattcaaatttgaatcccggccatctcgcgggcgcggggtgagcgggagtggggcgtgggcgcggggagggcgaggtgcgcgggggaagtgggcgacgtggcccggggcgcggagtggggcgcggaaggcgggggaggcgggcggcgatgggtggtggtttcggcggcggttggcgcgggcgtgggcggccggaggttagggaaagggctgacaggtgggccccacctgtcagcgcccgagagggagaaggaggccgggtgaacttcgggagtaggagggaggagcgggccggcgcgggaggaaatgggccgggcccaagaaaaagaaaaaaggagggaaaagaaaagataaaaggaaaaaggattttcccagggatttaatattgcactttgcttattttaattggttaaaattatttccaaggctctgaaaattccactaaaaatcctgttagcatattttgacatgtagaatccaagagaaattctacatgtcgattccgattattatttgcatttattaattagggattcatctctaggttaaattaaacaatttcttcgaacgatttattttatgaatttagagcaagggaggggaacttcagggcgtgacaaacctaccccccttaaacggaatctcgaccccgagattcggaagagctggcgaagaggtgcggatgagcggccttcaattcatcttctctttcccaggtggcctcttcctcggagtggtggctccactggactttgcaaaacctgatcaccttgtttctggtccttctctcactggtctcaaggatacgaactggcttctccacgtaggtcaaatcttcttggatgtcaatgtgctctgagctagcttgttcctcaggtaccctcaaacacttcttcagttgagacacatgaaacacatcgtggataccaaccatattagatggaagctctagctggtatgcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttatcagcataactcttctgccgagactgggcgattcgcagtctttccctgacggtcctgactttctcctctgcttcggttaacacttctgtcccaaacagttggcgctcacctgtttgatcccagaaaagtggggtgcggcactttcgtccgtacaatgcttcaaacggtgccatttgcaaactggactgatagctgttgttgtaagagaattccgcatacggtagacttttatcccaggctccaccaaagtcaagtgcacaagctctcaacatatcttccaagatttgatttactcgctcggtctgaccatctgtttgcggatgataagccgtgctgaaattcaaacgagtccccaattcttcttgcagtttctgccagaactttgaagtgaattgacttcctcgatcagatacaatcttcttaggtaccccatgcaaacacatgattcttgaaaggtaaagctctgccaaccttttcccggtataggtagtgtgtactggaatgaaatgagcaactttggtgagtcgatccacgaccacccagattgaatcgtgccccaacgatgtcctgggcaaacctgttatgaaatccattccgatttcttcccatttccattccgggatttgaaggggttggagtaagcctgctggcctttgatgctctgccttcactcactggcaaacatcgcagagtgcgacgaattcggctatttcctttctcatgctgacccaccagaatttctctttgaggtcctggtacattttagtactaccgggatgaattgaataatgagtttgatgagcttctgtgagtatgagatccttcagttctttgtcgtcaggcacacacaatctttctcccaaccagattgtgccatgttcatcctcatggaaatctcgggcttttccaaccctcatattcttttttagctcagctatttcaggatcatttacctgagctgctctgacttgatccacgagcgtaggccgtgcctctagggcagctacgaacccgtgttccacgatgcccaaatttaggtgctcaagatcttgctgcaatttgtcacacatgtcttcaatacatactgcattgcaatagctctttctgcttagagcgtctgctaccacatttgctttgcctggatgatagtgtatccccatgtcataatctttaatcaactctagccatcttcgttgccggagattcaagtcgggctgggtgaagatgtacttcaggctcttatgatcagtgtaaacttcacagcggttgaaaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgggatgcatcacagtagacttggaaatcttttgtctgatctggcagaactagaactggtgcagagactaacctcttcttgagttcttcaaaactttggttgcactcagctgaccatttgaatttttcatctttctttagcaactgtgtcatgggcctggcaatcttagagaaattttcgatgaaccgacggtaataacccgcaagtccaagaaaactccggatttgagaaactgtctttggtggggtccactttgtaactgattccacatttgatggatccactgccatgccttgagcagaaatgacgtgacccagaaatttgacctccgataaccagaagtcacacttgctaaacttggcatatagctggtgctccttcaatttctcgagtaccagacggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatccacgcacatcctcttagtcttgtctttcttctccacaaagatcaccggagcaccccaaggtgaagtactcggtcggatgtaccctttctgcagctgttcgtcaacttgctttttgacttctgctagctcgttagctgccattctgtacggcctcttgtagattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgatgctggggaatggaaggtgatcttctcccctttgtcgttggttagggtgatggtgcggcttgcgcagtcaatcactcccttgtttctggtcaaccaatccattccgagaacgacatctaggtctttagattcgagaaggatgaggttggatagaaacggtgatcttttgatctctatagtcaccgaggggcaataatgtgctgccctcatgtcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttgccagcaaagtggccgtgcttgccacagttgaagcatggtcctggctttcctacagcccccttcttgggttgttctgactgagctgacacagctggcggatctgactgagctggtgccattagtgggggtggagtcgagttgtggttgtgctgcttactgttgttgtgactgccaccgttgtaatcgttgttgaagttactcgggtgatagggacggtgctgacagacgatcagggtgggaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcatcgagcccaaaaaaaaacttctcctgcttctcagcatcggtgcgcacgtcctcaggagcgtagcgcgcgaggcggttgaactcgtgcagatactctgtaaccgttctggttccttgttgcaatgcacggaactctctcttctgttgtgccataatcccttcaggaatctgtaccttcctaaagttttgacaaaactctgcccaagtaaccttcgttgcatctggacgggtcaccacgtagttatcccaccaggcagaagcgggaccttgcaactggtgtgtagcaaaagcaactttctcttggtcgttgcattgtagtaggttcagcttcttctcaatagcacggagccagtcgttggcctccattgggttggtggtgcttgagaaagtgggtggctgaatacgaagaaagtctaacagtttggacacgtgtgatggtggaggaccaaactgctggttctgatgcgcctgctgcaacatctgatggtaatgttgctgcatctgttgcatcatcattgtcatcatctgagtgactgttgggttctcgggcggcggagatgaactgctgccaggtgcaccactggtatgagcttcatctgtctgctcttcgctgccactggcgtcgttggagtcacggggatcattccttgtcttcaccatctggacgaggataggtagaaataagagaaaggaagaaaacagatggctcagaaactaatctttcttataaacttaagtgcaattatcttaatcttgattaaaacactgaaaaagaggcacgcaactcctaattaaggctgtcataccactcacacatgatatcgaccgccgactaacccacaagcaacaaacctaaacatggaaactagcaagcaaacaaaactaagaagacgataaagctaagggcggcgactctgaagctcggagcggcgcttgcgatcgaagaacaggtctgacttctaaggtagacaagggataggaatcaatgcatgctcaaatccaaatttaaacaaagcaacaaatggcccaaacaactagccaagcatgatgatttttacgcatggaacatttttcatgaacccagacaaaagacactaatgcaactgactaaacaatgacttaatgtatgaaataaatgcatgataatcatgatgcgcataaaaactgcatcccatcgaatctagacacaacttaatgcataccacctaacaattctcgactgactgccaaataaattccaaataaagttttgctaaaaccctggactgtccctagccaagagatccgattaaataggcgaccaagattttctcccaaaatcaaaagatcaaaccccaaagtttcccgaaacaaatccaagtgaaaaaggcatgtgcatatgaaaaggggttcagagggctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatagaaaagattacaaatgcagcggaaaaagataaaagcgagctaagcctgaaggcttgacttctgcagcgggcgactccattccacaggcatccttgacggcagcgacgaaaccaacctcttcgagacatcttcaactgagaaggacttcaattctggtgagggggaaaagagcaagactgagtactacccacggtactcagcaagtcataccggaagaggaggtatgatgcaagatatatccaagggaggctaaaggttcttttgcataaagccggcatttcaaagcagtagttgaaagcagtaaaacagttgtagtatttaatccatattaaccaatcactgtccaacgttacaccacgttgcaacaggcccaaaccaccacctgaactaaccagttccaaaagctaactagggtgaaactaatcacggtgaatctggttgaccgcccataaccgcgggcacggctattcgaatagttttactctgatcagaggtgtacaactgtacccacaagacacagccccacgacacgttcccgtgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaaatgccatgggtgcgactagcaagaccatgcacccacagcccaccatgacgtgtattttaattaaccaacaccattacggtggcactaaatcaaagctatgccaataatcaagtctatgctttaatgtgatccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcagtatttaatagaaatgcgggatatttgtaaattgggtacaatatgatcaattgtattgcatgacttgccttgctctcgcac

SEQ ID NO: 65003 - DNA, 1753 bp, Oryza sativa
ccccccccccccccactgagcaaaatatcggccggcacgattttcaattttccgggggcaaaaaaggaaaaaaaatagtactcactaccccccccccccccttaatgagcgaattatcggcctgcacgattttcaaatttcagcacactaaatttcaaattgatttcaaatttgggcctaccccctaagaaatcctggatccgcgcttgcataggcctacttgaaccaagtttggttacaatttgcctcaatgtcttttacgttatcgccgtaaacaaaacgttgaattttgacctcgttacattttaacctttaacatttcaattcgtttttgtttcttcttattacacttaagccaggttattccttcaatggttttcaagttagtgcagaaattaaattcattctggtatttctaaacactttcatggccctgtaaccttatgacctgtagccacgaaatacatgaaacctgatgaattcattctaatatgcgcatgtatatagttcatccaagtttggtttgaattgcttttaatgtttcttaaagtaaacgcggtaacgagatattttctgatgtttttaacacttttattgaacctgtaatctttgacctcttacaccaaagtatattcagttcttcgttccaatggataattctttatcatttagccattatttgtttgttggcatgtacattatgggagaaatgtaatcttaatgttaatatctacaaaatgtattaacgatttcatgtaaataaaacccaaatatcttaacttcctagcttggtatgaacatctcttaattggaaccgatatattatattttgatcgcccaatccgtctgtccgtttgtccggacgtccatcccgccttttggtatcgcggaccggctccggacagacacggccgcgttcggcaccaccctcggtggcggatgcattatgaaaagttgtaatacgttgaacgtttaatggtattaagagatgttgcaatacgaattatatgatatatttatgaccaaaaaaaacagtaatttatctatctaaagaaatgtagtatgtacatacaaagctaggaagtcaagatatttgggttttatttaccggtacatgacatcttaaatacatgatatggatattaacaagagatgtagattacatgccaacaaacaagtaatggccgaattataaagaattaacaaaatatattcgatgtcacaatttaaaagggaggtaaaacgatagcaatggtaaatcattgcatttattcatattagatggttcttacagatacacagttgcgattgggtcaatcctcgtaacgtgagcttcctggctctcaaaatttcgtctcgtttggttgattgccgttttctttcgattcaacttccgctcggcccctcccccaccccctccccctccccccccctctctctctctcttcctttctcttcctctctttctctcccttaattttcatcttttaatgccattttttctttcaccagtacattcctaagaatacaaaacattgcctgaaaacaaaaaatgttgcatgatcgaagacataacagtttctcatatacattttcttatatcgtcatccgatccacttacgatgttaattctcgtcttttgatttatatatttaggactgacacacagagtgaatgataagaatagggcccaggtgttcgatgtgaaggaagtgattacgcacccggactacttcaaggaccccgtcgacgg

SEQ ID NO: 65004 - DNA, 1121 bp, Oryza sativa
tacattgatgtgccacataagctacagtacatcaggaatgagaggagtgcatcaaaatactttagaccatgatggatatttcgaaagtgcaaatgaggggtggccggtctgtaaaaacagttttctcctaaaagatcgacattggtcaagcgaccttaatctaaaaaataatttcaaaggtacttcagaatggtcaaagctcagttctgcgatagacattgtcatagacatttggatgcatgtgtcatggaagtgcttatactattaatatgaacatgtattttggtttttttttaaaaaaaaaaaactggcacatgattgtcaattttgcctaaccatagcaaaataggtgtgtgaagtttaaacatagcgaactatgactttatcaacccactcaaatcatgctccttatgaaaagttctagatgagaaaaattttaggtttgggagtgtctagattgaaatttttagtcgtttttctacccacttggatgtcaatccaatggttctcatcactcccactatcattctttcttaggtatatataaatatattgtttgtaggaaactaggaatcatggcatggatcaatgaggaggcactttctaagccaagtgatcaagtcaaggtgcaaacttatcacgaagggtatgtattctagctcttcttcctccgaacatacaagcataacttaaaatggaatcttattgaggagtacttttatatttactgaacttgggttgtagtctttcagaactcattcgaagtgtttttgcggcctgcaatcctaatcggccaataacacatacgctttctggccaaactcctctacccttactctcataaataggtaaccataatcctttaacgttcacattaaaaccccaaatttatgatattgatctagcgtcctttccatgttctcttgcatatttctttcattgtcttgtaggagctaaccttcatatgaggtcaatgtaccaaggaaaggttgataacaatcaaaatcgaaaggatggagtaacgattgcgtgagtgctagtcctcagaattaattggccagaccatcaaacattgttcctcattgattggtagtaattaattgtctagacattgtggaatg

SEQ ID NO: 65005 - DNA, 510 bp, Oryza sativa
tatatatatatatatatatatatatatatatatatatatatatatatatatatatatatatatatatatatatatatatatatatatatatatatatatatatatatatatatatatatatatatatatatatatatattctattaatcctagtggacttaggaacaggaaagagaaaaagatatggagaaggtactgtgaaaaacgaaggagaaagagaaagaccagctagggcagcaggaaaatgcccccctgatagagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattaatatttggaaatgtttaatagttcaaaaatatatacaaaaccagcacaatataggaagtaaagttgaagatatgataacctacttagaaacat

SEQ ID NO: 65006 - DNA, 1088 bp, Oryza sativa
tagggtttgtctttttttgaaacagagggagtacatgactagggtactaggcatgttatatttgaaaacaaactatgtacttggtttctattttttttcttcttttacctctctctatccctgcacctggccttcatctgagcatatgtataacttatggttaagtgaacatgtatatgcttatgtggcattctaattacgtagaggagtagaattacgtagaggagtagacgttagtaagatcagccatgcatggtttgttgttttagccttcgtttacacaaactacgaatgttcctacatggaaattggcatcttataagtttaggttataaaaaaaatactctttttttaaaattgacaatattgcacccacttcacaggttcgtataccactaatataatatattctttttttaaaaaaaacctgtatcaaagtttgcacaaatcttaaagtaccatctgggcaaacttgtactcctgcttcatatcataagttgtttagttttttcctagtcaaatttctttaggttttcccaagtttctagaataatatagtagtatttttaatataaaacaaacatattatcgaaaatatttaatttcaattttaatgaaactaacttagtgttgtgcattttgctaatttttttttgtcaaacctaaataattttaaataggaaaaaaaatcaaacgacttataatatgaaacggagggagcaccttgtatagcagtctataggccatccagactatcttgacatatgtccgtagcccagctctctcctcgcttatctctgatccttctcctacctgctgcccccaggtaatgtgtctgcacattctttgtgtgtgtacatgaagtttgagaggcgttttgctcaagaccgcgcaacgattccatatgacaccgcatcgttgtccatgcctatcatgttcatccagagcccctgttgatcttcagataagagaaaagctcaaaattaaagaaggcttgtttattgatcatgtcaaggataggtatcgacggcgatgcgctggctatggccatggttgtgcggttcttgcgcaataacgttttgatctcg

SEQ ID NO: 65007 - DNA, 1189 bp, Oryza sativa
ttattagggtgtccaaactaggagatgataataattgttttttggttaaaggtggttgtgccttatattttggaatggagggagtactgagttattattatattttaaaaccgacggacgctgtaaaggcatgcacgcagcagctcttccagactcctgaccctccgctatgaaagggggcaacaaccaaaatcttaaatatcttgatgtggtcattgacgacaaagacagtacaggtgaaagggcatctaaccacgtaaaatagtattggtttgacaggaattgtgtgctggaagggcttcagtgttggtttctgctaaatttgtgtggtctctctttatttttctaccgcaacaaatccaaaatgcccaaaatgtgttggaagctgagtggcttggttgtacctatagctagtacttaaaacgtccatatatatgccggcccacagtttggaagtatttgatgtatatatctgatcatgttcaatcgtgtgtttattgtgtatgagagtgggtgtagcttcttaaacgtacccaaaacctaaatgttcacatgcatgatataatctaccatctccgtttcagtttataagactttctagtattgtccacattcatatagatgttaatgaatctagacacacatatattactagattcattaacatatatatggatatgggcaatgctagaaagtcttataatataaaacggatgaagtaattttttgcaactcctgtccaacttgactcttgtttgtcaacgaatgcatgtcctgataaaaaccaatgccaagttttttctttttttgaaaaaaataagcaaacaaatgatcggtagcttgctaattcgtcgatgcacatcttatgaattagatacacacgcatgtaaaagtaactataattagcttatcctgctgcaaactaaacaaaggattaaatttcggttcactatcgtagctctcatcacctcgccgaccgcacaacttgcattgcttacttacgttcagcctctcagctgtatgtttaactaatagcgtttagtcactaactgctcacaatttttagcaaaaccacccccgccatatatattgcatcctagctgtaacatatagccaaagaattgttccctcggttctaaaatatgcttcctctattttataatatatgacgtcattaattttttgataa

SEQ ID NO: 65008 - DNA, 14411 bp, Oryza sativa
aggaggaggaggaggaggcttagggttgcagccccccccccaaaaaaaaaacaaaaacaaaacaaaacaaaacaaaacaaaacaaaaacgttgttcttggactaaaataagggtttagagggaaaaaataagaagggggaggaagatgagaaaatgaaagagagagagagaaacttatttcgaatcttatcggctggaatcttttcgctctgtcgttacggttcctccactgatgtaagcctacttcaagagtattgtagaagagtttgtaaaacaaagttaattacccctgggtaattaattaccaaggaagaaagccaattttgtctttacaagagccatacagtgcgtatcaaaaaaaagtgccgaagctgtgacatcatacaaatctattttttggaatttctcacttttttcttcattttccgaaagagcatcataaataatgtccaaattttgaaagccaattgaatatgttcagtattggctgagatatgaccatccgaataaaaaaaatcctataggagctcagtgttattttgctctggttcataacattacgaaccagagcaaaataacaaattaaaaaaaaaagaagagaaattctcaaaatagatttttaatgacatcacacttcaccactcttatctttaaacagtgacgtcgagtcatgtttcatggtaaagagtaacattacaaataccctgtctgatcatacagtgcactatacaggggcggatctagctttttgccaggggggggggggtgaccaaactgttttccaaaaatcgcggcgttttactgtttgttttttcaattggctgcccaaggaggggggagttaaaccgccaaaacaaggcacccccccccccctagatccgcccctgccatattcatagttgtgctgccgcggatgactgagctgcaggcttttcaaaagtatcgttaaaatctataccaagttggggctgaagcaatgaatttgggtcaaaagcaattatattgtgtacataatatacagtatacataagcaaaatcacatggcattaaattggaaacaacaacattaagaacgaaataatgtacagcgaaatattaaacaaaaacacggaaaacagacggctggaatagctttggatgttgacaagtctcttttcttcatggcttgaaaaatgttttcatttatccatgccggtgatggattgcttcaaaatctttgttttttgtgtaatcttttttgaaaaagtatgttaaagagaaatagaaagaaacaaaccaaggccacggcaaaagaagaaaaaaatctgctaaatgcgagaccatatattttacctaaaagcacaatttagtgaaactaattcagcaactaattcagattaactttttaatttaactgcccctttgcatttctgataagtgccccttttattttgacacgtaggcctaccccttatcctatttaattagttccattttcctcctgataattgccctgttttctttgtaataagtgccccttttccgttgtcataagtgattttttcatctctggtgagtgccctttattaagtgcaaggtgtgccccatttacacctctggtaattttccttgttactttgacacgtgctttttttctttctaataaattccttttccttttgtaaatgagcccccttttcctttccccataaaatgtgctcctaatttatagcgattaagagcaactttttctttaatttcacccaaagctggcttgctacgctcgctcgcatttaaagttgatataatcatgtttcttattaaagattatttcagtctttcatgactccattgtgcttaaaaccccatcaggattgtttttcctctttataaggtgtaatttttgcactgtgacgtacctcacaaatctcaaatcttttgctcgcttatataggctgatcaaaataattaaagtttatatcctatggattgaaactaagttctataaaatcctctatacattgcatcattgaaacacgaggcataattttacgtttaaaaggatttaagaccaaagaagcaccgatgcataattattattatggcctgaccaacatcgttccatcagcccaaatttggtacaaggcgattttgacaatactttttaaactgaccctccggtgctcagtcacccgtggcagaaatattatgaatagggcatcagtagactacggagcccgggaagggacatggtaaaaatatttttatctcgttaaaacgagatagttatctcgttttaatgagatagtatctcgttaaaacgacatagtatctcgttttaatgagatagttatctcgttttaatgagatactatctcgtataagtccattgcatactggaaccgggtggtccctgtgcctattgcttaccgtaccaaaatgatgttttttgatgcccaaatgatgtcttactttactagtgatgcccaaatgataattaatttttctggccaggcatttcactcttcttaatgatttagaaaagcactggttaccatgcatctttgtgacagaacttggaatctagtcattgaaaaaattgtgtttcttattacatttacaatatattttattttatgagggttgggggcattcaccccacatgctggtacatgtacatgtaggtatatgtgccacaagtacagcagaggcaaaattagggggctcaccaaaaatgggggttcactggaactaaagatccaaggagttcagacctcaaaatgtgctttggaactacatctaaatctgacttaactatgtaaaggcatgttgaataatgtaatgctttggaacagtttacttgccacaaaagctggatatgcaaagaactcttatccatgtgaattacattcctcacatggcagccgctcctctgaggcagcccggtgtcacatttgaaggtttgggataaaagactaagcatgattcaatggaattgaaaaggtgaagtattgtcacttattgtcaacatttgtgggctctggaacaaaaatatgaaaatttgccatgtaattaatctgaaagttacatgcatcagaatttttagggcataaaattggggcatttcagtagcatatgtgtaccgtacaatatattgtgagtgcacaatacaattaactgcagaggacttagaccaagaatatggccataatatatcaggttcttaatcaagtagttctatattgccgtaattggattactaataacttaaagttgtatttatcagattcgtaatttcaccatggtagtattgtttcacaaattattttacagacagagctagacaagatggctgatatatggaacaatcaccgtatccgaccctctgtgaatctccatgtaccaaagtggccatccaatgatgatgtatcatactccacaaatctggggtactgaagatcagctttgcaccaatgttgatgatgacgatctggctgcatgcataagtgatgctgtattccgatctaccgtaccatgcgacaaagatgtatatgacttgtgtgtgtatattatgaaaagagacaaccttgatcaaccaatggaagtccaggatgccttagaattgtacatccatctgaagcaggagattactgtgttgctttaaatatatgcattcaggaaattaagctgaaacccctgaagcaaaatatatcttaaccctcaatagcccgaaatttgatattccataaagtagtaaactttctgtacatctgatctccaggtattagtaacttccttgcgtagtaatataatagtaagtctactggaggtaacttgttttaacgtataggtaatttgtactcggcgaggggatgcgacgcttagcgttgctcttgtttttactgcattactactttctgaaccaattcacccgtttgaatttgtgtgttttgaacttgaacctttcttttattcatgcttcctcgaggagccgatgtatttgcattctaatgtgaacctgtgtcatcattacaaattttcaaaatactgcatcttctttttgctcaagaattgtgcactttgtattctttgtcaaggagatcagtacatgtacaaccagacactaaagctttaaaatcgtctggaagtccccttcaagtacaatatatataccttaaagttaggaagctaagatacaatggttgcaagtcgacttgttacatcttcatcatcgtaataaccaccatcacaatattgacaactaaaattacaataaacatcaatccacaatttagggaattacctgaattgccttgtggtggcagagactcaaaatgttattttcaggggggggggggggattctattatcaaattgccaagaacaagttaatatgaaggtacataaaaagtgatgcattacattaagaataaaaaaacaaacacattcttgatcaatgcattgtcaatttgtgctggaaaagatttttcactcagttattgctaatgtaaggatttaccaattgtatgctttgaaatttctgttgaaaagaaattttattgaatttgaacaattacatgtctgaaattgtgattttttttttttttttttttacttgtcttcgaatttctataaatttccatctaataatgttacataacagttatttctctgctccacagtggtacttcatcttcaatagatatagatgtaaaggtgaaaataggcacccacacacatgaaaagcaacgttacaagaagaagaaaaaattgacacagaaggcaaaaacatggacatccaacactattgttgtcacataagacatttgggaaacgagcaagatgaatgacaggtataactttaattgcaagtaaacaaaaataacacttcgacaacagactgatttatacaaacacagtcctttgatttcaggaatcagaacatggaatcagtgaggaatccctcaacatcttattgaaatatgtagaggttaatatcttttgtatgctttctgaatgagataggtcaagttttgttttgattaccaagaaaaatgaccttttgtgattttttttcccctaaattttgtatattattgctgttcgcctatgacatcacaaattcttatcaagagagggcgacgtggaatttatcaaatttcaagaaatcataactcttgaatggatcatctaattttgctcaaactttcactaatctgcttaaaagttaaatatttattttaatgatgtatgggtataattgtccttaaagtgacagctggaatattaaaatacttacatgacctttgattttggctaaatatgggggtccccatgcatgaacaatatacacaccaaatttttttttattttttaaattattcacatttttgtaagcactatggacagatgacattttgatctcttagttttactccacctgggtggctctacaaagatggctagccatagggaacataatagtatacctattatgtaatgggagcttgctcatctgtcgggaccaattaaaaaaaagtcttcattgaataattgattgaatttatttaaccacggtaaaaaacttaaacataaatcatacagaaattacattgaatagaactacacagagaaacaacctagtaataataagcataattaattaagcatgataatgaaatgaatacgataacaatgagagaaacataataaaaacaagaaaacctaacaatacatgtaagatgtctgtgtcatttgtatagtaactgaagggaaaaggagaacaaagatgagggaagaagaggacgcgagagcatatagggggaagtctgaggagaaagaggaagagaaggggagaacataagacagagagagagaggaagagaaagagggaggtggaggttggggggagactgacactttaatggtacaatgcatctacctctgcttcaaagagcttacgatttgagaaaagatactctttcaggcaacacgttgtataattggacacccgtatagataaatcccattgtttgttttgagttttcctaaagatagtttatggccggaatttctgagcccgtaagaacatccttttaaagaaatgtgttcgcataatgacgtaggaagcaatttgtaaacaagtttgaagatctatcctagggctttccttttccaacgtatttggacacggtcaattttactaagagaatagagcagatactatctcattaaaacgagataactatctcattaaaacgagataactatctcgttttaacgagatactatgtcgttttaacgagatactatctcattaaaacgagataactatctcgttttaacgagataaaaatatttttaccatgtcccttcccgggctccgtagttatgactctagtaataaggagctaggcctacttaagttgggtacaattttttgtgacaagcaccgtaaaaaggactgatttgaatgaaatcagacgttgtaaaatgttggaggttgtaatgctgtgccacagaggtcagtggctgcatgccccgtttggtgtgtgtctctgtaggtctgtgtcagagccatgagtcggaaagggaaacaattttgataacgggatttcaaagacatgtaggcctgcatataggggaatcgaagtttcattctaaaaatcactgtgtcaatcaaaagcatattgatatatttctaaagaattatgacaaacccgagtcttttactagtctttttttatgattattatagtcctataatagactagattctctgccaaatgatggaatttgaggatattgactgtaaacaaaggacacatcgcatatatatgaatactagtagtacatgcgcgctgttttgtcaaagagattctagagggataattataattgttttataaattataattttttcgaaggtcaaacgcaccgataatatagtcttgcaaagttatgcgtagtctcctcaatctcctcagctcagctagctgcgctgcatgcagaaatcagatgcgctatgcctaacagctagcaaaacagctgtatttcacgcctacacatggcggacatgatggacgagaagtatgggaaaatcggtggaacttccattgaaacaccgcttaattgcaaacaactcattagtttgaactaccctggtgtcgtcaagaatccttcgatgatgatagaaacacttggtggagaaagcaagttgacaaaggttagtttttatgagctgataaacatgtcaagttgtggcttatttgcctttcctcgtcggtctgcctatcggggccctggcccctaggtctaggctggagtcgcgctcactcggacccggtactataacccggcatgatgcatgattgaattttggcgctagttcagaagtctatccatactttgacccgtactccggcgtggagataccctactaaaaacatacccaaaatgaagtgaaatattcatcaaatgtccaaataaaggtcatgatttaaaagtatagggtagcgccgctagcgtgcccaggcccagtagtattcggtccattcccagtattcggtcagacagccgtttcaacagctgtaacaatttaaaaaataatttatgagccacaaaacttgcacaaatcgggcagctgaacaacttttcttaactctcaaaattaaatcagattaaaaaagatctccaacttagcttgaaatttgtcagtgttgcacaacttactgcacattcgtgtcctgttagcacatgcgcgaacatgcatagccatagggtagcgcgcccagtattcggtcaattcccagtattcggtcagacagccgtttcaacagctgtaacaatttaaaaaattatttattagccacgaaacttgcacaaatcaggcagctggacaatttttcttaactctcaaaattaaatcagatttagggccccggaatgatctccaacttagctcgaaattggtcagtgtcgcacaactttccgcacttccgcgttctcttagcacatgcgctaacatgcatagccatatgtagaagtctattgcgaaacaactacgtgtgctgtcacaatgaatttagtatgtgtgtgaagagaatcacttccgtgttcgctccatcgcagcgaatttgcaaatgacgcacttgccgatgtgcaagaggtatttatacgatacccttgccatgcggtatcgctcggccagtattcggtcaacgcattgacattcagtgctttatcgcgcaattgtgtgaaaatagtgcgcaaatacgctacgctccttcgcaacggagataccacgctcaaatcgcgtgaccgaattctaatcggtgcgaccggattctgggcagaaaaatgctccgtcctctttcggaagtattttgcttatcattattctatattttaagtgactataaaatcctgtcagaggaataaatttcttttcttttgatgggtagattgccaaataaaagaggtaagaattcaaaatattagtgatttcccctaaagtgaccgaatactgggcactctaccctacatgtatgtagaagtctattgcgaaacaactacgtgtgctgtcacaatgaatttagtatgtgtgtgaagagaatcacttccgagttcactccatcgcagcgaatttacaaatgacgcacttgccgatgtgcaagaggtatttatacgatacccttgccatgcggcattgcttgtccagtattcggtcaacgcattgacattcagtgctttatcgcgcaattgtgtgaaaatagtgcgctaatacgcttcgctccttggtgcgaacgaattctgggcagaaaaatgctccgtcttcttccagaagtattttgcttatcattttatattttaagtgactataaaatcctgttgaggaataaatttcttttcttttgatgggcagattgccagataaaagaggtaagaattcaaaatattagcgatttccccttaaagttgatactctaagacaatcccaaatactgagataattacataaatagaaagcttttaacccccataataacaccaaatggtgtccacccgacaaaacaagtttagaataatgaatttattcgagtaaactctaccaaaatatctaagtctgaaacccggaagtgcacgtagagtcgggcctctatccgtgacgtcacgaacgggagtcatgggctcagtgagagtgaatggcagtgatattcctacgtaaatgctatcctgtcagagcttagatttgttgttgttaaggagtatatttgatggattttctgttttcatttgaatgaagaataacgaagcaacattttccagtcgctgatttctttttatatcctcatattcacctatttggtagagatttaagacgagtttactgcttaggaattaaagttaaatcgtgcacttatgaataggcggatgcattatattgtcatcagatgtacatgagcagttttgtaaaacgaataggtctagaactatgatagtacttgtcatagatgtgtgtgactgcctcaaaaaaggatacagtaccagttaaacattttatgttgtaaaatatcaaacttgaacaagatcatgcaagcgcgcttcctctgtaatattttggcgagtgatgcggctcttgcatgaacgttcgtgaagcgagcagaatcgggaggtaagaccaagccgctgctctaggcgctgcttgcttgtgatggaacgtacatgtacgtgcgctagttatatgtttatcggcaattgcaagagaatgaaagcgacgttgccagctaagaaaaacaactaacaaagacttgctcctgactaccggtgtcagaattagtagatgaaggatgttcagggccaaggaaggcgaaagacatgggaaaaaggaagaagaaaccatcgggagatcgctgtagtgtatggtaatgaaatgtgcatgggtagacagctactgttcactccgtgcctgggccgatttcaacaccaaaacaaaaattacatggtgaaaatatcgactaatagcacatcgttggcatgtatatgtcataatttttaaaaggggaattgatattaatactatgaagtactaggggaaggtaaagaattgtacatagaattatgatttattagacttttcagcctttgaaacaaaaatatgcagaaaatcgtatcactctgcacatgtttgcaatggaacatccgggtacgtgaatatactctctcccggacgtgaggtcataaatagtagaccagcgccgtgactgattttctatgcaaagagaggcggatattttagacatttcaattgaggatttcgagtagacagaatttttttgtgatatactaagtaattgaaaaacttaaaaataacatatacttgccgtaggtaacaaattaagggacatttatttgcttagagtatcaactttaagtgaccgaatactgggcactctaccctaggtctatatacatgtagactctatgtttgtttgttacctgtttcgtgtcaattttcttatctttttcacagtaggaatagatactcgattctatgtatttcctaaaaacaaagacttataatatgcactttctcacaggattcacggcaaactgcagcacaatacaattgcataccgtactgacggtgggatgcaggcgtgtgttcagttacatgtacatatacgttagcgaccgtaaactaagattacagtcactaacttaacacacgcgcgcacccccacccgaccgtcgggtctacatggattgctaaataagtaaatacatgtaaatgaataaataaataaatattactgctgggaaatgaaaatggaaaaaatatcctgctgtttatgctttgctcgttgttgttgttgttgttgggttttaaggctgaccaacctaaaaagattatttctgtctggctgtgctttttttttttttagttgttcatcactgatgattagatggtgctgtttcttttcctcttcagtgggtatcatgtactatgcagcttccgtttattcgatggtgcgggcaataattttaggtgttgaccatgaacagggtgcgagtattttattaataataggggttaactgtgcagtgctaaactatactttcatttcccttcctctccaagagagttagttataactcatgtataatgattggtatctacctgtagcttttatgaaagccaacagagtgtgcagatgatcttcattccccagtaaattctttaaactcctatctttaattttcaaccgagaaaacattcttttcctctctcgtacatatttcttacactccaataaataataattgattgtttcagtttcatgacaaaaatcacaaaggccatcttttcctttcaggctttcaatgatgaccatgcacccctctcactcaacttccagcctggtaacccttactgtaagccagctcgaggcgtggcctgcaggtctacatccctactcatgaaggtcaaacgtcgatacagaaggaggagagagagtgaagatggaggtctgaagactggttcccagggggagagggatgggaattcagcaaacgggcaatattctgcagaggttcttggtgtgattggacaaaaatatgaatttccatgtaagtggatatatatatatataaattttgatctctcattgtgttacaagattatggccaaaatgttttttgtatatcttggctttcctaatagaaaaccagaaaatttcagctattaaaagtaatacaatacaaagttttggtatggggtcatgaatttggttcaaatgaacatattggaagcatatgccatcctgcaatattcagtgatcgttgtcgcggttgaaatcaagtcttaagttatgaaattgtaaataataaactctttatgttgtgtacagctatagttttaaccacgacccgaaaaatatgcagtccatatttattttatatacctctgcatcgattctcaaaacgaaatatttgaacaaaatttgcttgagtttttttaaatgcggtatagtatcttaaattttggcttgttaacgcttgaagaatgatggataatgcatgtatgacgaaaaagttatagacttaactcgatgttaaactaggggaatacccggaataccaagcctgagatcactccggctgggctggggtctgttgtgtccattaaaccgaagccaaatcgtttcctatcattataaattaggcctttatagcacatcagacctgcatgttactgtataccaaaacaggggaaaaaaataatatttatttttggggggctacttttgtaccttaccggcatgaaaataacattctaatatttgttttgcattaaactctatgcaaatttaagagggctcttttctgatttttgggggctatttcgccctgagccccgtgtatttttttcactgtaccaaaataagaccagatttataccagcctttgagataacgttcttgtcatatttccccatatgctcttatatcttgaatacagacctgtgtgactttcaatacctgccgtgcgaacaccaatccagcgggggagaagcggagagcctcattggaaagattctcccttcggccggtgaggatattagttatgtggacaaagacactccatctttcatgctacctgagatgttctccaagtttgacaaacccatcccttacaattacaaggcaggccaccagctcccgaactctaagcaacagcacgagatggactttcgtgccaagctaatccagcacgggaggcataagcggaccaactatgcccatgttgtgtcaaccatgggtgattttgagattcccaagaaaccccatccgattgctgtagaacagcttgaagctcagaaaccaggagctactacggatgagattacaaaggtgagaagatttctttcccatagatcatttccaagcctggaattaacttttctttcacaggggctcttaaaaaaaagggccctgagagccttctcacagaggctcttttagtaatgatagaggctctttttttatacaaattttcattgaattggtatccatgatactcctaaattctttgctatttcatcatttgtgtgaatggtgcgattttgatctatttgggatagacttgccaattccatctgacttccgatatttgtgaaatttacgatttatttatttatttgctcatcagtatttttagttacattgaaatactgtttaaatgtgctagttgatgttcttaatcataataatgacaatcttacctgttgatcttgttaagattaagaagttattaaaattgatcggattcacattttgagattaacattgttgtatgtttgagcttatttcacttgtgtaattggttgtcatctgttttcggaaaattgcccctggttctggctaaatcccgtgaaccaagggcaacttttgaaaataaattgcccctggttcctggcagcttatttcagagttgcgtgcaaaactgtggcggttcattatgtagcgtaaagtgtaatatgcttcacatgtcttatctgtatccggacacctacccccttggacatccacaccccggattaccacccccagtcatctaccccctaggacaactacatgtaccccctagggcaaccgccctctaggacgattaccccccaggacaactacacccggacaactaccccccagacaaataccccccaggtcaactaccccccggacaactactccctaggacaactacccccaggacaacttacccccaaataactaccccccaaacaactaccccctaggatagttgtccggggggtagtcgtcctagatgatggttgtcgtatagggggtagttgtccggggggatagttgtctggtaggtagttgtctggggggtggttgtcccaggggtagttgtcccgggggtagtcgtcctaggggatagttgtcggtagttgactgggggtggttatccagggggtagttgtctgggggtagttgtcccaggggtagttgtccctggggtagttgtcctagggggtagttgtcctagggggtagttgtcttagttgtcggtagttgactgggggtggttatccaggggtttgttatccaggggtaggtgtcctagagagctcagtaaatatgggcaggatctgtcttttgtgcagttgccatgtatttacatgttaacgaataagacagcaatgtatcgtgtcatatctgaacgagcctcaagtacatgtaactgttcaattgatgcgtgtatgattagtacatgtacctagttctaatacctagtaatatttaaagaaacagaaccttgtccaaaatatgtctttgccagtacaagaaatcaaaccgacatttctgtagttatacagtacggtaggcttgcggttgcaccatgtaaga

SEQ ID NO: 65009 - DNA, 731 bp, Oryza sativa
gataactgcgcgtatattgcatttactaggtgttaattttgaatatatcaatcaattaatggacctggcatatatatcttgtaagtattaattactgatcagttagttaatgaccttgtgaatagttgcattgacattggctttctcggtgtaacccaccgacatggtcagaaggtactgcttgccactcgccacgtcctgtacgtacattcatacaaacatgcatgtaagagatcgatcgatcgatacatagaagctagctacactgacatcgatatgtgatggaggcctgtgcatggcgcaagcagagatgaagatcagatcgatcatacggatgttgggtttccccagaggcggcggagatgaagatcagattcccggacgacgatgcccggaggcagcctctcctctgctgctttcttcctcgacacctgtactgcttctgcttctatcttgctcttctccttctgcaagcatcatcaatatatataattgcgcacgtttttgtattacttaaattggttattagtattaattagttcgacacagttacgttgtatatatatcactatatatatatagtagctagacgagatatatattataccggccctgaaatagtggcgtttgacgaaaagttggcagtggcgctgctacggacggaaaatggtgccgcccacaacgacatgtacttgttgagtatgttgatgttgctggccgggggtgcagga

SEQ ID NO: 65010 - DNA, 2169 bp, Oryza sativa
aaggaggccgggtgaacttcgggagtaggagggaggagcgggccggcgcgggaggaaatgggccgggcccaagaaaaagaaaaaaggagggaaaagaaaagataaaaggaaaaaggattttcccagggatttaatattgcactttgcttattttaattggttaaaattatttccaaggctctgaaaattccactaaaaatcctgttagcatattttgacatgtagaatccaagagaaattctacatgtcgattccgattattatttgcatttattaattagggattcatctctaggttaaattaaacaatttcttcgaacgatttattttatgaatttagagcaagggaggggaacttcagggcgtgacaccaaccgaccccgccccggcgttcccaactattggcatgcgaggtttccctgaaccgactagttacttagacagggtgtcccattccaccttgtggttgcactttgattatgttcgatgagtttcccacaggaatcggtccttatatgcgaatacgggacagtgccacataggcacaacccccgcatcgcgagttttcacaattcattttgttttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccatcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgggaaaacccgcgatcgacgaaaaatccgataaccgcaactatacgcaacaatcgaaaacctaaacaagagaccaaaagaaagatcctatttagactaattagtagtgccattaaatagatctcaattttatggaaatactggaagtggaacggagtcaatcggagttgcgaattgggtgatatgaattttagaagtttaattggagtttctggaataggagaaatggtttatggaatttataatattctcaagaatattattgacagtcactgtcacgcgggaccaaaggaaatggtttatgggattttagaataaggaattgatttatgggacaaaggaaaaaggatttattaaatccctgaaaaagaaaaggatggagggatgttaattggacttgggccgagcgaaggggcgcggcccgaagagatgcgcgggcgcggccgaggcgagcgggtcggcgcgcgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcggtggaccgggagacctttgaccggtctccgcggggccgggcggctgaggtggcatccacgtggatgccacgtcggatggggaagggagaggaggccgggcaggctgatccgatggccggcgacgagcgacgtgaaccggcgaacggcggcgaggtggattgggggggtagcaccggaagagagaggaggccaaggggaatcgattcaacggagcggattagccgggggaaaaacgacggcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggcgcacgcacggcggcgttaggcggcggcggaagcggcgacacggcgcggagacaaaggagaaggccggcggccttggggcagccagggggaggtcaaggggatccccgggagcgtggcggcgagaggaatcgacgcgagaggagccgacgacggcggatttcgacggcgatcgtcggcggcgagcaaacagggaaacttcactggggcaacgggggttcgattcgttgggg

SEQ ID NO: 65011 - DNA, 2175 bp, Oryza sativa
  unsure (1)..(2175): unsure at all n locations
aaactgtaaaagcagattagaaatcaaagttgaaacaaaggctcggcggaattactctagcaaacccctcttgctcacagccatgtgctggtgaggtctccgatgatgttcttgatgtcccgcagagccctcctgttggtgtttgccatctcgggcgcatgcttgacgccctccattgaaacaccttcgcccaaatttacatgttagagcagcaaacaaaggccacacagaacaagcctgaattccagatgcggataaagttggtaccttggttaaagttctcagatctcatgttctccattgctgacgttctactgtagaaaaaccaaaccgaaattttgtcagaacacgaacgctttttttgtcagaaatcgaaaaacaggcagcgatatgaacatgtagcattacgagccacgcggatctacaaaaggcaagacattattatttgaattcgctcctgatatttcgctagatgtcttaaaaattccagttttgaccacgaaacgacccccaagaagtcaaatatggcagaaaccaagagaagaaacagattagaaccctcgtaattccaactcgagagacttgctgtgcttgaactctctcgtcagggtggagagatcgaagaaattccacagcagaaaataaaagaaaagaaaaaacacccacaaaaaaaggaaggctgtccaagaagttgctgaacatgccttccaagaagcggaatcatctccctgtcgagtttcctccgttcttggtagaaaaaaccaggaggaagaacccatcaaaaacatcaaagatctaatcttgaaccaatcctacaggctagagtaccgacgattcgatttcagctagctgctaatctttttccctgaattactcgtccacgtctccatccaagcggagatccaagggaaaacgagctcagggaaccaaatcgaacgcaaaaccacatcaaaaaaaacccctcaaaatgaaaatctcctcctctagcccaaatttccgaccaagaacgcatcaatctaccgcaagaaggagccttacacgatctagaagacgagagaggaggaagaagattgntgccctgccacctctctccccctctctctctctctctctctcgatgctccagaagaagaagaagcagcagaggggagaggcctagctgcgagtgcgagctgcggtggttggaggagcggaggagaggggagacaaaggagagataaaataggggaggtaggaaggcgtaatttggccgaaaaggcaagggctcacccggcctctcctgtttaaacgcaacggtcgtgggatctgggccgtcggatctgcatcctgcggcggaggagtcaccccgcggccttaacggctacccgcaccccacaaggcccgattcccacatgtgctttcaaattagaagctggtctcacttgtttccttctcccctcctcatctcatcgccagccaacaccttttaggggtctatttttagtcacttgcttcacaattctcctttaaatgcaccccccctactgtcatgtcaggttttattaacaaatattgcttgattcgaatgcaacagattttgcaaaaactatcttccctgttacaaagataattatatatcatggccccactcaatatatcgcacaatacaaatcatggtagtaacttgtacaatttggttagcccttgaatcttaggttttcaatatattcttataattttctgtttaccaacacgcagaataccgggggaaatatgtgtgctctttcgacaatagacccactgttttactttgcagctgataagccgtgaaaaaatgaacgaagcaaccaaaaataatttatagttaaaaagtttatatttatgttcttagcaattcaaaagccaatgatagaaaagaaactacgatgaaaaaaaactccaaaaccaactctaaaattaggtttaaaaaaattcaaaattttgtagtggctagtaagccaattagaaaacaataggtgtgaatgaccttttttttttgccaaagatctaactttacaaaactatgccatgtttatatcatgtgtaatttaattagttgagttcataaagctttcattatctttgaaacaactaaggacataaggaacgtgattaggttgtgttcttatgagtcttcctcttggcacgcaaatggag

SEQ ID NO: 65012 - DNA, 11616 bp, Oryza sativa
  unsure (1)..(11616): unsure at all n locations
agtgtagtgttgtgtcttaaagtctcagataaacttgcatgcaagggctacatgtacataaacagtgtatgtatcttttattgtctcaaaatcagagggtgatttatatttttctggaaatggacactcatcacttccattttttttcaatatattgtttacccgtaaatacacgaagacacacaccatatcagctctgttctgaaatatcatttattttatttattagaattagcgcctccagttcttttacaaccactgcccaagttgatgctatatgtacagtacattatgatagcagattaatttttgtcaatggacatacatcaacctgtacctttatcagtaaataaacaataagctacagtaatactgtaattcttttaataattaatattgctattaatcccatttgaaattgacctatatagatgataagtttacaagcatagactgttattttccacttcaaataaatatctgtaccaagtttatcttagtatctttagtaaagcctagcccatgccaatatgagtacagcacatggcgtattttgtgccatctacactgtacagtctagcaattaaagttaaacttgagttctggtaaatatagaaaataaattcacacagaattccaacgaaacttacactgaattttcaagattacatatataaatgacataatgccaaatgattttggtagaaaatgtatagtggccgagtaatgagcatagaaagatattaaaggaaatccggatagacccgacaccatgtgcttaacacagatctctatgtacgaatgggagtagtgtttttttatctatctttaagatgatgcccagtatttaaagtcattgtgtggttgtttttatttcactggttcaaacaaccaatctactgcaatccagaatcatagcaattttctctcaaaatgctattcccaaactagagctcaagattagctttaaaccctgtgtcatgttcaatttcgcgcttacgattcattcagacccgtttcatttaactattaaaatgaaatgatgaatttacagaagagtttgcttctaatgtattcaagaccttttaaaccaagtccttgttcaatcctttcatgatgatgatacgattcaccgacgccccccccccccccaaaaaaaaaaaaacctttagataccacctcgtttctctatggtgcatgcatggtactgccccttcaatggggcttatattggccctagctaaaggggtatacatgtagctcagaaatgcagtccaaacagtaatgatgaaatcccctatccttgtagtggtgcctgaattaagtccatggcaccctgaataatgacggtacccccttagtcctctttggtagggggtaccgctggtgttggcctgttgaaggcgcctgctatggccctagcgagagggacggtcgccagcggtgcagcccagtagaccaagaggtgctccaagaggctttggttaccacagttcaaggtgattcctgcggccagggcagggttaaacatcatcccagtccactccaaaccttgacaatcaagagggaaagtaaaactattgaaagatcgtgggcaaattactcttcttatgatattaaagccccactgtactacttgtagctactttgctccctctatatagaaatttgaaaacgatgcctaaggccaaattaaaaaaaaacatgtttagcgtcctgcttttgtgaaaaataggaaggaggcccttttttcttttttttcaaaatggctgctcagtacaatttccctgacagtcaggctatttttcaagatgaccgccaagatttttttttaaatttttaaaatcagaaatagatccattatagcagtgtttcccatgtttttttttgtttaaaaaaaataatcaaaatttaaaaaaaaattatttttaaacaatttcaacaacaaaaacaaagtcaaaaaataaaggaggatatagggcggggacggttaacatgtaaattttgtttaaaaattatttttaaacaatttcaccaacaaaaacaaaataaaaaaatataggaggatatagggcggggacggttaacatgtaaattttttgtaatggcctaatcagtgaccattggtcccccatgatcctctttttcttatgtaaaattgagagctgagttgatgagatagccacctgtcagtgaccaccctgggtggtctaatcccccccccctagccaactagtacagatggcttttaaagagtccattctcaaaaaacttctgacttgggaaagtaaaactattcttcttatgatacatgtacatgtattaaagctacggtcacaaacgttcgtacaaatctctgtttttccattgtctgaaaatcgtttgtactgcgtttgtagcagtttgtaatggcatttgtgaccgaggctaaacagtcaattctcaaaacacttctggacttgattacaacttctaaatgtcaaatatcattattgtgatttgcgaactgtacatgaaagatgtatcattgtttctttcgaaattcatttacctgtgacgatgatcaaaacctggattgcggcatcagcaaacattccactgtactttccttttggctgaaagttgagggtcatgaaataggtcagggtggccaaagcttctgcaaagccaccttccaggatagagacgttcaatgcagaagcacagtagacctgtagcaggtgcgagaccttcctctgatgacgattggtcggtaccaccttccacatgaagcgcacgtagggatatgctagttgccctccgaccacctgaaggcatatcttggatagtgccgccccagggctaaagtcacctttgagcatggactgccagatcatacaggtgttggctgtggagtcgccgtcgaacgtaaggctctcagacacgaagagaatccagagatagagagcgtaccagtagaggccgtactcctccaatatgatgtcgccctctatgacgcctgcgaccagttggaacgtggagatgagttccgcagcatagctgtaccagaccggatcgttgcgcaggattctcttggtcagagaccgaatcagattgcagccgaccgtcgtgaagaagacgaggaggaatgtcgccaagactgctgggtactcctgcgtcatgttagtcgcctattatttcacaaactgaagacagacagactttagctatcaaaccacctcaaatagtaatgccggatgatatgatgcattcgatattatataacactagtggtcctttcagttcttgttattcaacacagcctgagacagctttgtccggtgccctgcacattctcaaaagagcagcataatattccaaccgtcttctagaccaccagttaatatattaaaagtagtttcgtatgactgaaggcctcctgagtgctgcaaaccaatgaaagttctccttttcttttgtgttttgctgatgctacattaatgtacaatgcaacaaaggctgccctttattctccagtgagcaggatctattcttcacatctaggtcttagtttgactagacatttctggtattccaggaatgcccctggctcttacagaccgctgggacggacggacggacggacgattgacatcacttccataactatgacaaaccagtggttcacatccagaacatgctcaatagatgcatgtactgcgtggtgtatagtattcatggcatctaagttattcaaggttgcagctagaactttatgcaaatatgcacatgctacagtgtaattaaatgtgtttacatttatcgagagcattataatctgatgacctttgaatcataagtgaagtattaactttagatcagccaaatactctacatttaaaccccctaaattagaaggaaagccaattctatacattgacattataggggagattatttacatgcagatgatcagaataatttgtctgaagtacaaaattatgtttaaatgagtttgacattaacttgttaagactattttattactttgataacattctgagagatcatcgaaaaaggaagttaggcagcaatatcctgtctcaaagtgtaatacgtgtttcctaagacatattgagttttcttggtgagatttatggatcattcaatatgtgtctcattagagattataggaaaggcaaatgatttcctgccatcatccctggggggtgtttcacaaagatcctaagttgaacttttaatctctaagtttgacttaacaattattcaaagccgaggcataaaatgttgattcaaatcattcatattttctattatcaagaagatttcatgttcttgatgtggtattaataacagtctaaaatacttgaattttcgcattcgaatatgttttttttaaggctgcaaacggctctccataattttatagtccaacttagagttaagttgaacttattcaaggatatttgtgacacaccccccagatttgttgaaggctgatcaagttttaaatcattagcctgttcaaactggaagaagtttaaaatacatgtacatgtacatgtaaaatcgtttgaagaaacgtcatataataaaggatcgtcggatagcaaaaggtgcgtacagaatgcataacaacataattgaaacgttgattagatttgaaaaggtcaggtgacataacagcctaccaatcatcaaagtgcactcacgataaaccctgcccagtttttcagtttcatccaataacattaagactaaatcaggaccctgctcctttatttgaaaagatgcttcaacatttgtttttgccatgtacattatttgactatgcacttctttattcaacgttcagactactttatacagtaaaattgtaatgacataacttatagctatacaattcttgtatagtgttccactgacctctggttgtctggactggggattactctttctttgaagaatggaaggaaatactgaacacaacaaggagttaaaggaaatttgtgaaaagaatactataataataataacaataacattaaagggactttgtaacattgttcagataagagatagtggtgctaaggtagtgacttcaatgctagatgtacaattaaagataatctgaaaatttgagtgaaaacggatcattattcatggtactaattgggaaaaactgatctgatcgattccttaattctcccaactatattattctacttctattctgctacttgtcaaagcctgttcagcatcaagacaaggacaatttaattacattttaggtgaatgtaaatcgtcacaaagcaataaaatggctctacattccattccagacagttaagtgttgacagatttttatagcctgttttatgtatttttctcatggaaaaacggttgggaaaattcaaaaatggttgggagaatttactgttaatccctgttagagggtgcctcacatcgacgccttcaaagaaaaccatagatatctttgtggtttgagaatttgttcaggattttttgcatgtcagagggttagtatagtagaaggaataaagtaagtaacattttatacaaaaattaagcaatttttttcatcaaccttcaacaatgttactgagtcactttaaagggattgggtatctttgtatcagattctgaaacaaaaatcctggatttagctcatgctgcaatgataattaataaacctttaggtcactcaggaaccccatgacttttactagccgatcgcttgtctgattatgaagatatttatgattggaaatcgaaattttaaaacactacagtctattggggaaaatgagtacctggttattaaaccagttacccaaagatttttactcttttgaagcgcaatttttagggcttcaatatgacaccatatcagagacactgtagggccatatgcatctcagatttaacattgttaaacgatgcctttaaaagtgggttcttgtattaatttttatagcatgtatgtcatacttatagtaagaaacaataatgtagaccaaaggtaaattcattttcttgttcttttagtaggtggtgtgaaaatagtgccattttaatgacctaatttacctttgaaattgtaataatttttaaattttttatttgttttacttgtatgtgtatttttgagttgcagttctatagattattttcttactcattattttcctactcaatattttcctttttttcattttgagggtagagaatgagtctcttcaaatcatgtatttgactcaagactattaataataatgaacatttgtatagcgccttttctacaagtagatacaacgcgcttaattaacatatacaatgaacaattaacaaaatagaaagatgcttaacaacagacatgtatgtaacaatataggaatgaacaaaataaagggtaagacaggtaatagaagagcaagaacaagtgctggtaagcgggcattagttaaacaagtgtgttttgaggtgttttttgaaagtcattagagaatcagcagtttgtacaaaattggggagattgttccatgattttggagcagtggctatgaatgcccgcttaccagcattggttcgacaccttggggtatctaaaactgtacgagtgttggatcttaggttgtaactggagtgcctaacatgaacgagatcagtaagatatgagggagagagatagtgtaacgacttaaagacaagggtggaggtcttgaagagcactcgctgttgaataggaagccaatgcagagagttcaacaagggcgtggtgtgtgtgctctttggttgtttgaagatgaggcgtgcagactggttgtggagaagctgaagacggtgaatgttctttgctgttgtgccactcaacaaactgttacagtaatcaagacgagataaaactaaggcacggactgcagcatgagtggtactttcgtcaagatattttctaatcctgcataagttccggatatgatatttgacagtcctgactacatttgagacgtgaacatctggcagcatgaggttgtcaaagacgacgccaagaatacgcagcttctttgacggtttaatcacagtcccatcatgaagagttagagtgaagttctggagcaatcgttgatggactttcgaagcaaagactactaactcagttttgtcttgattaagtttcaatttgttggatgtcatccacctgtagacatctctcattgcatcccgtagtctgcatgcagcatgatcaacagagtcctggctagaagggtcgcattgtatatacacctgtatatcgtcggcgtatacatgatagcctatgccatgactgtaaaggatatcagatacaggtttcgagtagagcgtaaagagcagcgggcccatcaccgatccttgcgggacaccgaactccaacctggtgtctagtgatttcactcctctgattcgcacatgtgatagtcggttgctcaggtatgatctaaaccagtgcagtgctgtgccagagacaccatattcatcccgaagccttgtcagcaagatcgtgtggtcaagagtgtcaaatgcagatgacatatctagcgacagtagaatgacgcatttccgatcatccagagcacataagatatcattctgaagactcaccaatgcagtctcagtactgtgatttttcctatatgcagactgtttaggatcaccaaggctgttgtcttccaagtagttggctaactgtgatgagacgactctttccataagcttggctacaaaccttatgttcgaaatgggtctgtagtttttcattctttctttgtcaagtcctggcttcttcaagactggtgtcacagatgcaacacctagagatgatggaaaatcgcctgatgccaacgatgcgttgatgatatgcgtcagctttggcagcaaaacaggaaggtgacgcttcaggagccacgttggaagaggatccaaaggacatgtcttgttgggtgagcgtttgatcagcctctgaacctcctcagatgtgaccaactggaactccacgaatgaaggggctgagattgccataccatttggattgtccaattcgtcaacgtttaagtcatctatacatctccgcaagtctctgatcttctcactgaagaatgtgcagaatgtagaggcaagctcaactgatgaatcagcatctgggagaaatcgtttactcttattcagaagatgcttcagttctctatacatgtcctttggagtactttcagaaaacaggtcattgtagtagaaccgtttagcccttgacagagcttcagctgcagcagctttagcttcacagctagctacatacactgtacatgtacccctaccaagttttgcaatagtttaagtatgtgataaattgatttggcctgattcatgtttgttgagaatgtgacatacatgtattaaagattacactacatttaaagtattcaacaaaggccctcattcaaccagtacatatttcaattttgagttacaaaaaaaataaattacaaattttttttttttacaaggggtatgaatagtgtagttgttaactgtatttaatttaacggcaaaagcaagcgaggtgtaaagactaaagaccaagatcaagagtgagaaataaagagagagggagagagagagagagagaaagatcaagagagagagagagagagagagagagaaagttcaagagagagagagaaggggaggggggaggagaaagatagagaaaaaaagagagagagagtacaagtgaaggcaatacaactactgtcctgaatgcatttcaatgcaacacttatacaggtatatctacaattttcaatgagcacatcgtaaaggaaaagcacattaccttttcatctctcttctctttagctctttgaacagcgccccctatggtctcggaatgcattgcgatgtaacacggagatctcaaccatcctgatcaagggtatcctttgtgtggtggcgtactacttccaacagggtccctggagagggctgtggtgccgcatggggtacgaccccagagaacatccagagtcgaagaaataccagcttcttgatttcaggataaggaaaggtaaagtgcacccatagacactataggatgttaaatgctttttttaatctttcattttatcttgaagataaacttgagttccagttatgcaattgcattgtgaaagaaactgcttggaagcaattattattaataataatgataataataacaacaacaacaataatgatagtgataacgataataataatattaataacgataataatgataattgtcaaaagtgaattcttcacttgtattggaggatggatcgtgttttgaaggaataacaatgtactttgcaacattttacttttgacttggcccatttatatacatgtacaggtgcactgtacagatcatgattacataatcattactaattgggcatattgtaaatggaaatagaccggctcatcaatgatactattgtcatctatgataatttagtaacacaagagatgatatcaaggctcaaacttgaaatgcagaactttttttttgatggatttcaggcctgataattacctgattaaaatcgtttcccgttttttttgtttttttgtaactgattattttttctgctatttctttttctttccgattttacacctattcacctgattttccctgattttcccaattttcccccaattttccccaaactaacccccttaaaagaggggtaatgttgttagatgcaattgttttctccctgaatccttttttttttttttttttttttttgttactcaaggggagggaggttttttttagtactcacaatcacccctggatcattcatgtttctctactgtgttgaactactgcagagctgactgacaagagattgaagttgctgctgaagaagaagcgaatgattctctaccctcaccaatccctgaagcacaagaagggtgttcctacacccctactaggcagcaatcctggtcaacaggtggatcataaggaaactattgtaagttacaagattgttcatttcccttcctatcatgtgcttttcacactggtaaaattttgctttaatagccccggacnatagatggagctaaaggggggggggggggggggtgtcttagccccacctatagtcctgggctaagcttcatccactttctgttcagacgcgaatttgccaaagtgggctagccccacctaaagtacagggttagttggcccagggctaactatgcaattctggtgctaagcaaatgaatgagaacagaaacgaaaaaagtccggtactacgtaatgtagcttatcagagctggccagaggcgaagcaagaaacccaaagcaaaagccagagtaaatttataatagaaatctgacactggtaatttttatgaaatggggcccaatttttctttctatcatcctagagctctggtcagtggtatttttctctttctttgtctctatatgttttgtttcatctttgcctggaaatttaatgaatgaatgaacatttagccgctggctgaaggacattagcatgtgtgcatgccacaaagcaaattgttggtatcttgcttccgaggttttgactgctctaaccatttaaacagaacagagattttctcttcgtcaaatgaatttttaaagagaaagatccattgtagtaacttaatttgattattggtatcaaataagcagatacctatgaaattacaggcatttttatgcgaaggactttctgcttaacgcaagttcatacctgcatttagcagaactgtgcaacatgcctacccgtaatctctttgtataagacgcacccctattttgggggccgagaattaacaaacaaacctttattttactgcgaggtgcagttgaagtcgccgaatttgtgcttgagaacttgtcacaaataatagtaacaatgttgtttttaaaactaaagaggacagaaaatttgtcctcaaagtccaaacagaaatccagacatacaggtagtgttgttctagtttctgagtggtgagtcaacacaccatgtatgactgagctgggagacattgccaggcataaatcgacactaaaaaaatatataaaaaatcttgtacctgtttataagacgcacttccgaaaaaaggtgcatcttatacacagagatttatgatacgcctttctgccggcaattcaacatgaaatgaataaaattgaataaaatagattaattaatatctgttacacctgtaggattcgtactacatcatgagacgagggatcctaccggcataccaccagatgttctaccagctgtgtgatctggaggacccagagctccaggccatcgtcaccaaccctctctggcacaagaagaggcccaacatgaagacgggttactttgaggtggagatgttccgtcagctccgggacgccctcactcagatgatcaaggataccgtgctggaagtcaatgcaaaaaaattgcagcaaggtaaacctatccaaaataatatcgctagtgatatttgtttgtctcgcaatgtatg

SEQ ID NO: 65013 - DNA, 19684 bp, Oryza sativa
agaagagtattggaacacttaaaacatatacaagaaggtcaaggaaaaactacctcagtagaggggaagtaataaccagctcaatcttttgtgcaagtccactttttttcacgtgctcacgcaggcagtcaacctacaaatgtacacaaacaaactaataatggaacttgcaattatttttttttgcgctgttttcctgcaggtaggggctaggagatatatatacactaacataacattttgcatctgatatgcctggagtaccagacatttctactttgtataagaacatgaataccattcatgactaaaaatataaccttccatgcttcatccatccacatggaagtttcacacaaaatcagtaaacgcaatacagtgtttctttgcataagccagtttatgaatgaaaagatgatctcgtcacacaaagtcagatttttcagggatgtaaaacgaatatagcaggccttactttatgatctcaaactaaaagtataaaaaaaatctttctgttaaagattttttgcatcatactacttctgttcatttttacttaataagacattttgcatcatactacttctgttcattttttttgttttataactaggtcatcgatatggtccacaatgcatattttatgttatcttcaattttttataaccatatgaaagtgtctttcatgataaatgtactaatgtcattttcaaatatcagaccatcatagttttacaaatattagtgatgtgaaaatggagagtgtaagcgtcttcagaattctatttatttatttatttatcatggatgaggatgagttaataccgaaatcacaccaagtgagtgtggattccaatattcattttgtgcaacaaatttactttggtttgattgaacaagtgaacaatagaatatcagaaagaaggaaaggtcactgtagggtggtaagagatccactcctttgtgttgtatactgaactaagagcccagactagcatgattgaaacaggaaaagtacgtagatcaatttgtgaaagaaagaaagaaagagagagagagagagagagagagagagagagagagaaggctgaaattacttggttccagcccaatggagtaaggtgggcgtcaaagagttggggcgacatgtaggcgctgtgatccttctcgccttccacattgtgaacaccctgggcatgcctgacctgcagggacaggaaaggattactgatggctaaggaaatacagtacattgtgatcgatgagcagtagtaggagtatttggaaaagcataggaggaagtagtaaccaggtagatggttttgcagcggtggagaggatacatggcggtggtaggaggattggcgtccattggagctcctaaaagacaaagaaaatagaatctgcgtccattagaataacaacagtgggggttaactcactcaaaaaaataaaagagcagtgaaaaggaaaggaagaaagaaatcctttaaatttgcaggaaggaagaaattggaatcggggagggatcgttgggtttggggcccggccggcagtgatggggatttttgtgtggatccaatccgatccgatgggatgggatattgcgaatgtacagatagaggaagaagctaggagaggagaggggatccggagaaagaagtggtcgtatgaatgaatcaggcggggcaaggataagtaggtggaagctatatatgaggtacctgaggaggaggaggaggaggaggaggtgcagcgaggaagaagaacaagggaggtggggaatttggcacggcggcggggaaactgtccgactccgatggtggtggtcgcggcggcgaatacagtgtgcagatgcgagtgctggagcagctggaccattactactttgaggctttcagctcgtgccaaaaaaactgtgagtcgtgtcagagttgggcacaaagaaagaaagaaagaaagaaagaaagacggggatgcgttcggattggctacttggcttgccacttttgtttgtttatttgcccactcacccaaagacacccacagatctggagctgctgcttcgctcctctcctactagcagtagtagtaatactctatgaaaaatctatttactattagccctctgacatcagtttttctgtattgctggaagaaagatggtgcgagagcaagtttaatagtatagccaagtatagccaatgtaatagtcaattcatacaatagttgcttgctatactattaatacctggtcctatatgtcatacacacattaagtcttaaagtccatgctgcagctgactacagatttatagcatatgctgctcttctctctcttcctttaatctctttaaaatatgtttatacagtgtgcagatttcagcgccagatacactgacgttgtccttttttctgtgcaaaagatgcgagtagactacttaataaggccgatcacagtgcgggaacgtggaccggtgctccacctcgccagctcggatgtgggcttgcgtggagcgaggaagcatgccccaacagagccgctcgcccccacggagggcgacaagaaagctccctgttgcgagttcatgcgcggcggagaaaacggctagcacccgcaccaaggacggcgtggcttcgaggcgtcttaccctcgtgcgaagaaatccccggtttgctcacgaaaattcccctcccaccaccgagtcaagaaaaggcaagaaaattttggggattgaaagataagaaattgaagaacatatcgggttcaacaagatgaaaaaaagaaaaaggaagcaaaatcatcacaattcatagggccaaatcggcgttgccccccaaatccgctggagcagtagagaggaggcattgcccccaaatccggcgctgcaactcggatccgggcccttgagtgcagacaacaacgacggcctcctcatcaagtccgccgctcgaggtctccctcggcgaggtcgccacggtggaggcgtcccccgctcgagcgtcgcgtcaccggagtagcagagaggaggaatccaccatttggcatcgcgttgtccactcccgccgccaccaccgctcccgagtccgtgcaggaggagaagcgagcggcgcagtcgacggcgagacgaggcgcatggcagcggcgtccctacgagggaggagcggcgggtgaggtggaggaggcgaactcgagcacgggagcgagatgaagggtaggtgaaggaaatgatttcttgcgctcggtcgtgctaaccgcacccaggtcacgcgcgttgtgagagtagttgctttgcacagcgatttcatccaattaagctacacaacttggggtgcttgcactgtgggatgggtgtctttgagccaactttttgggttaggggtacgagccccatggcttgcattgtgagtgccctaagagcatcaccaacaacttacgtataatctttccccaaaaaattgtttgtgggtttcctaaattgaaaataggaagtaaaaaaaactcctccctccaacagatagcctaaattcaatccccaaaacttgaaagtggacccttctgttaaactacatatataggaaattcctttttttttctttcacgcgcagaaagatcgctttctccacgcgtggaaacgggaagggagaggcgggagtgcgagattgggagcgagtttcgcgtccgcatataaacggagctagaaatcgggagaagggaactccaaagctcgggtaaaagagtaggagatttgttgaagctgttttttttttactaaaatctctcaaaatcagttttggaaatcagataagtagactgttggtgatgctctaagtagctgaagtgaacatagcctggtggttgagctcttttgattccattgtacaaggttcaaatcccaccagcccgaattgatttttcataaaaatgtcatgtgttttgtataaaaacttaaacatttaaaaaatatatcacattttttaaaaatatatttttatttaaaaaaatcataaaatttcatgtgttttgtttaaattaaaaaacttgaacacttaaaataaatatcacattttcaaaatttatttttatttaaaaatatcccgttcagtacatatttaaaaatagaagaatggattaaaaaaactctttacaaagaaaattcaaacagcaagttgataaatatgggtaaatgttattttaaaatgtcacgtgttttgtttagggtttagggtttaaaattaaaatggcaagttgagaactaagggtaagcggaatttttttttgtaaaaagaaggtagaggaggggttcgaaccttggttgcatctgccaccaagctaaaccaaaccacatgctttcacacctatttagacggtacagtggtcagtggcgcaaagatcccttgacgtggagatttcgtgccaactcaaataagatcttggtgcgccaaccccaatgtgccacgagaatgctaattgcgcgtacgcgccgccggcgcgtacgctgccaaaaaaacccataaaagcccgcgttcactgccaaaagcccacacgtatgtttctttcatgttttttttttccatttttagcagccacgtttctttttttcccttgaaactttcaactcagatttaaaaattttcaactcaaaatttaaaactttcaactcgaaatttgaaaactttcaattcagatttgaaaactttcaagtcgaaatttgaaattttcgaagtcaaactttaaaaactttcaactgaaatttgaaactttcaactgaaatttgaaaactttcaattcagatttgaaaactttcaattcgaaatttgaaattttgaagtcaaactttgaaaactttcaacttttcatctcaatttttaaaaactttcaactgaaatttgaaactttcaactgaaatttgaaactttcaactgaaatttgaaaactttcaattcagatttgaaaactttcaactcaaatttttaaaactttcaacccaaaatacaaaaaaattctaactcggatttgaaaactttcaaatcgatattttgaaaaactttcaaatcgtattttgaaaattttcaaaatcaattgttttcatttttttattgggaaattattgtagcattttcactaatcaccatgattaacgctaatggtcaggattagcgacgtcgtcacacgcatcgttaaatgtcgctattgaggatgctgaggcccgcgtgcgcgcgagttagcgtcctcgcgcgtacgcgtgctagccatgcccatgcgctaatgtcacggatcatttctaaaattagtttttatgtggtttatttttaattaagttttatgaaaggatcaatttgttaaattatcggtatattaccactatacttttcatcttaaaaatacttcagtacaagcaaaagcttcgactgtacaagtatacttatctattggcacacatacctactatttacatacacttctattatagctttagcatttatatttatagtcgactaaggcaaagtttgagaaggagatagagaagaatgggaagatacgtaaaatgaggtgagctattagtgcatgattaattgagtattaattattttaaaatagattaatataattttttaaatcaactttcctatatataaaatttgtgcaaaaaaactcaccgtttagtagttcgggaagagcgcgcgtggaaaacgagagaaatcttctctctgtcacccctaccgaacgcagcgtaagtgttcttgcagataaacaaaagttacattaccatgatggccattgccaattcatggacttaaaaatagagaaaattcttcatataccactcaaaatttatgaatttccttatatgccatccaacgaaaatttacatcctttatatgccactattgaggtcaaactgtcttaccttgtcagttttttttttgcgaagcagtagcatataaagaaatacttccttcgtattttaatagatgacgtcgttgactttttctcacatgtttgatcatttgtcttattcaaaaaatttacgtaattataatttattttgttatgagttgttttatcactcatgatactttaagtatgatttatatcttatatatttacataaaatttttgaataaaaagaatggtcaaacatgtgagaaaaagtcaacggcgtcgtagtatcaactttttgatggtatacaaggaaactagtgagttttgagtggcaaatatttgagtgtgttctgtaacgtgtttcataaaaatgtacttccaaaattggcttgtgtggagttgacttggacttggtgggctcgacctctagaagcatcgatctcagtaatgtttcggtcagccatacaggcacatataatatacagtattaattcatgtaagatatccatactccatgtagtagtacaagtcaaaggcgatccatccaatgccaatttgtattttttcttttagagaagttctgatccattaccgaaaggacatgcagaacaaatgctacagcacatcaggcttcagcttgtgggcttgctggctcaaatctatataacctatacaatacaaatgatcctctcatatagtgtagttattaatattttttttatgtggtgttttcacgtcactttaattatctacaagccacataggccttgtttagtttgagaaaaatttagatttaattgtcacatcggatatacagacatacatttaagtattaaacatagtctaataacaaaacaaattacagattccgtcaggaaactgtgagacgaatttattaagcctaattaatccgtcattagtaaatatttactgtagcaccacattgtcaaatcatggcgcaattaggcttaaaagatttatctcgcaatttacacgcaaactgtataattggttttattttttatccacatttaatactccatgcatgtgtccaaacattcgatgtgatgggtgaaaagtttttgttttgggaactaaacaaggccatagtcgcgcatagtcgcgcgttgcgcgactgttgattccgtataagaactatttgttatatatgaggttttagcatgaattaatttatttacaaagtatctattggtctagctaactatacatttaactaaattgtactatatgagaaatcactataagcttcttggtttttattttttttcattatctttgcctcctctctctctgtaccatgtgccctagaaatctccggaaatttccatacgtttatccaattgttattttttagtgcatatgtaactttctgatctaatggctattatttattcaacggttgatatatttttgatgatgtggcgtgttctcatgtaagaaagcttgcagctttcactatataaaataacataagataagatatcaattagaatcacacttaattaacgtcggagatcatcccaaagtcatattattattgatcattggattattttttgttggcttatatttctattagtgatacatgtttcatcccgtgcatttctttctcctcatcatggttagcataaccatgcaacctcaattaatcaagcaaacaatagggcaccaataccatgcataaatctaaacagtcctttaccatcttgttttcaatttgtgtacatatatgcttaatgaacatatcacatgtatatgatagcctatgcatttatggttgtctctaaattatatttaaataaaaatgatcttctgttttaataagatagttcaataatcgatctttcacggtatcaacatactatcataataatagtatcaatttttttctatatgtcaagtttttcttataaattataattaatattttgtatttctattttgacttaagttatagccagcatttttatatatacctaatttcttgtcatcaaaattgcaaacgtaagttttattggatggcactaggtgatgcatgcatggttgtgggatgttgggcctggatagtcggcactaggggccggccaccgccgccacttgggggaggggagggattgatggcgcatggacctcacctccggcgccgccactactttaattttttcgatcgggagaggcgcgagtgttggggtgagaagcagcacaatatacatatatgtactatgggccgatgcacaatatatttagcgggccgccaattgaagcccatttctctggctaactgcacctaatagtgtcaaacttaagtgtagcggcaaaatggacatatccgagggatgattaattgttcctagcagatttgaaaccatggaccggatccacagcgacgacatggtgatggtggcatggctgtggaacaggctagtcctcttcgtatatatacatgtagcagcggttacagccaccctaaaattctcagttcaaatctttatatgagcgaatttcaaattgggttgttgtctgagaggctaaggttgtgttcgtttcaggaggatgggaactaattcctcccgcacggaaaacagaacgatccattagcgcgtcattaattaagtattagctatttttttcaaaaatgttttaatatgattttttaaagcaactttcgtatagaaactttttacaaaaattgtactgtttagcagttccaaaagcatgcgcgcggaaaacgagagggggagttgggaaccccgagatttattcaagagtactcttggcagcacggataaatattagatgtttatttttaaatctagcggtagtttacagatttcactacataagtgatttgcgctactaaaatcttgaactcttctatcaaaagtccatattcacacccaactttttgaaatatgtagctacagaatccataagataaattagcagccaggatctggaaaactcagtttttcagattcttaactagctaccaaatagcaattctatgctcttccaaataggtctgaacctccttatccgttgggttacattttagctagacatgtttggttccatctccctcctggctcttccagtaatatattggatcgaaaagaagtatgacgagactaattggagaattccggccgtcacctagacatcccattaattatttaattaaaatttaaagttagacctgggcgatcgatcgagtacttaaactgatggtacttcagttattagtcgtcaaacctggttaggcgaagtgagactttatatgcaatttagtgccctttataataaagaagaaaagatgagatcgatgatgtgaagttaggtccatcatgtgtacgtgtgttctccttccagaaaagaaatataatcaagtccacacaaagggcataattaatctgtgatctaggccacaatgaaattagtggaaacacctatacatatcaacaacacaaaagctaatctctaattaatacatatgtatactcacatgaaaaggacgacactacttagaaaattgattttcataggctgctcatgtttaactacgtatacgtattgttatagttttgtttggtgaaattataagcacataatgatttaatttattccataaatgaatcatgacattccatatgtaaactagcataaacacatcattagatctacacatgtaaactaagcagtaaaacatgaacagatcaaatatgcgcaacatgtcgaacacgtaccgaggtggcggaaataccggttgctcggcaggaactactcgcggttgtgggcgtcgacaaagacgcgcagcacgcgagcggagaggaaggcgagccgtcgcggacgaacagggagcagtcgcacgaagcgcttcccaaaaaccttattgccgccttctctcggtgcaggacgtcgaagacagaggttccggagacctgctctcccgatcgccggtgcacgccggcgagcgggatggagtagtctacgagcgacggcgcaccacagagtaggaggcaaaccctagattgatttcgcgtgtgttgcgtgaaggcggcggctcggtttatatagagataggtcgcttgatcagggcgcccgcacgatctccactccacgtaacagaaccggataagtcgtgcgtaacttacccggactccacgccgttttcacgcaccggatttttcggaatgtttccaaaacaaaacaaatccgaatttcccgtagcaaaacaaaactgcaaaaggatgctgcatctacgcaagggtgaggagccaattttgcggaccattcgacgcgtacgccgtgcatgcgcgtgttccccctcttctctacaccacacatgcttcaagtggctagtagggaatcctcccttttaaggagatccccctctcctagaataagcaatgtggtactaaactccacatgcatgccatcccatgaggtgggcttttgtgatttttaaaagaattaatctttgagtggggtttagcccatccattaattccaacaatcccccaccaaatctcaaaatcccactgagatttgccttttccaatgtactgtttatataccagcggttcgatggagaccgattaaggttgaacatccatctagaactccaagctacacttactcaacacttgaacaatggactacaccttgaattgcaagtcttgtgcaagcaagtttcactcagagtcttatctggtactagaccgtctataaactacccctcgggtgtagcgtataagtcatactcctaggtctttagtaagcttcctagaagattcacccaaaatctccatagactgcgaccaacagtcaagctcacaaaggtgagttctttcaagaatgctctgcaagacatcatcttcgctaattaaagccaatagaactcattaagtcatagccaagctgccttgcagctcatgagagtacatgcatcttcacttagagagagtatagattagtactctcctctagtttactaatggtttgttcttcccatattctaattcacgagatcttcgatcacatagattgggttacaaccatagtataattcacatgggtctcaaacccatctccttcgatgcattgtctatcacatttcgtgatagtcccttcgtgaagggatctgccaggtttttagctgtttggatgtaatccaacgttataactccgaagtttctcaatttcctgacagacttcaatcgtcttttcacatgtctagacgatttcatattatccttataactattcactttgacaattaccgtttgattatcacagttcataaggatagccggcactggtttttcaacaataggcagatccattaatagatcacgcatccattctgcctcaacagtagcagtatccaatgccgtcagctctgcttccatggttgacctcgtcaaaatggtctgtttggaagacctccacgaaacagcaccaccacctagtgtgaagacatatccactagtggctttgatctcatccacatcagagatccagttagaatcactataaccctccagtaccgcatgatacccagtatagtgaagccccaattccatagtaactttcagatagcgcattactcgctcaagcgcacgccagtgatcatctcccggattagaggtaaaccggctcaacttgctcacagcaaaggagatatcaggcctagttgcactagccaggtacatcagcgagccaatgatttgggagtattccagttgattcctagcaattctcttgttcttgcgaagcaacaagctaggatcataaggtgttggagaaggcttactatcaatgtaaccaaagtgattcaagatcttctccacataatgggactgcaagagtgtaatcccattctcacctctaattagctcaatgtttaagataacatcagctactcccaaatccttcgtatcaaaattttgagacaagaatgatttaacctcatttatcacctcaaggtttgtcccaaatatcagtatgtcatcaacatacaaacacagaataacttccttacccccaccatgacaatagtacacacatttatctgcctcattgactgcgaagcctgcagatgtcaatgttttgtcaaatttctcatgccattgcttaggagcttgtttcagaccatacaaagacttcaacaatttgcacaccttgccttcttgaccttcaactacaaacccattaggttgatccatataggtctcctcatccagctctccattaagaaaagttgtcttaacgtccatttgatgaacgagaagaccatgtgaggctgcagggaaagtagcacacgaattgtggtcaatctagcaacaaatgagtaagtgtcaaagaaatcttcgccttctttatgagtgtagcccttagcaacaagccgagccttgtacttttctatagtaccgtcaggcctaagcttcttcttgaacacccacttgcaccccataggtttacactcatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgtcatcctcctcagtgacatgttcatgtgtatgttcagattgttctggtggtgtgattgaactgggaattatttcagcgggttggctataactactatgtgtatccttcattgggaagaagctctcaaagaaggtagcatcacgagactccataattgtaccatgtcaggtacctcagatttaactattaaaaatctataggcaatgttgtgatgagcatatcccaaaaagacacagtccacagtcttaggtccaagtttgcgcttcttcgttattggtacattgaatttcgccaagcacccccatgtgcgcaaataagaaagtgatggttttcttccaatccatatctcatatggtgttttgtccttatttctgttaggaactctgtttaacacatgattcgaggtcaacaatacctcccccaccatgccttaggtagtcccgcgtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctaagtctttttatctttctgtcaagttgattttcaatttctgccttataaattttaaaatagtttagagcctcgtctttcttttcaacaagtacacatagcaaaatctagtagcatcatcaatcaacgtcatgaaatattgttttccacccttcatcaacaccccattcatttcacaaagatctgaatgtaggagttctagtggtgccaagtttctctcctcggcagccttgtgaggcttgcgaggttgcttcgattgcacacaactatggtacttagaacctttgacaatagaaaacttaggaattaaacacatgctggaaagccgagacatcaagccaaaattaatatgacataaacatgagtgccaaacattagcctcatcatccacactgccacaaatatggttcacagacttattttagaaatcagaaagggaaaagcggaataggcctccgcactcataacctttaccaataaaatatccatgtttagacacgactactttattagactcaaaaaccaacttaaatccgtctctagtcagacgggagccactaacaagattcttgttgatagaagggacatgctgcacgatctttcccgaagtaaacttcagatctactgtgccaacaccatgaacagaagcatgtgacccattccccattaggatggtggaaccccgtgcgacctgataagaagaaaacaatgagatgtcagcacaaacatgtacattagccccagtatcaacccaccaattagtagactgattaactgaaaaaacagtaggtaaattaccatacccgctttcatctccagtgttgccaatggttacattagtagacttagaagtctgccctgcaggtgccttcatccccttgcgttgtggacacgtcctagccagatgactaggttggccacacagaaagcaagtcctctcatcctgattagtattattgttgttcttcttttgcttcttgaagttggtggtctattgagctttgtatttccccttgctcttattctgggccttgtgcacaacattggcactaaactgcccaccatcgcccttagacatggtgtccttttcccgagctttttcgtcaacatcaagagacgctatcaactcctcaatggagtattcctgtctcttgtgtttgagtgcagtaccgaaacccctccaagatggaggtagtttcgcaataatgcactcggccacacatttgtcgggtaagacacacttaaggagttcgagttccttagccatggtttatatctcatgagcctgctcgactacagaacggttgtcagccatattgcagtcatgaaattgctccatgatatatagatcattgctagcatcagtagcaccgaatttagtattaagtgcatcccacaactccctagcgtcggtcatacgcatgtacacctcgactagacgatcaccaagaatgctaagaatgcatcccacaaagagagtagtggcctcatcgaattctttctactggtcagcagtaagaactcccataggtctaccagcactcacccagaagcatttcgtagctgtcagccacatgatgaccctgatctgccatctcttaaagtgcacaccggtgaatttttccggcctcagtgcatcggcaaaaccagccatagtaaaaccacagtgcctataataagttttttggattgttgaaattataagcacataatgatttaatttattccataaatatatcatgacattacagacgtaaactagcgtgaacgcatcattagatctacacatgtaaactaagcagtaaaacatgaatagatcaaatatgcgcaacatgtcgaacacgtactgaggtggcggaaagaccagttgctcagtaggaactactcgcggttgcgggcgtcgacgaaggcacgtagcacacgagcggagaggaaggcgagccgtcgcggacgaacagggagcagtcgcacaaagcgcttcccaaaaaccttattgccgtcttctcccggtgcaggacgtcaaagacagaggttccggagacctgctctcccgatcgccggtgcacgccggcgagcgggatggagtagtctacgagcgacggcgcaccacagagtaggaggcaaatcctagattgatttcgcgtgtgttgcgtgaaggcggcggctcggtttatatagagataggtcgcttgatcagggcgcccgcacgatctccactccgcgtaaccgaactggataagtcgtgcgtaacttacccggactccacgccgttttcacgcaccggattttttggaatgtttccaaaataaaacaaatccgaatttcccgcggcaaaacaaaactgcaaaaggaggctgcatctgcgcaagagtgaggagccaattttgcggaccattcgacgcgtacgtcgtgcacccgcagggtgaggagccagttttgcggaccattcgacgcgtacgtcatgcacccgcgccgcctgccaggctaggcgagcgagcacgcgcgtgtgttccccctcttctctacaccacacatgtttcaagtggctaggagggcatcctcccttttaaggaggtccccctctcctagaataagcaaggtggtactaaactccacatgcatgccatcccatgaggtgggcttttgtgattttccaaagaattaatcttcgagtgggccttagcccatccattaattccaacactattaagtaaaaactttaaccattaactattgcataaagaatacaaaatgtactatcaaacttagtggtaggggtttattattgaccattttcattagtattacctcatatatatatcatgttgatcactcctcatgtcgcgacgaagatgtcgatgttgagcacacttatccccaattgtcttgcgtatccttgacattgttagtagaaaacaagaaacataaacgaaagtatacatgttcctatttactactaggtagtggaggctcaaaagataaacgctcaaacttttaaccaagctcttacaagttcttactaatgtaagaggaatggtgatatacaccagcgcaaccaattaccctaatgaaggttggatgtatcgatgccttggcaaacacttgttgtgcggctgcaataaaatttgtggaggtgtaggtaggcttatatatgtagcaaaggaatagcaaatactcaaatcagagaaaacaaagttgaatatcgttcaaagacagtaccgtgttggtccttggctagaacgtactaagagacgtgagcctagacacagatgataccacaacatagcactaaaaataactaagcacaactctgatatatgaaagcaatctcaaagataataattaagtgattctctcttttcattccttcttctttttttctttctttttttcattctgctcttttcttttcttttatgtgcggcttttcttttctatttttaagcaaaacagtctcaagaacctcactgcaagattacatgtactcaaatgtaaatataaaaattataaggacttaaatataaaagttcaaacccaaagatttgaactatacaaaaaaatgaagtgatgaagctatgtcagttccatttttgcaaacagattctaaatccgatgacgaaatttttttcatcaaggtgtctagtaactcacggtatggtagaggaaacaaccgtactgtgggggtggaaggatacggtcatttgtccagatttggtgcacaagcacgagataaaatggaaactgacttttagccgatccaatctactatttctgcccgaactgaacataagtacttccaaaatccgttatagtctcttcttatactttttgtgcagcacaaaaaagcatggcaaaaacacacactgggcaaccctatatcaactccaaaacctatcgacaataccctaatgacataaacttctgagaatcgaaccctagcagcgagatgattatgttttcgtaggtcccgacgacaacaaagacacgtcagcgacggtgacagtggtagtatacgtgatcagaactagaaaccctaaatggactggacgctaagaccaacaatacgactcgacgatgcattgcaaaactcaacaaagaaaataccaaaaataacaattcagtggcacaaatatggctagataaatgatggattttttatggttattttcttgttataggtagataaaaattcactaagcaacgaaagctttgataccacttaataaaccctgagctgcacttgatacgctcacggctctggttggcttgatctttcgatgagtggatgattacaatttgggagaagcactaacgatctgactacaaccatacaagatgttgtgttgtgttttagcgaccaatacacctctccgtgggttgttgattttgttggtgcgaatcaaccttatgcctacaagtaaatcgaagaaacaagcaagaacaacacataaacaatctggtgttgcagataggaattgaatacacacaataagttggggttttaaagatgagtacttaggcggtctagccgacatgcgtaactagaatatagagtagcaatagctaaactttaatctaaacaaaacccgagaaaccatgaagaggtatctagctatttaaagaagtgggaggatgaccaagaggttctagtgtcatgcttcaccagattggggtgcactccacatgggctgcacttgggccaggtcccaaatgaagttatgagtccataagaccattataggtgatgcaacaccttgtttttgtgattgcggtcaattgagatggaatttggagatgagactcgatacggatccaaagaggacacctagagttttccatcaagtactgacgggccgaaaataaagctcgtatgcacattctatggctgtttgaagaaaacaatataagcgggtggccgaaccagattgcaccacttggaccgcttgatcttgatgtcttcaaattgatccatgatgcgaacaatcattgtatccatagtaggcatgatcatgtcatgggcactccttgcaagactgttgcagaggccatgccgtagtgccacctcatgtcatacattgctccaccacctaatctgtcaattgtcttgaaagtatctcttttactaacaatgtaaaaggcaattgtaggcactcatataaacatacgcacactcactatatgaatatacacacatatactctaactctacccatatgagagaaaaatataaagattgctttgttcataaagtaatctttggtatatatatggtgagatagaacttattttagtattccttttacaaatagttaataaagggtttagggttcattgttagccataaagggtataaaggcctaaaccctgtatacgtatctgcgggtgctttcttcctagttagtcataaaggccatgcatccatccggttcattgttgactttgctggtgaatctcattattccattatcgatcgatcgtattaattagcctattaatcaaaacacacacacacccgcgcgcatatattaatttatagagtagtatacacacacatatataatgatcaatctctgcaactttcttctaattaattaaactgcataatatatgcaacatgcgtacgagcatgtgcagtaggccaacaagctgcatgcatttgatcatatcttcatttgccatatactagtagtttaaaattaaatcgtactacgttaggacagatagatagaggccagtgcccctagtaagagctacttcaggtgatatacgcaatgatccattccatttcttaaatctggcgtaaaagttagagggtgatgtggatggaggtggaggtaaggtgaagagagtgatcgatgcagccatgcagatagggacaacctacacattaccgatgatatatagttctacttgatcatagaaatatatgttatgaaagttattcttatagtgaatccaaaattatgatgttatacttatatgaatatttaaaaattaatggccagagatacaaatgttaacttaaagatatagaacgataagaaattaatttgaagcgcagagagagacgtaatttaggaaaatatctattatataataaaagttcaatctttcaaacgctctcaagctgctacgtagtgctcccaaaatgcttttaaattatcacatggtgctttaataaaataaaaaaattctaaaaattctataaaaaagcaatagcccttaattttcacttaaattagtcaacacattgttttataacattagcttatatctattgaaaaaaataatccctccctcctaatatcaagaaaacgtacttacctaacctacccacaaagtgtcagtgttacaacctacccacaaaatgtcagtgttacggattagttatacctcctatgttttaatttgtagccaccaggaataccgcatatatagtattatacataaaggtatattcaaatatggggaatataatgga

SEQ ID NO: 65014 - DNA, 9204 bp, Oryza sativa
cgcctcctcctgctgctcgccgtccccgtccgtccccgcgcaggcggcggcggcggcgctgtcgtccccggtgacgacgagcacgttcttgacgcggccgccgagtgtggtgatctcggccttgagcgcgcgcagccggagcgccttgagcgcgcggatgaggtccggcaggaggtcggtgcggtcgtcgcagcagagcgacgcgcgcacgacgaggcgcccgtcctcgtcgctcgacgcgtcgacggtgagctcgtccgactcggtggggagcgggcacgcctcctccgtgatctccgacgtctgccgcttcagctccttgacgtgctggatcacctccgcgagcagcgacgccttgtccgtctgcacccacacacacaccgcaccaacatgtaagcgcgcgcattgtcgatcaatgagtaaatcacaaggaagaaaacgcacggcggcgagagctcgatcagccaagcagcagtagttaaattagttaaactgctgtgtctaccgcgtgctaatgggggtgggcgaatggggggaatgatgagatggaacggatgggggggagtacgcatgcagggtgcaaaagggcttagggggccggggcgcggtgcgtgccgtggcatgcatgcctcctctcctctcctctccgatccaagcgtgggactcacactactctcgatctctgccaactaggagcacaaacaccgcgtaatcaattgcaaaacgctagtgcgtgcatggcctcgcagctagcttagctagcatgcatgctgttgatggtgctcgcacgcacgcgcgcttccacaagcgagccgtgttcgtccttttggtgttaagtggggcatctaaccatcaccactccccattgtttatacttcttcccttgtcacgccaacatgcggtcgtcaaatctgccgtccgccatctcgcagagtactactactaggttattggcgaatctggaacaaataatcctatgtacagtgcactcactaggcacttggaaatccataacgacctttcagcctacatatagatctaacagaattttcttttcaggtaaagaacagtagtagaaaagtaaaagtttcatagatgcaaaaagggaggaagagtgtactcctatatattgtttccctcgataacgataatgtaacggtttaattagcacaaggcaggcagggaattaggctgagtggcataggataacgtgagtggttttggagtaggggctcgcagagaatatctgggttgggattcttggaagtagggggaggtagcaaagcaggatctctcgagatggtcggctttctttttatctttgccgctgctgctgcctgcttctactactactagctctcatctgtgtctgacacaagctctcgtgtttgtctctcctcggagaggccagcatgaactcctgcgcgcgtcgcaagcttttcgtgtccttcctggtctctcttttgcgcgtcaactaggcggctcccctcccttcgcttgtctcctagctcccccctatttactagcagcgctatcggatgacgagccagtgccagccatggggttcgcgcgtgttttggttgggtcatgtagttgcaccgtggggatatgcattgcatgaatgaatttatgacggggatatggactgtactactactaccttggttgtgttggggaggaggctgcggaggcgggcgaggtgcgcgttgatccgctcgcggcggcggcgctcggcctcgctgtggctcttggacgcggccagcgccttggcgtccatgatctcctgcgcggtcatccggccgaggtcgccgaacggcgacggagcgaagggcggcggcatcatcatgccggcgacgtgggagccgtggtgacccatgtagagcccgccgaggccgagcgggtcggacgacgacgacgcgccgccggagtggtcgtacgcgtactggagcgcccgccgcgcgtagaagtcggcgaagaacgggggtggcggcgggggctgagggggcaggggcggcagcagcgggaagaacgggctctgctggccgccgccgccgcctaggttgtggtggtggtggattgcaccgtggacaggctgcgccggcggtggccagcacatgatcggcggcggccccatggtggcgctcacgctcccgacgctactggtcgcctcgaacaccatgccggcagcatcttggcacactccaccaccgtctccccccacctcttgctccaccacgccgctcgtcgggccaccgcaagcctgctcgatcacctcctcctcctcctcgtcgacgagcaccccggcttcttgatggtggtggtggtggcggtggtctccatgagcacccatctatcaaatcgatctggaagaacgcaacacaaaccgagccgcggggatcgatcgatcgattgaacgctggacgggcagcgtagtacccggggcttgcgtgtgggagggagatggatgcttcggcagggtgtgtctagggctaccttttgtatagggtgtggcatgtggcagcatgatgcgcctttcggcctttttgtctttcgcttatgatctcgccgggcgctcgcaagaattatggcggcctcccccctgattatacatatacaccaaaaggcctcgccttttctcgcttcattcgcccccggccggcgggggtactacctctagacctggcactgaccggccctgacctgatggtagctactggtgttacttggctgccacgcctttcgatggctttgtgggggcaaaggctagtagggtaatataattactaggctggagtaatggagacaggaggggaaagggagtgtggaaatggagctggtcgatcaggcctggaagatggcaaaagggcgctagctgggaaagagagaccgagagtcgagggaaaaggcaaaagattttgcatggaaggagagagaggacgagagagtagaagagtcctacgtacagtgcagcggttagtagtgcttgtgtgtggatggacgcctgaatggctcggtcaaggcccatgttctgcagcaccccgcgctccgctttaccaatccacgcctccccgagagacacaatcattttgtcttggaatacactcctcgcctgtggctgtggtgtggtgcatgcagctagccagcgtacgcttaacatattggtttttaccagagcagctgcgtgggcgcaggattatgtattgagcgagaaaaacaaaacaggatccacgcaaacagcgggctaatggcagcactcatgccccatcgatcgacaacggcatggttatcgagttcaaatcttagcccatgattaagctagctatagaactagtagctccgtccaggcaaacgaaaacggaatgcgatccccggccacgtccccggcccggccggccggcgccaatcgccatgatgcccgccaggcccccgcccgcgacgacacgatcatgccgccgggctggcctgtgtcaattttagcgcgggacgaggcgcaaggggacaagtagcagcttcctacagtttcccacctcccctgataccgcatcgatccctctcgccttctccctcgtacaccgcgcaggcgctcgcttcgccggccgcgcttgcgtgctgcgtgttcggcaccgtgcagtgcccaacttggcgcaggcgggcgggcgtaatctcgtatctcgtaccgtacgctcgcgcgcgcgcgcgcgtcaggccgacgaccaggcacaggcgcgcgacgagtggcatgcgcgcagcccggctgggcgggcgctgcatgcatgagctcatggccatggaccatgttgtgtgcatgcgtcatgcaacgtgatccatcgcgatcgatcgagtggtggttcgagctagcgcgctcctcgctagctagcagttttgttcagagcttggctgggaaatgcacgcatgcatgggggagagagagagagagttggcccgagatggatcgaggcaaaacgacgggagagggctcatcatggcgtggatccgccgcattcactcctccctagctagctcgttgtctctcgcttctgtgttcttcgttggctagctactccagtataggactgaaaacggggcgggtatttcccgaccgcccgcccggccacattatttcgggtcaaattcgggtcgggaattcgggtacccggacccttacacggatacagggttcgaatacgggtaattttttgcggatatgagatcgggttcgggagagcggtatccgacggatacggattatccgggaaattatgcgggtattacccgataatctatccgtatattacccggatagatggacagcagcccaacaggcaagcgcccaacaggccaacacaacaggcaacagccagcccacatccaaaaggcccaccaaacaaagtgccaagcacaaaccctagccttcacttcacagttcagatcagtacagcattgagtctgaagctatcaagctatgaatgcctacttttgctactactttggtatagttttgctgataggcattacgatgccataagcccctaatatattcataatagacatataggaaatggctgaatggctattgtctatgtggtatatttggttgttgctttgacttgatatctgaataaatattcgtaaccgatatagttcgtatccgtcttggtacgtattcgttccgtatttatgcccaatattatccgtacttctattcgtatccgataatatccgtgcccgacccgattccgattataaaatatgggttaggatatgagaaggatgagatccgaccgaacccgacccgatttcacccctactccagtatatagagagtactggtactactgcgttactgtgctgtgcctgtatttatgtttctcgggtgtatcctcacggaaatgatccacctgtagggacggcccactgcgtagttccttttgccgcctctgggcttcctttgcggaaattggaagagcaatgtgcgtgaactgtgaaggctaaaatgaagttccagatctccggatcggtctccacagctcctttttgcaggttttattctctaaaaaaagttcgttttgcagagggtatatatatatatattccagttagtagggggctcaaaagtgaagaggatagtttcttgatagaatcagtggccagcctgaattaattttgagcggcctagtttggatagttctgcatacctttattttagatagagttcaagagagaagcttcgtcagttggattgggcgttctgaggtcaggagtatgaggtaactgcccctctgatccatgatgggctatatagccggtaagctgtatctcatcggcctagtatgtcttttttttatatataatggaatagagcatcccggcctttgctcaaagagctacagtcaattattacaatctcacactcaaaatgagtgaagttcaaagaaacttaaaagatgaaaccaaccatcaataagaaacaacctaaagactgccaacccaagataaagagtacataattattgaattctatttgtgaacctccatccaaaattgacaaaaagttacataaccgttgtctcaagaatacggcatgcagcctttaaaagctcactatcttcctcacacttttgtagttgtgcccaaaaccggagccaatgtgttgtcctgaaaactacttgcatatatgaaatagatggtgacttgtcaaaaatgacatcattcctactcaaccatagagcctaacatatagcagatgctcctatgagaacaagttttcttctttttttttccacccccagaagccaattatcaaaaatatgagatataccatgaggaaggtaaagaccaaaagaaaattgaactgctctccataaaaactttgcataatgacactctacaaaaagatgttgagtagtttcatttttcatacagaaacaacgtctcaagctaccattccaattcctccttgccaaattatctttagttaatacaacccctttaagcaagtaccacataaagatcttcatcttaagaggcatcctaagtttccaaataatcttgtttctctcaatataattattgtttattaaggctaaatacattgtccgaacagtaaattgatcattttgatgataattccatctaaaacgatcattcagttgactcaactgaatatgcacaatagaagcacacaagttatgccaatttgctaaattctgaccaaccaaagctctcctaaaaaaaacattcagcggaacagatctcataacattagcaattgaagaattcttccttcgaacaatggcatatagagacggatacttatctttaaaagccacgttacatatccatttatcttcccaaaatctagtttgttccccattattcacaatccaggaacccatattcaagaaagtatttttaactttcatgagacctgaccagaaatgagaatcccctggtttcctatcaacttgagttatagaatggttagagagatacttccttttcaataagtcctgccaaaccccttgctcatttattaacttgaacaaccatttactcaaaagatatttattttggatctccaaattatgaacacctaaacccccttggtctttgggttgacaaattatatcccatcttgttagtctatattttttcttatgatcatcaccttgccaaaagaaacgtgatctataataatcaattttttgaagaactccctttggaatctcaaaaaaaagatatcattattttccgttggaataaatacattatttttcctccctcatctctagcccttgatcgaatcgcattccttaaccgcaaatccggtgaaaattaactccttcgatggttttagagaagtggttttgctgacgtgctatgttaacttggtccaagtatgctgacatagcaactcaatcgtcaaatgaattaaaaatagaaatggattccacatataattaagtgacaaggataaaaacataaaaacaatggagcctacttgtcagccccacttctccttctcttcttcttcttcctctcgcagtcaaagcttgcacgcgcggcgatggcggctacggaggcaagcggtgtggctagggtgggagggagttgggataaggagtgtggatgggcgttagtgaacggtggcggtggtgacaatttctcctcccctccctctccctactctctctctctctatctctctctcccagcggacagaaagacatcgatggtgatgggggacggtgggttggcgagggccgcgttgtgcccacgacagagccccgccacatcgcccataaatctcagttgcgttgcccggatctaaggagcagtggagttgcaacagtcgattcctcctaacgacgcaacgacaaacacaatgactgcaacggagacatcgtaatccccgaagataggccaatgggaggggatccggtgacgaggagcgcacgaagtgggtgttgttgcctagtaggaggggatccggtggttgccactctattagtttcacaccctatggaggctggctcaataagaactagttgtggtaggaggtgcgcatccaagcattgaaaccgccacatcagcgtgcggcagcctggtagagctcattatcgctgggatgggagggggaacaagaggttggggatgggagtggagggggaggggaggagaggaccgcggatgaccatgtcatcgtcaaccgttgtcgcactcaccgatagtcgctcgagttcatccttcggccgtctctgccattgttgcccccttctcgtcgaccgctgccttcccatggatgagctggcgagcttgtcaaccgccactgtcggagagaaggaggaaaagagactgacatatgggtccattattttctaattttttttcactaacatgtgggtcccattaaatttttttatttttattttcgtggcacaggttccatttagttttttatttttattttagcgccacatcattgtcacataagacgaagaccaagtcagcatgccatatggatgccacgtaggacaaaaacactagccgaaccgccgagggactcgatttgcaccggttttcaaagatggaggatgcgttatatccagtattgcgatttgagagacatgattccattaagggcagaagttgacggattgagagacgtttctattgttttctgcacacacacttcccgaactactaaacagtgtgttctttcaaaaaaaaatctatatggaatagttgctttaaaaaatcatattaatctattttttaaatttaaaataattaatattttattaattatgtgttaatggcttacctcgttttgaatatcttcttagtcattttccccttcctctcaaacacagccttattcctttggaaaaagtccactttgactcccttaattatcggcggaatctaatttgtgaccctcaaccgcaaaaccggataagacgactccctgaactattgaaaccggttcaatttgactccctcagcggttttggagggcggttttgctgatgtggcgctgacgtgtcgatgttgacctagtattcgtctcacgtggcgcttacgtggcattcaaattaaaaaatatatgtgggacccatctgtcattcacacagaataaaatatattgtggaacccacatgtcatcctctcttatctaccttcttcaacctccccctctctttctctctctttttgttcgcgagcgtgggatgagggccagcggtgggagggtgggcgggcgaaggccgaagcagggtccagatcgtcggcggcagcggtggacgggggccggagcagcggtggccggcgcctcctccaaccccatcccggctagagttcacccagcccggagcggagtccccctcgccgcctctctttctctccccccgcgagtcgtcgacgtcctcgcccgtccctccccacggcgccgttgccgccccgcctcgtcgctccaggtgccatggagctcgccgcgctctgcaccgaccccgtcgtgctctccgccgccttcctctgcctcctcctccacctctccctccgctcctactgcccgccctcccccggcggtggccgcagcctcccccgggacccccgagcgtccccgtcctcggcgcgctgccgctcgtttgcccggccccgcacgccgacctggtgtctctagcgcacaagtacgggcccgtcatg

SEQ ID NO: 65015 - DNA, 706 bp, Oryza sativa
catattttgtcagttgcaggttcaaactgactggcatgctcgcacctcccaagatttggacctgcattctaagcagatcttctagggtagtgtgtgtttttcgcgtcaacacatttttggcacgtccagtgggacacaagttttgcacccaacatgtttgaagaggaagtcaatgctaagaaaaaacaatttactatgtcgatggttgaaacacttcaagctacagtcgatgaagtagttcatcgtgcattgttcgaacaatctggagtttgggtggatatattgcaaaatttgatcaaaatgacggttgatgagttaattgtttaaaggcgccagctcggggggcaaacatatcagtatcagcagtatgttagctgacaagtgcagggagatcgatgtttttttttataaaaatcttctttcagggtagatcgatgttgatctagaccaataagcagattttgttttaaaattctcatccaatcaactcttttttctcctttcacccatctattcttttttcttttcattcttggttcatgcttaaaattggtttcacgcgtgagaaacgatttcatcttttgcccctctgcattaactctcttgtcacctaactttttgcttatgttgcattatatttaacactatgcaaactagctgaggtggatgtttgaaactgtccttagaattagtttatacaaatata

SEQ ID NO: 65016 - DNA, 624 bp, Oryza sativa
taaaagcaggttccatggacggtattaaagagacaacccagagtgtgtcgtcaaagatgggatccttatctcgaacttgaagagacagaagattgagagctgcccatgaggttactggtattttgaactcctccatccattttggattgagtgttttcttgtggatctttgtctggaaacgatagggtccaagatggcctttcacgtatggatcagctaatcctgcacatagatccatcaaagcagcattgttgtgagaatcaactaaatatgaacaaggaccagtacagtaattcaacagagaatctcttgtggaattttcctagtcaaatatactatatatggacgggcttggtagttgagaacataccatttggatcagagggtttcatatcagcaccttccaagatctctaccttggcatgtgcaataggtggcttctcatcaacactaaaccagctatctgacatatttggataatgaatttgttagtatcatacaatcatcattgaataaaagcaatttgtgattcaatatactatcagtgctgtgaacggtattcaagtttgcttgtgactatgggtccatgttccacatgccatgtttttttctgactgctaaatt

SEQ ID NO: 65017 - DNA, 1977 bp, Oryza sativa
cccccccctcaccagtacgccagtgtgtattagtcaaaacatattctttcacataattggtaattaagtgcttccatttcattttttgaaattggggcgtttccaaacactggtctttacctttaaagaatgttgtactgtaaaacgtcatcagaagagaaagaggtggagaggaggagggagagacagaaagtgagagagagaaacggagagggggaaggagagacgaagggagaaggaggaagaggcagaaagagacatattctgagagagagaggggagggagtgaaatagaaatagagaggaaagactgaagaagagaaaaggaaatttgaaaagtagccagttcaaatagagaaaagggatgagagagtgagaggaaggataaaagtacatgcaatataaaaatacgaatgaatggcagaacctgctgtgccaatcatcatgacagttaatataggttttcccgcccaacttcgtcaacttagcatccgaattaacgttacgttcattcaacttcgtgcgaaattgaatgataatgtagatcaacattcaaaaagctaattgcgtcattcaatttgatttagtaccatgggattgcatactcttgtcacggagacgtgcaaaacgagcatttaatttagaaaagcgtgcaaagagcattcaaattcgcgccggacagacagtggtatgtcttcgtgcattcaattccgtgattaggcatacatatgtgacatttgtgcattgcttttcatttgatgttaatttgtcacttaatatacttctgtttgaataattttattcaaaatttacttggaggaatggcatgcgtattcgttacattacacaggtaactgtccccagagaaggtgcacaatttgtgacttctcttctaagcacatgctatatataaacagatcttggacagaggtatagttcaggtttaatagacatgatggaaacaaaataaaatgattgtgactgtctgtgaggcgaaacgctgaataattacaacgactcaggtttttacgggaatgtcagtttattttagagtcataaccatccagggaaatgcaactctgtctttgacgaacgaatctttatctttactcctttcactgctttattccgttcttcttcccttcattccgtgaaaactgtacatgataaagcataacaggaatgcataattagtatgtgttcatgaatataagttccacaatattaaagcagatatagcattctactaaatcaaagacattgtctgaattataactccttttcatgtttgcttgtaaatcttatataagtcagacactgtcttgacaaatctatctgaactttatgtagaatgtcacagctaacacacaattaaacttatatcatctctatcatgtctaaaccagatttaacacggtttcaactaaaaatgtgaccatatttaacgagcttgaatgactttatcatagtcaaggaatacaataacaaagtcatgaccttgacctgtcattcacacaagtatgctcacattcctcatcccttttcatcatagaatgtcttattctgcatcatacattttacttgactacccataggaaagaaatgagcctgccgcatactcctgcggcagacctgccgcagacagtcatctttttcacatgcaaattagttttgccgcagacttgccgcagacttgccgcatactctttcagtatgatgaagagtctgcggcagacctgccgcagacttgctgcagacctgccgcatactctttcagtatgatgaagagtctgcggcaggtctgccgcaggcttgccgcatactctttcagtatgatgaagagtctgcggcagacctgccgcagacttgctgcagacctgccgcagacttgctgcagacctgccgcatactctttcagtatgatgaacagtctgcggcaggtctgccgcagacttgccgcatactctttcagtatga

SEQ ID NO: 65018 - DNA, 36356 bp, Oryza sativa
aaatcaatagctagttgtcagatcaattctcggtgaatactaattggtaggctaaatttagctagcttgctccccattgtaattggtatgatacatcttagagctattcaaataaactggattatggctattacccatctaggggcctaaaccagtataaaaatactttgttccctgtcttttaccgcaatcttgcgcatactttagtatcaacgcccacaatactatactaataccgttgtcgagtataacccatcgatagaattggggaaaacatataaagccgagaaaccacactacatacatacccctgcatagtacgatcatagaaaaaacaaccatccttaaactttccatcataaagaaaactacacataacatgcacaattaaaatagtgctaaatacacgacacatggagctaacatgtgttataaaaaatttccaaataatctcaaatcatattttatggtgtcagataaatgggaaccagggtctccatatcagatacttgggcgtacctgccgcctgctcacgaatgtggttccccggctatgctcggggcatatccgcccacagtgtgttaatgccaaaatttgataaaattctttattggatttggttagggaaagaacataatcaaccgatggaaagcttatctagaagaaaccgagttcaagaaagaatcgtcaagaccacgacatggtagcttaatttatctattaattatacatggtttagtatttttcctttttatctttaggaaagtttgattagtgtctgattaagacttgtgtattatctttaggaattgtgagtcatgtccgattgggactcatatcagcccgagattataaatatgtacacccagggtcttcgtaatctatctccatagaccgatgcaattactttcgacgcatcgccacccttttatcccagcgagttattagtttcgagcatggctgcattggttaagttcgatctccggcaaggaagttccatcaactttgcttgtatcagcctggcgagaactttctcgattaagtctaatattctatctaggttgatgcaagcattgcctatttgatatattgattctatcttcaattgcattactgtttagagttgtataatcttagttaggactttcttagttgggtctgatattctagctaagttggtagttctctaattgtactattattttagatagatttattatatccatcacgtttgtatagatctatcggctaagtaggtttttcttattatctttagtcttatactgtctcggtcaggcccaatctattagatttttgctaataagtttaattcttgtaagccggtaaggtttttatgcagcgttcattggagcgctacccgatgttatcattattttgggcttcaactatcagatgtatcagttagttagccgatatacactttaatttacttacattagatctccagccaatgtatgttttaaccatcagatgtacatctaccacattatattagttttagacgatttgttcacattatattatctcattgcatcttctgagttacatcggcttacactcaaacttgtataatctttagttaaatctatatttatcaacttctatcttatattgtctcagtttggtctgatctatcaagattgcttttgataaagaacggttgtttagttccagccgatgataacatagtttagttccagctggtgataacacaaatctcattgcttatctgattatctgaatttacattagacctatagccgattattcaaaaccctattgacattggttggcctcgcaacatcatatcagtttattggtcgattgactccttgatcttatacgatctatctatctatctatctatctatcttgctagttgcaggatcaaattaattgttatgccctacactggagataagcatatttccaaggccttcgtgtgtcacgaagaatttcacatcagcagggtgcaacccccaagggctatgctcagggcacatttgtcacctaccctccgagagtggccccctatgggttgttgttggtatttattctgaccacataatagtctgcaaacgcacagataccgttgtaaccttcacccaagggtattccaaggtatcgtattcacatggaacgtgtgtgtataatctaagaacaagattcttccaaggaaaacaactaaatggtaggtataggatagagaggactcccatgggttagttatcttaatgaagttatggtaaaactctatcaatttcttcgacactggcgtacccctggtctgcgaaggaaactctgccctatagctctaggctggcaccacctgccgcctgcttctacaacccgtgaaacaccaacaaacaaaggtaaccttctacctagataccggtgccggtgacaatggcaacgacgcgctgtccggctcaagtgctagcaacaagcggtccaaatctgaggtatgggccaactttgaagaactctttaaatcacgcaatggcaatcagattcgccgctaaatgcaattattgccataaaacaaatattcacatgcctcccttccatgagatgggaccttgtaatttacttagaaattaatattgacatgaaccttagcatacacattaattccaacagttcgcagacactactgcatcggaaaggaggaggtggccaatgggggcaagctagggcgtggccaatggcagcctcgcattttttttctcgagtggtgtttgaatcttataaagatgaagataaaaataaagattaagtgtttaatgtaaaacaaggtggtaataatgtatgattaattgagtttttaattattacaaactttaaaaaatcgattaatctgatattttataacaactttcatatagaaagttttcacacaaaatgcaccgcttagcggtttgaaaaacgtgccacgaatatctaaaagtttatccaacttttgttggagaaaaaaacagcgccggtcaccattgtaaagggaaaagtgtacgcaagcggctattttaaagaaccaactctgtataaacacatttgttgttacaccaaagaagatgattatcaatgttaatactgaacaaagacttaagatatattgcagctattttccggaacaattagttagtcaattagggccacaaagggttgaatgacccaacaatatagcaccccggttttgatctatttccaccggccaaccatggattttcggctagaatttgagtccagtgatatatatatctaatttattttgaacgcggccatgtggtttttaagatggctacagtaacctgctgtcgcattaaaaatagaaatacgagagtttataatcaaataaggttgcagttagtcactgttgtatggtcgacaataaattgccgtatcctttagcagttggtgatgttttatttttctaacaaaaaagtatcgttgttgtttattgaattttatttattttcttgtcaattggacgtttcggtcggtgcacttcaattccactaagcaattgaagtgaatcggaggtcgcatgcatgacgacgtggccggctggctaatcattaatcacatcaatgatatatacatggaagctactctctctgtcaaaaaaaaactattcctaccactattcctagcattccaaggtaggatttgtgaagatgaagaatgattaaaatgtccttaatcattggaaaaagtagtaaaggtgataggtaggtaaagggtatcgaagggataaaacttctcgttttacgtgctgagggtaagtaggatgatagaagttggttttgtgtggaacaaaatttaaactctagaagttgagttttttaggacggagggaatagagtaggatcatggatccaaacctccctgtaggatgtagtttttggcattttagtccttcaacgaacttattttataatattagcgtcaacctttgaatggtacgcagaatatatttaggaagagaagagactacctgtttttgaagaaaacaggatgtgactagattgtgcacggtagtgtgttagtctgtttatgcgaaaacatagcggcctagaagttctgcttagctccagtgtaggtccaaatatcgcttcggattcagaacatgtcagttggttcaatcctgcaaccaacaagaataacaatatgtttgaactagtaaacgatagtcaattggccaataagccaatgacgtatcgtcatgacctagccgagccgatgcaactgagctgaatcggctataaagtatggaatgaaaagataaatatgaaagatccttacacatgttccatcagcaacagaaactaacaatatgtaatctataattcaagattttcaagcaattgggatagattgaactaaaccgagattttataaactgcttgtatccaagattgaataaattgcaaactacaagtatttgtatcatagccgataagaccgtttaggtaagaaaagataatgtattggctatagctccgatacaaccttatacaaaatatcaatctaaagcaaatatactaaacaagcattaattctaaatatttaaatctggtcaagattgaatacaagcttagcatatttgaatgaatgattttcttatataaggggcttatataacatattaagcaatattaatcatattaaaaaaacatgtaaaacaaatatattaggtaagattggctaaaactcgaatactatccttcttggcaatcaatgagcaagttagttcttacaattccaaacatgactcagtagttcaaactttaaacccaattaatgcagcactaagtatgaaaggaaatataaggtctaaacaatcgagctcttgattgattttcagggtggtagatacccttactaatctaaatcaatgaaaattgtttagctgatgtcggtgaaaccctaacagatcgagtcgattgttaacgccaaaatttggtaagattctttaatggattcggttaaggaaagagtgcaaccagctgatggaaacttatctagaagtgattgagttcaagaaggaatcataaagaccatggcatagcggcttaattctatctattaactagatgatgtcccacgctttgctgcaggatatatgttaaataatggagaaatgatgaaatgatttggatggaaatattatgaaaatgatttgagaatgatgatttagcatatgtatgtttagttttagaatgaagtaaattgtagatataattactatatgcttgcatgttgagctttgtgtgcttaatgggttgatgtggcatgcttgcttgtaggttataggagtgctaataaatactatgcttgcatattgagctgtaggtgtttagtgggcattagctttatagaaagaagggattagacaagatttagtaattcccttttatcttttggaaagtgtgtttagtgtccgataaggactttatgttttgccttttatctttaggaaagtttgtatggtgtccaataaggactagtatctaccaattggtataaatatctacacctgggatccctgtaaactatctcacgatgaatacaactactcggcgcatcgccaccctctttttcgaggtttttacttatcattggtagaacttggcacctgacgtgggctgcatcgacttcgatctccagcgaagggtaagtcctacattccaccggccctagctattgtatcgactacattggttttgtttaaggctgcattgcttcgacctcttggatcgctctggttcggttgatatatttgcctaccaatttatcatatatcttagttaatctaagtcgattattcaactttcttgtatcggtcagaacttttctagggttttgccagtatcagctaaaatgtttcgtcgatctagattagctaagatatctaccaccctgaaaatcagtcaaaggcttgattgtctagatattatatttcttttcatacttagtgttgcatcaattgggtttgacctactaagtcattcttagaaccatagtctctagcctgccttttgattgccaataagggttccatcggggtttcagccgatgagttatctgaacgttgcatcggcttataagaattacttacaagttggttttagccgattgtaacaaaggtgccattgattatctaatcgtttggatttagtgacatcgaaacaccagccgatgtatgctttaaccgtcagatcagtactcattctattatattattattagccgattggtttatgttggattatattattgttttatacattatcatcagccggttgtctttatattactcaagtgtcagaatctacactggacatacagtcgattgttgaaaaccctatcgacatcggctagtatcgacttattggccgatcaacactttgattttcactttataaatcttgtcagttgtaggatcaaactgactagcacacccgcatcttatcagtattttagacctgcactagagctaattaagcagatctcctaggccgttgtgttcgtcgacttagttcgcgccaacacagatctggcaccatcagccgagtgcgtatttttcgtcaacaccgatataggtaaatagagtcatccacttagattagctaagatatatgataatagacaagtcttatatcttgccaaagatcgaagccaatgcagctcgactcgaaacaagaactcatcgagacaaccaaaaatgaaaagggtggcgatgcgtcgagagtatattgaactattgttatcctccttacaagaccctaggcatatatttatacccataatacaaaactcatccatatcagacacgactcaaacttaacctggctcttatcctaattaacagatacaattatccatattagactcgatttcttgtttagaaatatctacaatctcttctctgagtccgacaaaaacacgacttgcttctatcggcaacacttagtcaacatggcaccgccgatgcctaccagctgattcattttctatttgtccaaccgaaatcatgtcgttgatcccgctcatatcttattccttcttttaacggaatatgccaaattttaccgtcaacataatcctaaccagcgaccactccatcgcatatatgaatccccctttagctaaaaaaattacaatggtgcatgtctttttttaacctttttaatgacctatatcttttaaatcacatattatttttaagatctatttgcatcactgtactctactcaaaatatgtgacaaaacgatatccatattgaatacattcaaacattttatcaattttaaataatttatgtaaattgtagaagtaacttagatattcaacaaaagtaactctctatagcattagaaataattacattatgactgagttcaagtaagaaactatgtggagtaaattcacaagtgtagagaagatttttaagtaaatacatttatgaaagttaattaaataaagtttgaaagtaatttttataaatcataaaagtaacttagtaaaaaaggaagtaagttgttacaacattagaagtaaatctgttgtagggataaaaacatgagtttatttggaaattaaatttaatcaacacaaattatgaaattgactaaaagcaataataaaagtatcaactcagagcattatgaatgtatagctagtaatttaataaaatctaaaattaatttatatatatgataaaagtaacttacatatataataaaagtaagttgcatatgtaataaaattattttacaaacataaatattttttcatcataatataatcatgtaagatcttgttataaagatttaattgcaacgaacacaatagtataatcggattatagatctataataagtaatttaagagaaaattttataaggaaaaatggacatgtatgacataatagaaaaaaaacatgcatgtctgtagatatgtagtagtacttctctgttgtatggctggcatcatttgttaagcctagcctatcggagttggattcttgagttggggtttaacagccgctcaagcgaacgaaactagtgtggcggagtgatttacaacgagggcaacatagctctaggtggtggcaaagagaaggctaggagtgtggagattatggataccccatacctccacggcatgtataatccgactgggtatggggtgctgtgacatcctggcccagggcttaataggattaatagaatactcatataaacaagttgcaacttctttttcggaagccaatctcccaagaactccagggttaagcgtgcttggcctggagcaatttgggatgggtggcttggcctggagcaatttgggatgggggaccgaccgggaaattcttcccgggtgtgcacgagtgaggacaaattgtgcagaaaagactattgttggtctgtgagggtagtctatatcctaggatatctgccagatgtagagagggcccggccttggagagtagtgttggtctgtgagggtagtctatatcctaggatagctgccagatgtagagagggcccggcctcggagagtgtgttggtctgtgagggaatcctaggatagctgccagatgtagagggtagtctatatcctaggatagctgccagatgtagagagggcccggccttggagagtgtggggcgtcacagatggtatcagagccaacccttgcagctatacgtatatatgaatatgtacgcgggcatacggtgtatacaggatgatccacgatgtggtcgtatggcatgacgtatgtgcgccgaaaattgtgtgtatatacgtggtgctaataggggacgttcctggcctgggttgaccgacgaggacgtcggtatcttaagggggtgagaatgtgacatcccggcccagggcttaataggattaatagaatactcatataaacaagttgcaacttcttttccggaaaccaatctccaaagaactccagggttaagcgtccttggcctagagcaatttggaatgggtgaccaaccgggaaattcttcccgggtgtgcacgagtgaggacaaagtgtgcagaaaaggtgccatgtatcgggaaattcttcccgggtgtgcacgagtgaggacaaagtgtgcagaaaaggtgccatgtatagatagaatatctttaaagggactcggattaaattccaaacttgtacgtcaaggaaatacccggatcctagtcggttacgattgtatcttatctgtagctacctattccgttaaggatatgggctgtactttgtaatacggaccccttcccctatataaggaggggttcgggtgcctctcggggcacgattttttcccagatcatacgatcaataatacactcggtggatcaatccccggacaggagtagggtattacttcttgattaagaaggcctgaacctgtataaaattccttgtctctaaacccatccacttttccagcttgatagccacccccttttagtattgccgaaatcttgtttcgatagttggcgcgccaggtaggggtagcgtcaagttcttcgccgactagtgcgatgggtttcgtctccagcatcgacgacttcgtcttcccacccgggcaggcgttccagttcggcagcctcgacttcatcaccaacgacttcggcaagatttctctcctcgactcggattcgaaccagtcgggaagaggccaggtctccgccccgttcggtatcccgaactcggccgagatctaccccaagatcatctcaactgagttggccccaaaccactcagacgagatccaatctactccaacacgatctgatcaaggcgatggagcctatccgccaatcctgatgaaactccccgatgatttggctgctgtcttcaccacaagggtgtcttctccccgtaggtctaggctggatccggccccggccccgatccagtctagctccagggaagtcggcgtcatactctagcctctcggcacggtttcgatggaacaactagacggctacctcagctcccctggtgtcgactcacgaccaacggagatcgtggagtacgacgacttcggctaccgctacgaccaccacaagctcgacaacttcaacgaaggctttgaagacaactacacacccctctacttcggcattttcagaaccgacaatgagacggaagaacagcgtcaagcccgagaagcagaagaacagcgcgtgcgacaagaagccgaacgacgccgactggaggaggagcgccaagcacaagagcgagaacggctacagcgtgagcaacaggagcacgagcgggctgcaaaggaggctgaggaccaatgacaacgcgccttggaggccgggcgacgagcacgagaactcatcgggcagcaagacgtcgatgggacggcggtttttcgcaccccacaacagaacgcggatgcagcgatcacccttctcgaaacctcctcaaggaagacgcacttaaccaagccaatcacgtcgtcaacatcttgaaccagaccaagaccatgatcgcagcttcagtcccggttaactccgcgagcgtccgcacgccgactggcaaccgagttccccctcttcgatctcaagactatcaccaaccaagcatcagcgtcgtcagcgtgggatccagtcgcaggagcagggatcacgacgagcgatccgcccactcgcctcctgaccgacgcagggagcgtcgagctgaacgaccccgctccccacatcgcaggcgtcccatcgatcttcgtgatactatcaaccagcgccgcgcgacgagaagctacgtcccccaccattcaccagatcgctacgacgacgacatggatggagttgctgccttcacaagcgacatgcgtcgagtggattggccagtcggcttcaagccgactggaatcgagaattatgacggcaccactaacccagagtcttagctcaccgtctacagcctcgcaatttgcgcagaaggaggagatagcaaagccatggcaaactatctgcccatggccctagcggattctacccgacaacgttcacgtgtcaacacttttgacaagatcatgaattcccaatgtctacatcatccaaattccaatcacacggccaaagattgctttgtctacaagcagttcgcacaataatatgccaagaacgcacgcaagacgactgacggagatcaaagcacgtcaaagaagaaggatgatgaagatgatgccccgactggttttcaagaccatcgcaaggaatttaaccacatctttggcggacccctggcttatgaatccaagcgaaagcaaaagctgaccgaacgggagatcaatgctgttcagcccgacacaccccaatatcttcagtggtcagagacagctatcaagtttgaccgctctaatcaccctgaccgagtggtccacccggggcggtaccgcctggtactagacccagtggttcgcaacgtcaagctccgacgatccctcatcaatggtggcagtgcactcaacatccttttcgccaagactctggacgacatacagattcctcgcacggaattgaagccgagtaacgcgccctttcacggagtcatccccgggctgtcttctactcgactcggccagatcactttgccggatactttcgacacttgggagaactttcgcacagagaatatttgcttcgaagttgctgatttcgagacagtgtaccatgtcatattcggacgcccggcgttagccaagttcatggttgtcccgcactacacctacatgatgatgaagatgccaggtccccgaggagtcatatccctacggagcgacatcaagcaagccgtcacttgcgacaaggaaagctgcgagatggcccagacccgcgagatcacgctcgcccgagaaaagatccgactggctgcgtccacagcaaccgaatgagaagtgcctgcaaccaagatgacaaagagcggagaaggcgacgccaagaccaagaagattcctctagatccctctgatcctacaaagactgttgtaataggcgctgagttagattgtaaataggaaagcgcgctcatcacctttcttcaaaataataacgatatctttgcgtggaaaccatctgacatgcctggtattcctaagagaggtgattgagcactctttacatgttaaggaagatgctaaacctatcaagcaacgactccaccatttcgcacaagataggaaggacgcgatcaaggaggaactgaccaagctgttagcagcaggcttcatcaaggaagtccttcatcccgactggctggccaacccagtcctggttcggaagaagacggggtaatggcgcatgtgtgttgattcaagtcttgtcccaaagatcccttcgggttacctcatatttaccaggtagttgattcaacggccggctgcgagctactcagttttttggattgctactcaggatatcatcagatccgactaaaggagtccgactgcttaaagacttcatttattacaccctttggggcctattgctacatcaccatgccttttggattaaagaatgcatgagcaacttatcaacacatgatccagagatgttttttcaactcagatcggtcgtaacgttgaagcctatgttgatgatgtagtcgtcaagaccaagtagaaggatgatttgatcacggatctagaggagacttttgcgagcatccgtgctttcaggatgaaattaaaccctgaaaagtgtatcttcggagtaccgtcagggaagtttcttggctttatggtatcccacaggggcatacaagccaacctggagaaaatcaatgctatcctcaacatgaaaccgccaagctcccagaaggacgttcaaaagttaactggttgcatggcggcgctcagccagttcgtctcacgactaggcgagcgggggatgcccttcttcaagctgctaaagaaaactgacaatttccagtggggacccgaagcacaaaaagcctttgaagacttcaagaaattcctcactactccaccggtcttagcttcgccacatccgcaagagccgctgttgttatacgtgtcggcaacttcccaggttgtgagcacggttctggttgttgagcgtgaggaggaaggccatattcaaaaagtacaacgaccgatttatttcgttagcgaagttttggccgactccaagacaagatatcctcaggttcaaaagctattatatggtgttttaattaccgtcaggaaattatctcactacttccaaggtcactcggttacggtggttacatcatttccatcagggatatacttcacaatcgcgaagaaaatgggcggatcgcaaagtgggccttagagttgatgtcttttgatctatccttcaagccacgaacttcgatcaagtcccaagctttagcagacttcatcgccgaatggaccgagtgccaagaagacatgcctgcggagaagatggagtattggactatgcataggagcgggggttgttctaatttccccgactagagagaggttgagctatgtattgtggatacatttttctacatctcgcaacgtggcggaatatgaggcgcttcttcacgggctaaggcttgcgatctccttgggaattcggcgtctgatagttcgtggagactctaagttggttgttaatcaagtcatgaaatagtggtcctgccttgatgataacatgactgcctatcggtaggaggtacgcaaattagaagataaattcgatggccttgagctaacccacgttcttcgatataataatgaggcagccgatagactggtcaattttggttcaaaacgagaagcagctcctcccgacgtgttcgttgaacatctttatgagccaactgtaccaagggaagaaataaacgaggccacggacgctcgagacgtaagcatgattgaagccaactggagagagtccttcataagatttttgaccaaacaagaactccctcaagataaagacgaagccaacaggatctccaggcgcagcagacattatgtcgtacatgagaccgagctgtacaagaaaagtccatcaggaatcttgcaacgctgtgtgtctttggaggagggaagacaattgctaaaggatatacattcaggcatctgtggcaatcacgctgccgcacgaaccatagttggcaaggcatattggcaaggttttttctggcctacagctgtatccgacgctgacaaaattgtgcaaacatgtgagggttatcaattttttgcctgacggactcatctaccggctcaagagttgcaaaccatcccgttgtcttggccgttcgcggtatgggggctcgacatggttggcctgtttaaaaaggctgtcggtggttatactcatctcttcgtagccgttgacaagttttccaagtggatcgaagccaaaccggtcatcataatcacggtagacaaggctagagatttcttcatcaacattgtgcaccgatttggggtacccaatcggatcatcactgataacggcactcaattcactagcggggtatttaaagatttttttcaggacttcggcatcaaaatttgttatgcctccgtagcgcaccccatgagcaacggacaagttgaacgtgccaatggtatagtgcttcaaggaataaaagcacaagtttttgaccgactgcatccctatgctggcaaatgggtagaacagttgccatttgtcctttggtccctgcgcaccacacctagtcgggcgatgggccagtcgccgttttttctagtctatggagcagaagtgatgttgccaagcgaggtggaatttgagtcgttgcaatttcgtaatttcagcgaggagcgctacgaagaagaccaaatagatgatcacaattggttggagaaagcccgtgaagcagccttaattcagtcggctcggtatttacaagggttgcgccattatcacaatcgcaatgttcgatcacgagctttcttagtcggcgacctggttctgaggaaaattcagactacaaggaaaggaccgttcatagtttctgaagttactcagccaggttcttaccgactcaaacgtgaagacggtactcatattgacaactcttggaatattgaacatcttcgtcgtttttatgcttaggcattattttttgtatcttcctctttgactgctaacatcaagttttttttcttgagttatcagtcgggggctattataataataatggagtgtgatttttatcaattcaatttgcttacttgatttatcattgccttgtttgattttttttgtcttagtcaatgaggactgaaagtttttaacaacttttgcgggttttaggctcaatgaggtttgacaaaaacttttaagaaatcaggagctaagtttgaaacatcaagcacagcataaattcatcagtattgtacaaattgtgcctccatcatcatcatcatcatcatcatcattgttagaatacaacatcaatcagtatcattcttttcatcatcagagttattagatccagtcggcaaaggtcgttgtcctggaatctctcaacaacatcagcagctatcttatcagcagctttttgtgcgtcattgataaggtcaagaccagcttcttcgcttgtcccgtctgcaaagccatcaatggcatcaatatcaatcttcgggtacaaggacttggtcatcgccaacgccaggcctgctcccatgtttccagcttccttgatattcttaaaatatgtatccggagcaattctcagcttgtcgaagatctcggcagcgtcaaatgaactcggaccattgttattgaagaacatggcttggacaagtgcatgctccctttgcttatttattacaattccttgtggtcgcatttcatcatcccaccacttgactaatattggtgggcaagaatcttcagccgatcgtatccggaggagctcctcttcatcaccaatcaatggcccttatatattcatgaataatggtgaagtaattgaataaaggttgtcggatcaaagcaggtttggaggacttgtttacctgtgataatttccggtcggggacgagcaggtcctttcaacctaacaggagaactagttccagggtcagcaccaatgtccatcttgggagggctgttggcatgagcttccatttctgggatatctctattatgttctgtacccgattggtttctagtcgggggctcctgatcagcactggctttagcttcagccgactggtttccagtcgggggctcattcctggtatctacattgccggttgccagttgattattacccgggcggttttcggcagttgacccagtttctactgaaggaccagtctctatgccagtcggcgtggggtcttttccagagggatctatgtcagatggttttctacaaattttagacacgttatcaactctgtttcaattgtgagtaactagtaaagcaggggaaattaccagaggacacatacctggatgacttcctgatttttggcatgggacgactggatgttttcttcttcggattggttggctttagttgttttccaatcacccctttgttgcccgtcttttccgcgtcatcaccttcatcgtcacttgaaaccagcttcctcttacgagaatctgactggttagtcgatcttgaggtgttgggttggacgtccgactgaatcttcggccctccgctggcttggccagtgtgccggtgaggtgagcggcgttgagcaattggaggatcggacttcatcaaagcgaattcctgtgcatggtcttccaagttctcagtcgactttacagacgataaaagcatgctttgagagaaactgagttgtataatacataccggtggaggagggttgaaggcactgtatggcacaactggcaataagtgtgaatagttgaccactatggcattcgagaagattttgtacatcctctcctgcataattttgaactcaagagattctgggttctctcgattggggtcatgcttgccgtcaaactcaaaggctgttctggatctttccttgattggtgccagccgggtcttgatgaagtgccgggtgatttgttccccttgcagactttgttctttcagcttaagcatgcaatccaacaagtcgagcgcttgggcggcctcttctcccatcggcagtgagttccaggtatcgcgatagactgggagaagacaggagtatccgggaagcgctggctcagggttttgcacatagaaccagttcgtgtgccaacctttgttcgaggtcttgaatggcatggagaagtatttttggctcaaggtccccctctgttgaaatccggctcccccaactacgcatggtttgcttttgtttggctggggtttgaggaagaagatgcggcagaataaagcgaaatgtggcctaatccccaaaaaagattcgcaagcatggatgaaattggcgatatggactatggaactggggtttaggtggtccaggctgattacatagaaatccaaaattcctcggaagaaacttgaggtcgaaagagaaaacccgccataaaagaaatgggagaataccaccacctcgtgtgtgtcgggggtcgggaacatttcaccgtatgttggacgccacccgatgatctcttttgccggaagaacgccgtgcgccaccatctccttcaaattctcctccgttacatcggagggcgcccactgactttcaaagctttctctcttccgccatggatgcgaactggatggtatgatttggttcggaatgtggctgggaatgaatgggagattgatgcggtggttgcgtggaagatttttgtggaattttggaggacggattggagcgaatcggtgaaccctagcttcgccggtgcggtttcgcactgtagcagggaatggggaaagtggcgatagtttcggcggggaagacgaagcgacgtttggcttttggtattattagggtatcgggagtactaatgggcctaggcccaaaacagtacttcagcccactttttttttctatcagcgtggctaagttgtgatccttagggacttaggcattttgcttcggcaatacttgctcgcaacagtgtagcccaatgctgctaaaatcctttttgacgcagttagataattatttggaattactacgatgcaaataaaaaggtgcccaatggaaaagtgttatactaatttttgctagcttttttaggcagcaaaagctgattgggttttgttgagatgactggtttttgagcagtcattctctcggcatgttatatgcttatctagattatggcgtgagtcatagcctaggctatttagactcatcaattgtcatgaaatcacatttataccacatttgatggatcctttaagagtttttacttggattcttgtcatatgtgttgatttatggacctttagagtattttttactcaggcctttttatatttccatttttggtatattaaagctaaagcagtcggctggatgttttattaaacgccgcatatgcttagctgtatgatacttttggacaatttggttgtaaaaccactcggatggatgttatttgcgccttgactatatgtttagtctttagataatcacatagtcgggggctacacctaattaggtgcatctagtcaatgcacctgattttttattttcagcccttcatagtctttgattttggtactcgggagatcaaggcagaagaagtcgaagtactcggattatcattttggattacgagacaagactatttcgtcgactataaaggtctcaggggctactgtggagattatggataccccatacctccgcggcatgtataatccgactgggtatggggtgccatgtatagatagaatatctttaaggagactcgggttaaattccaaacttgtacgtcaaggaaatacccggatcctagtcggttacgattgtatcttatctgtagctacctattccgttaaggatatgggctgtactttgtaatacggaccccttcccctatataaggaggggtccgggtgcctctaggggcacgattttttcccaaatcatacgatcaataatatactcggcggatcaatctccggacaggagtagggtattacttcttgattaagaaggcctgaacctgtataaaatttcttgtctctaaacccatccacttttccagcttgatagccacccccttttagtattgctgaaatcttgtttcgacaaggagggagctcaagagatggagaaacgcgataagaaggggagggggatttacccgctcgctaatgactagtaggaccgcatatgagaatatggttatatttttcaagtgtggttttcttgagtgaccgtattttcagaggtaggtttagactatatgaccttcttatcattactggacttttaatgggtcgtctataaatataaaactttgtacatgtaaaaagctgtggtgcggtcattgctcaaccgatcgaatttggtgcggtcattgctcaaccggtcaaaactacattagcgaaaagaggatcccaagatcccaccaggataagccatgtcatcatataaatataaataagaaccgttggatgcacgatttgaatgaagagaacagttggatcataagagagaaaaataagtaaaaaaaagtgtcagggttatggataccatatacctaatagtagttgactaaatctcggcaagacctaccacataccatgtcttaaacggaaactgacctcggatatggagggagttctggataaggaaagacaaccagagttctacatggaaacgacaaggactactcggattgtatccatattggtttccctagttctacttggacaagggaacacctatgagtataaatacaaggccccctaggaggagaggagacacagaacaatagatcaaggcggaagatcaacatacaagccaacatacgccaagacaatacgccagatatcgacttcagatattggcatggctagtcccctacggtgcctatgtctaccgtcaggagagatatagcactgtctctgatctcgccggatgtggattcgagcaagaaggctaccctattgtcgactacgagtcagtactacaaaccgccaagtcgacaacagttagataggctaccccaaatattgtactggtgtgattatgatgaataagagcagtaccagcttcggccaacaggatgtagggttattacctgacaattcaggggcccgaacctgtataaaaatcctcaacatacgccaagagaagacgccagatatcgacttcagagattggcatggctagtcacctacggtgcctatggctaccgtcaggagagatatagcattgtctctgatctcgccggatgcggattcgaggaagaaggctaccctgttgtcgactatgagtcagtactacagaccgccaagtcgacaacagttagataggctaccccaaatattgtactggtgtgattatgatgaataagagtagtaccggcttcggatgttgggttattacctgacaattcaggggcccgaacctgtataaaaatcctcatctccgtatcttttacctaagtctcgcgtacatcctagtgccaacgatcctcatattatgcaaataccggaatcgcgacatcatacgtcgacagtggcgcgccaggtagggccgtagggggatattggtgctttaggatttcgacgagatgggttcgagaagatggattcttcaacaacaaactactcaacggcttcgtatgttgggtggtatgacccgaacgaagtacgttcttcgacggatcgggatcttcgtcaagcttgccaagtcatcggcactatggattctttgacgagagatacttcaactactttggatctgggaagtctaacctagccagagtatgtgccccaacaaggtcggaaccatcatcctcaacaattcgatctctcgagatcgaccaagcctcaagatacttgttacaatctatagtcaataaaacttgttctcaggaagttcttacaaagccaatcccaacacctggtaatgaatttcggattgtccagtatgcagatgatactctactttttttgactgcttcccaaaaagagcttttctatctcaaggcaattttgaacacttttgtctcttcaactagccttaagattaactatagtaagtcatgcatgattcctctgaatgtagatttggaaaaggttgatcatctctcaaaattgtttggttgctctattggtagttaccttttacttatctgggtcttcctcttggaaccacaagaccaagagttatagattttgctcctctagttgatagagtagagagaagactctcagcaaccactgctttggtatcttatggggacagattgaccattgtgaatgcagttctttcctcccttcccacttactacatgtgctctctttcactttcaaagacagttatagaaagtattgatagagctaggagacattgcctgtggaggggatctgatattaattctagtaggaagtctttggttctccgggaaagagtttgtcagctgaaagatagaggtggtttgggtgtaatagaccttagattgcaaaataatgcccttctcttgaagaatttgcataagttctataatagatatcctgttccctgggttagtttgatttggaatacttactacactgcaaaacctcctcatgctgttactcctaaaggatctttttggtggagggatgttttgcaatttgtggatatttttagaggcatctcggcctgtactgtgcaagatggaaaatcttgtttgttttgggaagatttgtggaacaataaagtcagagccttggtttatcccagaatatattcttttgccagaaattcaaatctctcagttctgatgttctctacttctgatctacctcagctctttgccttgcaacaatcagcgcaagcttttcaggaatatttggcaatgtcagctgcagataccttggagcatcttaatgatgagagtgatcgctagacatatgtttggggcaacggtatcttttcctcacagaaaatttatgccatgaattttcctcttgtccatgtgcctgtttatattaaatggatttggaagagcagttgtactatgaaagtcaaggtgtttggttggctactctcgattgatcagttaaatacttatgacatgttagacagaaggcattgctcccctcaaaatgcttccttgctctgtgtactttgttcaaaaggatcaagggaaacaattctccacttatttttccagtgtccttttagcactcaatgttgggcgcaatttggtgtggtttggaatcttcctttaagctttggtgaaattttggtcacagccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatatattgttacagtggttaaatttgttgtaatttttttctcctttattaatataaaatcttaacggtgggggcttcccctaccgtggttctttcaaaaaaaagatacgcggcgtaccaaaagatgtcataccgtatgatgtcgaacgagtacgcaataaggtaattggtagattggttttttaaattaatctactaatttcgtagatacatccggcatgtatctacaaaggtaagcaatattttatatgcaatttatcgtacctattcagatcatacaatattgtcatatctctaatttattatgtttacctagagcatgttttttatacaatatctattgtgcaagtgcttccgatgttaggccaactacggtctaacgctgggggctcgctctgctctcttctatatgaatcatgcttgtctacggtttacataatgcctgatatttaatatgctcgttatatcctgataatactagaagatccatgcagttttttgagtacatactcgatattttctgctatatgtcttgtcttctagaaaatattttttaggaacaattgagcactcgagtaggttgtggttgagtacaccgcattatcgagaacgttctcgaaaaatgcagagttgttgcacacaacctaccaacgaagaccgacgacctatctcatagcaccaaccatggctaggctattcgagaaaaggttgttaacggataaattctcgtgaatgttgtcggcttgatcacccgacatgattgcgagtggacatccggatatgctataagttgggtatgtgagtcatgctggccacatgagatgcacatgtaacaaaccaactttagcacccctataggtgattgagaggctcctactcctagttctcaaaccagtaggacgtagcgatctctcgcgccttaactcctgatggtcgaggtacgacaacggcaatagcgtagcggccctcgcaccacgacttcagatgacttcagatggttgaggaacagctacgactggtcttcgaccggcagcgtagcggccctcgtaccatgactccaaatggtcgagagacacctactcactggttctcaaccagtcaatcgtagcgatctctcgtacatttacttctagtggtcgagttacgactactacctggtcctcgaacagcggtgtagcgattctcccactatttccactttaagtggtcgagttaaggctacacctggttctcgaccagcagtgtagcgatactcccactacctttacatctagtggtcgagttaaggctacacctggtcctcgaacagtggtgtagcaattctcccattattttcactttaagtggtcgagttacgactactacctggtcctcgaccagcggtgtagcgattctcccactatttccactttaagtggtcgagttacaactactacctggtcctcgaccagaggtgtagcgatactcccactagctttacttctcgtggtcgagttaagactactacctggtcctcgaccagaggtgtagcgatactctcactaactttacttctagtggtcgagttacgactactacccggtcctcaaccagtggtgtagcgattctcccactacttttacttcaagtggtcgagatgtggctacaactagttttcgaccagcggtgcagcaatcctcccattacctctactccaacaaagttgatatcaggtatatcaccaagtgttttacccagagatcccttaccacgatgacacctagaattgaaacctatcctcatgtccctttacgttgtcttgacaaggcctctgaggaacctaagggaacttcggctggggacgcccagagcggataaggccttgtcggatcatgtagagacaaacgaccatgtaagacctggtcatgttagaattctcgccgtgcgtattaaccaagccgtgtaatcggaaattgagctttccaacttcacggctgggggctagggtcagtgcttttttcaaccaaggcaggtcaagggtccaagagccttatcctctgagaacgattctccgacgataaggctgggggctagggagagtgtatgactcaacaaactgactgatcgaagtcggtaaaagagaagacgctcgtacacaaaacattggtctgtaaatttaattcattttcagttttccatacatattataacatgtcaccctttgagcgttcgctcgggggctatttctatctaatattcttttctgagtattgatttcaggaaaattctattcaacattgttgaagactccatgtctctatggttctacaccaagatcgactaaggcgagtacgatgaatgttgatgaggcttcgtcgcagattctatgccttctcgatcactcgagaacggttggtggatctcgacaaggaatacggaatgaagagatggtgtacccgtcgagataaaatttcttgacttcaatccaaattctcgattacagcaagacgggagacttaatcgtatgctctgtactttcttggttgacgtcggagattgactcggacaaaccctataggtgcccgcacgaggctgataagggaagtctagcgttatctctgaactcaccgagaacggtcacgtgagctcgataatagttactccaaggtctgcggttgagaatatgaatttgttcatttgtattaaagtcgggggctactgtcagggttatggataccacatacctaatagtagttgactaaatctcgacaggacccaccacataccatatcttatacggaaactgacctcggatatggagggagttccggataaggaaagacaaccaaagttctacatggaaacgacaaggactactcggattgtatccatattggtttccctagttctacttggacaaggggacacctatgggtataaatacaaggccccctaggaggagaggggacacgaaacaatagatcaagacagaagatcaacatacaagccaatatacactaagacaagacaccagatatcgacttcagagataggcatggctagtcccctacggtgcctatgactaccgtcaggagagatatagcgttgtctctgatctcgccggatgcggattcgaggaagaaggctaccctgttgtcgactacgagtcagtactacaaaccgccaagtcgacaacagttagataggctaccccaaatattgtactggtgtgattatgatgaataagagcaataccggctttggccaataggatgtagggttattacctgacaattcaggggcccgtacctgtataaaaatcctcgtctccatctcttttgcctaagtctcgcgtacatcctagtgccaacgatccccatactatacaaatactggaatcgcgacatcaaacgtcgacaaaaagcaaataatgtcataggatgttctagacccttcaaacatatcccataaaatgtgtggaaacaaagatatgcgaatgaaaaaatatcttcaaaattatccttataaaataatcatcaatgagtattcaatagtaattaactcattcaatagtaattctactgtatcaacaatagtaggtatccgtgaaaatatgaatagctacataacctaatactatcgattacttcactacagcttgaaattaaaaaaaaatgtgacatggatgacataataaattttgcaaagctgatttcaatcatatgattataagatttactattaaaaagcgtatatatacttctcaagtggtgatgacagaattgtaacgcgtaagaaatgtagctatttacattattactacaattgacacatttatttagatattgtaggagataatgatcgcggtaatatatgataaattatttgttgttacaatgatattcttaataacaaatcaagatatataaatccattactgttatagctacacttcttaaaaaaaataggttaaaacatatttattattaattgttattaacatttatatctattaacataaataatatataaatatatttaatagatggagaggtcatagttgtgtgaacacacaacttatgttgctagttcttcagccacgtgaaccggacatcacaaaaaaaaatgctgataaactactggccatgttggtttgggctgtgtttagttgttttggcaaaaaaaaaatttaacgtacacggacaatgtagactaataacaaaacaaattacagattccgcctgtaaactgcgagacgaatctaataagcctaattaatctgttattaacaaatatttactgtagcaccacattgtcaaatcatggcgtaattaggctcaaaagattcgtctcgcaatttacatgtaaactatgcaattagttttttttcatatttaatgcttcatgtatatgtccaaacatttgatgtgatggaaaagttggaagtttgaacgtaaacctccgatgatattttaaccaaacatgtttttaaaatacaatataaatctcttctattaaatgtttggtcacatgtatggaaaattaaatgtggacgaaaaaaccaattgcacggtttgcatataaattacgagacaaatcattttagcctaattacgccatgatttgataatgtgatgctacagtaaacatttgctgatgacggattaattaggcttaataaattcgtctcgcagtttagagacggaatttattgttttattattagtctatgtttaatattttaaatatgtattcatatacttaaaaaaaatttggcacacgaactaaacacagccatatcgatatggttaaagagatagggtagcaggctgccgtacgtcgccgatgattcacctagcagagccgcagtagtagagtgtacagttttgaatgcgccgcaccagccgcgctacccctcctactagtacgtacttaccgcagcaagctagtggtagacgttattctctccgttgtattttgtattttaagtgcagctatttttttcctaattttgattatctgttttatttaaatatttttttaaaaaaattaaaaacataagtcacgagtaaagtactattcatattttatcatctcataacaacaaaaaaaatactaattataaaaaaaatttcaaataagacggacgattaaagttggaacggaaagtcatagctgcacttaaaatgggacggaggaagtagtctacttggttcgatcgttgacgagagaaaaacaaagagaagaggagaatgagatgagccatgcatacggttgcgcagaataagaccaagaccgaaaaattcgttagtagtcggtttcaaccagtgaaataccaaaatatattctgtcaattcaattagtgatatcggttaaccgaattgacccatgtggcctaacctagtgggcctaataagcccactaattcggcatactaaaccttagaggcagggtagagagctgctcctccgcctccatcgttcctcggttcacaccacctccgtctccatcgcgctcacgcatccatcctctgcttgactacatccatcgcaccgcctcattagcgtgcaccacctcgcgcctccacctccaaccagcctccgccttcatctcttcagtccccaccctcacgatcgagtttcaggaataaaagagagagatagagagttcggagctcctaaacgtgcggcgctgccatcggcgacttgcactgcactgagatgaatgggatttggaacttctcgtggagtgatgaagatcgatgggatacaagtcatggcaagattaatttgcttctttttttcccctatgagtcgtgctcttttgctactagcatcgtatgatagttattcatttgagttgctttgattcatcaatgttgtatcgtcgacttatttatttttgtgattaattcttttgttgtttaaatcactgttatgggttagttcggtccttaatcgaaaccaaaacaaaataactgaagactaaagtgctcggttttgaatttttttaagatcgacaagtcttgtgattttgaagattgaattttccaaaaaaaaacagagaaaccgagctgaatttgtcggttaaatcgaatagccacccctagccgtgctgccggccgcagcacaagtgcactgaggcaaaggcgagaacacacgtgtcctgtactccagtgatccagtctagtcctagccggtcggtccaggccggtccagaccattctttgctggaatggagaccttgagattaacaaaggagttgacccttcagcccttcactctagaatagtatataactaggcaatgcttcatcaacttgtactctatttatttttaaaaaaaggaaagaaaacttgtactctattcatccaggcctttccttttctaaggaacggaagaacggagtaatgtgacattttccaagctacgaaaactatttcgtacagtttctttaaaaataatatatcaacttttaaaaacccgatttttttatttgtaataattaataactctaaaattaaataagtagtaaacatagtttcaaaattatagaaataggaaggacgctcttccgtatagcgtccagatatggacgttgttgaggactgcgtccatgtgcggacgccttggcgatagcgtccagcatagtgggctgctgcggacctaacctgggccgatcatcaaacaaccgagtcaataagcctaaaaaatacaaaagccgggtcaatagtttgatgatcaatgatccgaatgtaattattgatcggccttcatcctcgtgcaaacgcaatctggtagaagcaaattaaccgacattcgtcctcgtgacaaacgctatatggtagaagcaaattaaccattctagatacaataattttgatgatagtaatatgtgttgtgcgcttgtggtcagaacagctgcatcagtccatgagacctttataggaagaggcaaatcccacttatatataattacatcatggcagcttacatcactgcacttacatgaacatgttctactgtctgcgcttcagttttaaacactcttccctatccaaacaaagagcctaacaggaacatgcaactacatgttgagacgacaaacacttatattccgtccatgtgaagagctgaacacctccaaagccattatccttagttttgtaagccccctatggccctatagcagtagcagacacccttgctgtctttatgcaacaaagccacaacaatcacatatgctggatatctcatagaaggatcaatctgaaattcattctggaaacaggccatgcgctccatattttccttgataaattccaccaattatgtcaggatcatactacaaaaggacatgcagataggtcagcaaatgaaacaaagttacaaattaatggcaaccagtgaagatgtatcaaattatcttcggctaatcccatattgtagaaaaacaatattatcttcaggttgctagcagagaccatgcagggtatggtatcagcggaagcccggggaagactagtggaccgcggcgacggccttccaggatggaggcagacggcggctgtagcctcccaagattcacgatggacacgcctcccacatatggaggagaagggcagcggtggccgacggtgcctcctctcgctcggaggaagaatggaagaggattgcggcagatgggtaggttttgtgcatttttctttttcccatggatgaggagatgaatcatgaatgggccacgaatacgatgggctgtaacagcctggacgctgtgcaccaccacgtccctaggtggacgctatttacgagagcgtccacgcctggacactaagatggatagcgtccttcctatttttacaaatcgtgcccaagatttactagatatttaattcgtggattattaattattataaaaaaaattcagctttaaaactactttaagggcccctttaaatcgcagggttgaaaaaatggagagatagaaaaaacacaggattctgacaggaattgaagcgtaaaatagaggattacaaaacacatgaaaaacataggaatggttgtttgattgttgcgcaggaaaaacgtaggaatcagatgaaaaagatagactcagggaaaattttccaagaggttgaagcttttgctataggaatttcataggaaattttctccaaaatccatatgcaatgtgtcattctataggaatttcataggatttaaaaagcttcaatcatttaaatcaaaaggccaaataggaaaattttctatactatttgaatcctataaaattcctatataaatcctttgattcaaatgggccctaaatcttccaaggaaaccttatcttccccgaataggattctaattccttatattccgagaagataatttccatctttatttgtcatattaccttaatcaaaagaaatcttcgcgtatataatcaagtgtatttcatgaatccgtgtataggaggtatgcattatccttaacactaacacctactccctccggttccataattcttaatgttttgaacaatgacacggccttcaaaatatatctttgactttgtttttctactgtaatatattcaataaataaatgcatgtttacttttcttacagtactttaaaagataaatctatatatatatatatatatatatatatatatatatatattgttattgatgatcaaagttataaaaatttgacctctaccttttctagacttcaagaattatggaaccggagggagtacgtccctaagataacttagtcggtatatcccatcgatacagatgcggtagaatttttttattacatggatgtagacacataacaatcaaatatgctcatgaactcattcataacacaccctcaaagaggcaaagatcaacaataaatctctgacctccctgaatttctatctgtagtgcaaccatttgtgtttagtatttgtgggtatctggatttgaatcctggtaggttgaatcgtggttgttcatgcacccgcaactccactacttgtattagaaaatcatattaatttatattttaagtttgaaataattaacttaattaatcatacactaatagtttatcttgttttatgtataattttaatccctctcaaatatacggtgaaaaattggattgtggtggtgtggcaatgatgtatagcaagaagaataaataagcaatcaagtgaactagctgggtggcccgcgcaattgcgcggctagcacctaaacaaaatcatttttttattatgattttacttaaaatttattaaatagctatctcattgtcttaagagtttgaaagaccaaatcttatcatccacgtgttcctaattatatatatagttttttaaaagtcacaccagttgctacctcttatgtcatttccttttttatttgcttgctcgctctaccactatttttgttcattctccttggaacctttaagaattagatcttatagtttttagagtttattgtcacgttgggtttcgtttttataatttctagacgtcccgtcaaacgttgccattatactcctctgtatcccgtccactgtctcttctctttattgttattaagattttaaaaattaaatataattatcatttgggttcatttttactttctagaagtcccgtcactgtcagcggctttgccattgtacttctctacggctcgcccgctgcctcccttctttattgacattgagattttaaaatcgaacatgattatcattattttttttacttttgaaagttccgaacatttaaaaattgaaccttgtagtttttagagtttattgtcttgtttggtttcattttttataatttttagaagtctcgtcaaacgatgccactatactcatgtgcggcccgtccgccgcctactcttttattgtcattgtggttttaaaaatagaacataactatcgttggaattcattttttttattttctagaagtcctgtcaaaccgtcggctctgcaactgtactcctatacaccccgtctactgcttctattttttattgtcattgagattttaaaaatcgactatgattatcaatggggtttattttttttactttttagaagtcccgacaatcgccttgctcgtttgcttcacagcctgttgtcgtccctccttttaattgtcattaggattctatttggtgttttattaacattttttatatgtcgtatcaaccgccatcactctacttctttataggcatgttacttaatttatctcgtcatatgttttagatggtattttctttcaatagtctttatttttatcacaaattttagttatttataaattgtattcctaatttaaatcttatttttctttttctaatttcatattttctttttcaaatttcaattaatatcgtattgtgttcttttaatatttttattttttattttcagtttcagttgtttcaaaattgtattcctacttgaactctcttttaatttttctaattttggttattattttattttttattctgaattttaattaatctcgtattgtgttcttatatggattcttctttcaatattgcttatttttaattccgatttttagctaattttaaattgtattcttacttgaactattcttttttgttttgctatttcggattttatttttatttttattcccaattttaattaatctcgtactgggttcttatatggactcttcttttaatattccttatttcaattcagaatttcagctattttaaaattatattcctacttggactctccttttcttttctaattttggattttattttatttttatttagaattttgattgatctcgtattgggtttttatatggaaacttctatcaatattgcttatttttaattccgaatttcagctatttttagattgtatttctacttggactcttctcttcttctttttttctaatttaggattttattttatttttatttcgaattttgattaatcttgtattggattcttatatgtaaacttatttcaatatagattatttttaattccgaaatttcagctatttttagattgtatttctacttagactctcattttcttttttttctttttctctgattaatgtgggaatttttagcccccacagcgaatatggtgccttcttttcgagctaatataatagatagatacgaggggggcggtcaaatagggcggagagagaagatgggttgatgataataattgggcaactctcgtcgtcgtccggtagggagtaaattattaggggagagggagactggactgtttgcaataaagcaatgctagtagtagtagtagtatattaataccgaaaccaaaaccgcagtaggggggaggggagagagcagcttgccgtcatgccatgtgatacatgataggagtagaaggagaagaggagagagagtgtgtgtgaatcagtgaattaaggtggtataagtagcaagcgccaccggggagagttccttgcttggtttggttcctctctgcttctctctcttttcctccctccggcgaccaccagcataccataccatcgccggcttgcttgcttccttccttccttccttgggggagagagagagtgtgtgtgtgatggggacggggtggcggagggcactgtgcacgtcggtccggcgagatccggagcaacaagaggtgaagaggcgaggagaggccccaagcccccggtgtggaggaggcagcaggctgggtggcttcttctccgccatctccagcagccatagcagcagtaatccagcaacaacgacgcccaccctgcgatgccgcaccaaaccaaagccacagtccagcagcagcgaccaccagcagcagcttccgtcgtccgcgccggcgcccaagaagaggatgcctctgctgcaggctctctccgtgccatcctcgcccagatccccctccagattcgccctcctcaaggcctccatcctgcccaacaaggtaggtacctcttcttctccttctttagaaatgatgatgactcaaatgaagaataaatagctcctgcctgccttggccctgtgatcccccatgcatatcatatatattatgctcttcttcctcttctaatctggctgtagcggcggacggacggagatggagatcgaatcgatcaatcattgccaccactctctcttttgtcctaatccccttcccttccctcccctccttgagattcgattcgattcgcctcacgcaataataataataattactccctccgttttaaaatatttgacacagttgactttttagcatatatttgatcgtttgtcttattcaaaaacttttgtgaaatatgtaaaattatatgcctatataaaaatatatttaacaatgaatcaaatgatagaaaaataattgataactacttaaatttttaaacatgtgctaaaaattcaacggcaggtagtaaaatggaggtagtaactaataataacatcacaggcagaggagcagctttccttccgtcctgcaactgcaatcccccaccccgccacttcctcttttctttttgtttctttttaaatttctttcttctgggaatgggagtgacaatgcgagtgagaagcagaatggaacccatgaaattaacggtgaaggtataattgcagatataggtaggtagagatagatcgagaggatggatgatctcgaacaagatgtaaaaggatgatgatgcagggcccaaaggaagagagaaaggctgctcctctcttttggagtatgtcaaacaacaagtgaaaggctggctggggattggggaaagatggatcagattcagatcagatcgcccagctttttcttgattttgatcctccatcgattaccaatcaatcaaatgcctgccaaaaagaaagatcctccagcctttctttctttcttaattttgctccatccacagcactccactcactgtcgactctgtttatttagtttagggattagggattattactagtcttgttgtacttgttgattttgttgagagaaaagaaaagaaggaattgattgctaaagaaataaataatgttggatggatgcagagccggtgcggcgtgtgctcccacggcgtgaagaccggcgcggcggcggtgttcacggcggagtgctcccactccttccacttcccctgcatcgccgcccacgcccacgccctcgccgccgccaccgctctctcctgccccgtctgcgccgcgccatggcgccaggcccccttcatcaacaagcgcaccaccaccaccgacgaccacaagcgcaagtcctacgacgacgacgagcccctcctcgcgcccaaggccgccgccggcgccttcaaccctatccccgaggacgacgaggacgacgccaccgagttcaggggcttcttcccggcgcgccccaggagcgggctggccgtcaccctcgccccggacgccgccctcgtgtccgctgggcggaggcacggcaagtacgtggtggccgtgagggtgaaggcgcccgccctgcgctcctcgccctccacgcgcgcccccatcgacctcgtcaccgtcctcgacgtcagccagggcatgatgggcgacaagcttcacatgctcaagagaggcatgcgcctcgtcatcgcctctctcggccccgccgaccgcctcgccatcgtcgcctctccggcgccgccaagcgcctcctccc

SEQ ID NO: 65019 - DNA, 724 bp, Oryza sativa
gaaaatataggtatgatcaggcaaatttctccaacagaaatacttcagcaaaaatattacattggaataaggatctcagtgaagtctaaaaacaacatatggtgaatggtcacaaacaaagaattgctgattaatttctatttccatgaatatatatacttcaacaaaaattactttttatttttgtgatgcacaagctctaaataggttagttttgttctgaataatttaacagatcaaaatggtgctgaaatcaatttggataaaccacaatttattctgattaattaggccccgttcacatatcaggaagcctgctcacgaaaaatgagggagtagctaaacccaaacattgaattgaacagatccttaacagttgaaaaggctaattctgttgtgagtataccttcatcactgccaagtttgtatccaggccatcaactttgactccatcaactgtggcttgggccaattcaaccttcttatagttgttcattgactcattaactaccttctgcaaggcactcatttccccaacaactatctcgccaacaaagagtctctcacctttattaattggtgataccactccaagattcgacagaacagtaaagggggacattgaatgccttccactgctagtgccaggttggttaactgagttgatcttctcgatgatatagaaccagctagtgtttcaagtattacatcagcctccgggaag

SEQ ID NO: 65020 - DNA, 16704 bp, Oryza sativa
cccacaatattattttttgtgtgaatgacatatgggtcccatatatatattttttaattcgaatgccacgtaagcgccacgtgagacaaagactaggtcaacatcgacacatcagcgccacatcagcaaaaccgccctccaaaaccactgagggagtcaaattgcaccggtttcaatagttcggggagtcgtcttatccggttttacgtttgagagtcacgaattaggttccaccgataattaagggtgttaaagtggactttttcctattcctttcccattggtgcccctagcccattggcaccgcgaaaaagttttggcccaattatcggttggccagatttgcatcgatctgtttgggctggcccatgtgtaaagggtaagatgagctaatatctttctgcgtttttgctgctggacaggccgcttccggcatcggcgatacggcggacttagcgagactttgccggccggcaaatttcgagctgagctctcgacgccaaaccggcggtatatgcggcattgcgggcggctgatgctattacggcagtacggcttactctaagtttagtcttgtatgcacgcgaaatatcgatagtagactttgtactacttcctccgtcttaaaatgtatctatttttaatgttggcacaggtattaaaaaaagtagatgagaatgattgtagaaagtatatgattgtttaaaaagagaaagtcggtgaagaagaatggttgtgattggttgacaggaagaggtaggtggagaaataacttaattttgagacaatgtactgtgctagaaatagctatattttagagcatctccaatggtctatctaaatcggactctccaaatgtctatttggtcaactcttcatctaatttggcaagtcaaactcgtggtttactccaactgcctctccatctactatctccattataaatctattataaatgggacccatatgtcagcctatactaccatttttccaccacattccccatacatccccttcttcctcccttctacctcggatgtagcgacggcggacagcggaggcgggcgcgcgaggtggcggcggacggcggcgactcgtgggcgcgggaggcgggccaggggacagcagcgagcggagacggcgccgagccagcgggctgtagcgcggagattcactcctcaccggcctccctcgctcctctctcaccgccacgccctccatccctcgccggcgcggctggagacgacgcggacggcggcggcggtcgcggctggggatgacgcggacggcggcggcggtcgcggctagctctggtgcctctctcctccgtgccgtcgccgtcgtacggttcgtaaccgtcgccgttcacgagcggcgccatcgctgccttcttgctctagccgggggagatggagagagatggggtggaaggtggagtggtggggcccacgaatagctaggcaaagagactctaagtttggctagtgaggggtgtgatttagccatccgaatgatttggctaaccacatagagaggctattggagagttttttttttcatacttgctaaattttaacttggcgagtcatttagcctttatattgaagttgatcttagaacggaggtagtagaatgcagtgttgagaccctgccgccctcgcgtttgacccagctcaacctgcagcggtgcagccgaacctggtctcacgtgaactccccgtctgacccgccggtagtagaaacttctcatcgtttagctctgtttttcttcttttaaaaaaaatatagatctggtttgaaaaatgctcaaacatttaggttatatttgaagcagattattaccaagattaactacttgattttacaggaatgaagtagattataacaaatcatctagacaatacagtttaagatttttttttttgagaaaacataattttggagttgtgaagtacataatcctggagctccaaataatctctcgtggagtagctggaaaatttattttttttcactacaagaaagaagagctgcattgtgtgacgtagccctacagtgatcctacatgtaccagccggccatcctaaagagtgatgagaagctagtcgtgtatactggcggtactgcgtagtgcgtacgtagggacattagtatactggaacatgataagtggccctgcagcctgcaggccacccggaccccggaactaagtactcccctataggagtacctagccaaacaataacagatgctttactacaggagatgatacagagtactccataaagctagcatactccctgtgtcctaaaataaatcaagctaagatataatatactccctacgttctataatataagggattttgatttttttcttatactgtttgaccactcatcttattaaaaaatttgtgcaaatataaaaaacaaaaagttatacttaaagtactttggataataaaataaatcacaaataaaataaataatacttcctccgtcccacaatatagagattttcagtttttgcttataacgttagaccactcgtcttattcaatttttttttgcagatataaaaaataaaaagttgtgcttaaagtactgtagataataaagtaagtcacaaataaaataattaataatttcaaaaaattttgaataagacgagtggttaaacgttgcaaggcaaaaactcaaaatcccttatattatgggacggagggagtaatttcaaatttttttaaataagatgaatgttcaaacaatataattaaaaagtcaaaatcccttatattatgggacggagggagtaacattatctattgatgttttatgtcaagtttgtttgttttgaaatggaaggagtagctgccatactttgcttgtattgttatcaagggaaaattggaaccatgccattataattttgtaaaatttaagatataccattctgacccacatgtgattgactcatgtgggttctatatgtcattgagataccgatcacatattttaaattttataaaattataatggcatggatcaatgcataggaagagagtggaagtacgaatcgaacaggacaacgtacgtcatcagttgttcagttatctcacctgtcaaaattaaatcaagtactgccctcgagggatatctgttggcaaatactacaatatatttttaattttgattgagacttggaacctggcaaatatggtattttagcgcgattaaatatcttcatgaggctgatttttggtggagatataaccgtacagggactggacaagttctgcttcgcccaaatatctgtacggagtaaccttatagagttactccgtggttactttcctattgttctaagtaatgcacgcggtacaatgttcatgagaaagggttctctattgatgcaaacgttgtgcttagaggatatggatagaagaagagggaaaaacaaaaataaaataaataaagaaaaaaataagtcgaagatagaagagcccaaattccaaatgatgtccactgtcccaaaataagtatatctaatataggatgcaacatattctagtactggtgatcatgttagcaacggcagcctaggagcccaggcttaaaaatctcttcggcaacgacggctctaggggtagcaacggcctaggatagcggcggcctgagtgctggcgcaaggttctcggcaaggaggtgaatgtgggtcccggtggcggcggtggtagccctagtggcagcggcggcctgggagttcgggaggcagaaaagaatcccgtcaatggcggcagccctatgggcggtagaggaatctggcgaagcgaaagtggatctcgtcagcttgtgtcttgtcgctagttctaactagacgacgatgaatgaaggtgggctaatcggcggcgcgtgacgttagctcacctgaagcggttgaaaatggcactaacggagattcacaacaacgacacactaggggcagtggcgactaggcgatttccactcatcgaatctggctgtttgagaaggtgatgtcacgaagcagggtctgaggtagtaggattttcgtttttatggttgtgtgttctctttctttgttgagatgtaagttaagtgcttttgtattttttttgctgtgtatatatcataaactttatggatattctagctggattaatgaaaattcatttctaaaaaagtagctttttaagttctagaatatgtcacatcatatactatgtgtaattattttgggtaaagggagaatgaattagctaacttttcgtacagtttgatccaacaccgttgccacaaagcctccttgctactcgaagaggattcggatcctagttgtacttgccacggtgccgcctaacaggcagccgtacctgcctgcgactcgatctgatttgtccacgttgcgtcagatccccgtctcgctcgcctcgctacttttatactcccctctcagctttcccagcaaatgcaacgctcgtactcctcgcatcaacagcctccctcctccgctctcaaaaaaaaaaaaaaacagcctccctcctccctcccgaaggccaaagctaccctccatcagctacaacaagcgacaggcggcgatcgcctgcggtcgtgcgcgcgtggcgtacgtgcggccaccgagtagcggcatctgagatggtcctgcgccggagacagagaccggcggcggcggctgcaggtgggctgctcgggccgtggctcctcgtcgccgtgcttgtatactcctcgttcctcggctccaccgtcttcttggcagtcgacgccgcccgcacgtcggcgttcgtggccgtggcgccgctaccgatggccccttcgccatcgccgaccgcggccgagcttgtcggtgacagcaagcggaaggtgcccaccggtgcaaatccgctgcacaacagatgacaatcatcgagcgagcagcagctgggaaggtgagcgacgcagcgttcggtagcatgtgagaagcgaggaacaagcgagttaagctgtcagggaagccatgcatatgaagaagctagctagctactgctgctccttggtgagaccgtaagagagcagagagcagccaagcggaaaggggtggcggtggagagatcggcaatggcgcggccgccgccaccgtaagcttctgattctgcttcttttcttctccacactttttttttgtttctctttgatctgtcgaagctgtgatccgagaggagaaatgaagctgaatgagaagggtactgtggagtgccacatgctttacgtagctagccacagctagatatactatgctcttcttgtttttagcatgtcatggttgcgaattgatcaatgcttcaagtaaaaacgttcatgtactcattggtttcttcttttctagcaataaaaatgcacatatatgtctattctgtgcattcttctatacatgtaactttaggatcgattacattggaaacttcttcaaattagacgattttttagatagtcccttaaagagcctatatatgctatctctattcaactcgctcttaaatatacacaggaataccaatttgttgacaaaacaggctggtcaatgtaaacaccttcgcctgccacttacatataggcttacactagctgacttctccaatctctagcagcagaagtgctgtgtcaatggaggggctagctatttttgtccgcaaccttattttggtgctagatttttaccaacgtagtgtaagatattgttagctgacagatattgcacatgttcctgcaatacatgtctgtcagtgtgtcatttgcgcgctcgctgggcatccttcgcgaagatgagaaaagacgcattgtacgtgtatgcctgcacgcgaagccgttaattgtattactccatccgtttcgaaatgtttgacaccgttgactttttagcacatgtttgaccgttcgtcttattcaaaaacttttgtgagatatgtaaaattatatgcctacataaaaatatatttaacaatgaatcaaatgatagaaaaagaattaataattacttaaattaaaatttttgagtaagacgaatggtcaaacatatgataaaaagtcaatggcgtcaaacatttcgaaacggagagattacgtacgtataccagtgtggcagttattagtggccaccgtcctgcaggaacagtccaaagtgagtcctatggtctgatacagtagctctagcttcgtcgacgtccgttgcgaccgtggaatttgacttgatcattttaatcagagatcgttcagacacccaaggccaactgcagattaaaaaaacgcatcagtctttacgcatacagttccaaactccagtgctgttctcaaggccggaaacggcgaccaatacccacatggctaggaattcagtagtaccaactgcagtacacaaacaacaatagttttaatttccatagctgtttccagattaagatcacacgttatatactactccgtatatacactcaactcgcggtttgatatctaatttaaatactctctctatatattatactactgtaaattgatccttgtttggagtgcatctattccgttgttcaaacggaaccatctttctgggattcaacgttcatagggaagcatcttgtggccttttcctcttggcagcgcactcgatcgtgcgggtctttgtatgcagctagcgagcctagagcgtgtgcgcttgggcaacttaacgcacaagacgccggagaaggtgcgctcatgtcgcttcagctagatccatatctcccctttctcccatctacacctgcactaaccacgacgcatgcgctgcgcgccctatctttcaccgatcgatggatccgggtgcatgcaagctctaagtcatgatctacgagagcttaatcttagtagtactagtttaatccaaggtcaaaatggactggtgagcataggagtgcgcacacttttgtatttcaccgcgtctgcactctgcagcactgcatatatagtcctgcacagttcaagatggaggtaaaaaccttgacaagatggttaggaagagtagtaaaccttaaccacgatgtgatagctatctcggttccagatttgtactaaacatgaactaattagccctttgctgaagatgctttgcaagatttgactgtcgtggaatcccaagacagggtaagataatggttaggaatagactaacaaaatttgaagtattgcctcaggtaccattctaaaaaaaaagtattgcctcaggttaacgcaatgtttttgtactccagtcatcaggtagcttatgtgcaaaggaagaacattacaacatacatactccatggtttactccggtcaagcacacgtaaatcttcaatccatgccagctgcgtcgaggttaaccctgcccatggaagcgcgaggtggaaataaatgtcatagaagtgcggtatctttctcaccttaattaagccagagccgggcttgaaaacccattttggtcacgcagctcaagagattccaagccagcgtccatgcaaatgcatgacggatgcatagcccgcgcgcgctggggctggagcgaggggagcccagcgccgaccagtggctgggtcgccacggtttcccgggcttttgtttatcgcttcgaaggcgttgaatgtttgctgccgccattaatgaggtcacgtgaggtggaaccgtggccaccccggccgcattggctgccctgatcgatccatcggtcagctgagaccgcgtaaggtcagctgcgctgatggattgatctctcgctgttggatctgtagtccctgcttgctctggcctcggtgttcttctcgagagatcattttcttttggcaaaattggatctatagcatcgaaagtttctgttttaggttttgtaacaccgaaagttcaccgcttactttattagcatccaaaatctctctctgttcccataccaagcaattccgtccatctcatcccgtttcccgttttctttgactggattgaccaatctcaccacgaacagaactggaacgaactcttccgtgcttggtggcagcgacggccttgccgcatttgtccatccttggatgtcatcatcgtccccattaccggtggcaacacggactcagcccaacagtccgtgcatgtttaattgcttgatgcgctgctcgccgtcaattaactgaaaaagcttttcacttgcatcaatttactactaaaagagctgtccactgaaattgattggagatcgatgtgatggtcaaggttgttaccgcaggacgggctgccagcgatggacaagcaaggtggagtgggagctgctgcatagccactgatgatggatgtgcaacgttggtggtagtctggtagaagtctgacggcgaggtggggaagcagctgagcaggagcggacgaacaaaaagctgccgctggtgatgtacggcggcgccggtgatggtacgtagaagatgggtcacgcagctaaggtcgcaggagaagatacagcaaggggaaggccactgccggtgggagctagacgaacctgaacttgatctgtgctcccagtgggatgcccagtatggttggcgagttgacatggctaccggagtcaatccagtcaaagaaaacagaaaataggatgaaatggacggaattgcttggtatgggaacggagagagattttggatgctaataaagtaaacagtgaactttcggtgttacaaaaccaaaaacggaaacttttgatgctataaatacaattttgccttttctttttcatcatacggcctatagagcacagtgccacagactggccaatggccacgagcacgacgacgaagattaacgggcccatggccgaggacggaggcccatcaggcctagcctataacgtttcagcccaacatgtaaaaggccggcacgtccgtggttccgcccatgcgtgatgggcccacatgaccgtggtcatgggtatccagttccggttctgggctaagtcactggttcgtcttaaggctcgggtggcccacggcccaccaggccgggcactcttcctccccgacacggcaccaccgcaccacgggacgcggcggcgtagagattccccgccgcgccggatcccgaacccgttcaccgcccagcgatggcctcgcacctccgctccccgctggtgcttctgctgctgctcgccctccaccggctgtgtgccccgtggctggtggtcgccgacgacggcgcctcggtggcgaggtcggccttctccatggacggcgacgtggcgtgggtggtgcaggtaagcgacctccacatcagcgcctaccaccccgaccgcgccgacgacctcgcgagcatcctcggccccgccctgcgcgccatccgcccccacctgctcctcgtcaccggcgacatcacaggtgagcggcgagcccccttctcatgtatcgtcaaatttgattaaaaaaaagtcacgaattgttccttcatgcatccattttgtacagttgtttggtaaggagcatggcaactgccgagaaatagaccgtatctactctggttttgacatattgcaagtgatcggtgttgagtggtattgttatatgtgggaaatagcagtatataaactcgattagctatgctgtgaacgtagaatcaacttccgtataagctgtgaactcgattagctatgtgggaaattatgctcacagcatgagctttttgttacagttgtgctgttaaatgcgcatgtacttctgaactaatcccatctagtacatgatggcactgactacgaaggaatatcatgttctgttaatgagaatctgcagaaaattctgattcatttccatgtagcgtaggcaggttgaatttgtatttgtggttgccaagtattgcctaaaaagatcaaatgatacagtaactcagagtccatggctccatgccatgaaacttgagaatagcttcattagttaatgcaaggtaaagcatacaacttacaaactaccataaggttagtagatcatttttctaataaactcagctagcgtaacatccataaacatattctggaaatatcctggagttattggcctaacattcatttcaactatttgcatgaagaatatgactctgaatttgttgtataaaccattaaattctccaatatcgtatctaatggcgacatacatgaaagctgctttgttacaacaaatggagataaatcccaaatcacttgaaaacattactaactgtattttttatatttggaaaatatttatttgtatgtggaaggtcaaatattggaaagttgatttggtagtaaatttggataacttcaattttcgtcccttgctataatgcatttccttttttcaccttgagtgtacatgttaatttgttagacagaaagcccttgctagaataataaggaaatgaaacaagcacatatatggttgatgcaattgaatgtatatgttgttcttgtagttttatatattcctatgactgtataataatttccagttttttcgtgggatgttaacaagatgcaaagaataggagaaaaactacgtcaagacaagatgagagggaatggattacatacaaaaaagctattgatgcaattgttggaataggtggtattgataagagcaggatatttgatattagaggtaatcatgatacatatggagttccctataggggaggaaaattggatttcttctcaacttacagtgtgaactcacagcttgaccgattaagcaccatcagtagcattttgcttcaggtactccttatcttcttgtctgatctccttgttaggcacaattaattttgttcatagtcgtttatcatgacttattattcgtcatgcgcataatccagtgtacagttatctttcaattaatccagttctatattctgcttctttgaagatgtaaagcatactataacatatttgctgtcagagcttcagttgaacattgacctgcactttataccgctgattactgtgcacagaattaatgctcctctgccttgattattgaacgtcctctttggttagctggtagaacaatatctattggtccataataaatattactctcgtgtgatactgggcatgtagtactacaaatacatcatgcttcaatatcatactgatgatacttgaagcagaaatgtacgataagcttgaacatagcactaaaccatcttactcaatggagaacagctcttgctaactagacttgaccatcaattataatttactaataattgcatttatatgtaacaataatgatgtagtgtgctatactgatgtcaatgcaccttcagactcgcttaatgtacactcaatagcaggacagatgaaggtggctatacattcagcacttaaaccataactggcctgtgtcaacctacaatggtagttaaatttactaaactataactctatttatctttggcagctattacgaatcaaattatgtcttatctgtgccttataatttccgtaacccactttgtctctagcacttatatagatttctaatggtgtcataacagtactagaggagatttttttttttatgttgggctatctgtgcataacacattgtctatgttggattatctgtgcataatacattgtcaaaattcttgtaccatttatatgccacgcatctctgctaattctgcttacaatgctgggcctgaattttatcctaaaaggtactgtagggacgcaggaattatctcttccttggcatagatgatacaatgagtattggcattcgatatccagctaatttatttggccatcctactgataagaggatagacgctgttaattcagaacttcaatactggtccaatcattccaatgttccaataacaaaagtagtttttggacattaccctatgtcattcactacttcatctcaaaaaggacaacgttatgaaagtatatttgcaaagcagtcaatttcagcatacctatgtggccatctgcacgcgaaaattagtaagcagctttggcggtttcatgaaatgagtgcaacaacacaagagcagaaatcaagctattgggaatgggaacttggagactggaaagagtcaagactgatgaggattttagcaattgatggaggtgcaatctctttcatagaccacacactaaaacaggcatttcaaacttccatcttgatcacatacccaacagattcaagaagtatgaatacattggaatcaatgaattggtcaacgagaaatgatataaatgttcttgttttctctaatcaggtgatccgcaatgtgagtgcaagagtttttgactctcataatgagtttaagatagttgaagaaataccactgcagcttgttgccacaccatctgttcacaaacctttgttccatgcggaatggaatgctgaaaactacaaaagtccatcccctactcgctactggctgcaagtttttgctcaggattctcagggtgggaagacatcaagcgagcgacgaccattttcagttgagggtaaagtgcaaattcaatcacgtccatgtctgaactacttgatttttgaagtccaatgggaagacatgtatcaagttcttctgtggagtaattttgccttcataattgtactattgtttgctcccaaattgctgtatcattttatgaagaaaagtttgacataccaaagatggaccgtgtcagttatgctatcccctatccagccgaggaaagcttacttttggttggtctggtttctaatggagggtgcaaggagtagacccatctggttttctttgctcatatatgttatttggcttattgaaatgccatggttttggggtcatgcgacatctgagaaaggagaaattgctcaaatgtacttatccggatggagcatcccatctcttggtgaagacttgacctggaacaaatcgagcaacccagatgtgctggttattacactgcctttcctatacctggtggttgtcccagttgtagttgtaatatatagtttgtttgcagagaaggctgttgcttgtttgcggcacagcagaagaacagaaaacacggtcaacccaacaaattcaaaccctgagtcaggatatctactgccaagtgcttcagtgtctttagcgaacctctcagacaagaaaattctctcaatggtaatgaaattctgtggcggctggacaaggagggtgctcctattgttgtgctgtatcattgcggtgatacatttgaaggtgcgtacctatctaaaacaccatctgcagactgtaccatcaatttcatgtcttaaatgttgaattgcatatcttgcagctttcctcaaggctaatgtcagcttatggagccaaaccagtagccttttctcctccagtaacgtggatgccgttgttattattaagtgctactgcctattgtacaatgcccaacacatattagtgctgtcagctatttttgaagcacgagtatattagataagggcgtgaaaggtactgtccttttgttgtacttgaacgtggtgtgaatcgtttatcaccaacaaaaagctttgtacaattactcgatgtttcagttaataaagtgtcaatttcatttcatggacggcaattcacgtaaaattctatattttgtaaaatttatttattctaagagtacatttttaaaattctatattttgtaatattggattgtaaatttgtaatgctttcagatttactaacttgcgttcaacatccgggcaaaaataaacaaggaaatatataggtgttttcctcactagacccagcaaatatacttgggctttatccatactaaagatacttatagaaaattacaatgcatacgataaattagtacgatttttgcatacatatatgtatcagcgctgatacatatatgtttcagttaaacaaaacaggacaattagtgatgcatatgcccaccgcaacattacgaatcaaaagttaaccataacagcagacggcaatcaacttaggttcacagctagcgacacgccacaacagcacatggcaacaccataaatccaaagttttgacctaaggcaacagcctaaacttcacctgcggcgctgatcctgtccatgatgttcgcgacaacctccttggactgccgcagcaggacgatgctcttcttcaggcgctcgcgcttggcgccggtgctcggcgacggcgccagcatcctctccacgccggccatcttgttgcccaggagctcatccgcgagctccgcctcaaggtcgtgctccacgaggcgcttgacgacccgaagcacgtgcagcgccagcccgtcgacgaggcggagcacgatgctcctccagtacgcggtgagccgcgccctcaggtcgaacgcctgcccggccaagccggcgtgcgccctcaggtgcgaaacgtccacctccccaaagccctccagggtgatcctcgcgggcttggagccgtcctccacggcctccatgaaactatcgtggccctccatgatctccgtccacgtcctcatgtaatccgggttcgccgtgtagtcggagacgagctccatctcgatcagctccttgacgtgctgcgccgaccgcgcccgcgccttgtccatcagtgtctgcacggcgcggcggcacgacggctgcacctgggggaagttctcggagtgcttgagaaggatgttcatcaccacatcctccacgtaaccccacacctcgttcacgagctcgtgcggcacgtgcatgacggtctccaccttcttcttgagcaagacgaggaacgcggacctcgggaggaagttggggaggttgatccccttggtctcctccaggacgcgcacctcctccatcaggaacatggcgtcgtcgtcgctgctcttcgggcactccgcgggaagcctcctcttgtagccgtccatcttctcggcgatgcgtgcggtgccgtggaaatggcggtcgtcggggaactcgtcgaactcgcctcggacgagcaccttctcgagcgaggcgcacacctgcttgacgatgtgaaagaacgccctcaccgcgtcggcgacgttgttgaggtccggcggcatctggtccagctcgctgctgtggcgactgaggcggtcgttgatctgcttgacgatgtccgggaggcatttggcgatgatggtcgcctgaatctgcatcagcctctgcgcgagcaccgggatgccgaccatggacttgtcgatcttggagaggaggggatgatacttgaacagccgctcctcctcgatgcgcgcctggtcgtacgtctcctcgccaatgcggttgcggacgcagacgtagccgaggccgatgttgacgtcgtccatggtcaccttctcgagcaggccctcaggggccttgtccgccttggtgacgacggcgagcgtgcgctccccggtgcggtcaacctgctgcgacatgcggatggactcgcacgtcgggaagtcgacggtggcggagagcacgttgaggatgatgctctccttcggcgcgatatactccttgatgatcttggcgatctggtcgtagatgtcgtcgggctggccctggacggggacgcgcgtgatgccggggaggtcgacgagtgtgaggtcggggacgccgcgcttccgcacgacgagggtgatgggcgcgtcggagatgcccttgccgctcccggcgatctcggccgtggcggcgttgatggcgtccgcgaccttggcctccgaggtggtcaccacgcggccgttgctgtactccagctgcagcttgggcgagtcggcggaggggtcgtcctggagccgcatgacgagcggcacgcgggtgcagatgccctggcctcgcgggaggctgatgccggcgagcgactcgagcacgctcgacttgccgctggactggtcgcccaccacgacgatggtcggcagctggatcccctcctgcgtcaccttgaggtggcgcagccggtcgacggcgtcgaggagagggcggatctggtcgttgtaggactccgcgatggcgctgctggtgacgacgtcactggctgcgaccaaggccttggagtcgccaaccaaatccttcgcgctcttggtcgccatgatcggaagcagcttcttggacatgggtgcagcagctagtgtgggtggcgtcagggcgattggaagaagcaggggaaggagatcgctgtggttgtgagttgtgccacgccggtgaggagggttttaatggcggggatgggtgggagaatgattgcccgggaggtggagcgccgcgcactggaatcccttctcggaagacgaggggggtttgcgcgcgccgggaatcggagcggcggccgcggtgaagcgaaagttcagtacacgagccgacgagcgcgtcttttcgcttttcgagctttgtcttgttctcctggagaaaggtgggctgctttttagacaccgattgggctactctactaccggcccgtggattggcccattactgaaaggctcactttggcaggaccagttctcattcagcccgatctaactttcagcccataaacaatcgtgaagtactccggaggggcccgcgtgaaaaataggtcaagacgcagcccgcacctcgattggatggtgcgcggcgacccgatccctggatcgcctgtacggccagttcatctcgccggccgacgatgcccggag

SEQ ID NO: 65021 - DNA, 14241 bp, Oryza sativa
catgcgtccagcttgatcgcgcataaaaaagaaagagcaggccagacattccacaggcaggcctgcgccatgccgtgttctttttcagagtaagataaggtttgcggcaggtttgccgcagacttgccgcatactctttcagtatgatgaagagtatgcggcagacctgccgcagacttgctgcagacctgccgcagacttgctgcagacctgccgcatactctttcagtatgatgaagagtctgcggcaggtctgccgcagacttgccgcatactctttcagtatgatgaagagtctgcggcaagtctgccgcagacttgctgcagacttgccgcatactctttcagtatgatgaagagtctgcggcaggtctgccgcagacttgctgcagacttgccgcatactctttcagtatgatgaagagacctgctgcagacctgccgcatactctttcatatccagtacgtggcaataaagtatgcatgtagaagaaccagtgataaactgattgatacttcataatcaatattggcaatatcgatattaccaattaggtaataccaatatatatcgatattaccaattaggtatattctattctcaattgtattaacttcatcacattgatcatttgaagtgtattcaagagtaacatttaaagtgacacaggctcgtacacatatatatactaaatatgtatattgtttcttggttagtaatcatagtttcttggttagtaatcaatatatctattgcttaaacgtgaatgtaattgtaacatgatcagacaaaataatctattggttaataatggcaaaaggaaaatagaaatcacaaaaatgatgtgcattgtcttaatttgcttaacaaatcatgataaatgtatttttctgtcacacgtgtaaagtaataatgaatatgcatgagatgattggtttcaattggccctattagactttaatgggatttcctgtggcagacctgccgcagactgttcgtgtggcgtactggtatgcggcaagtctggagcaaagtttcatcctgccgcagatctgccgcagactgttcctgtggcatactagtatgcggcaagtctgcagcaaaatttcatcctgccgcagatctgccgcagactgttcctgtggcatactagtatgcggcaagtctggagcaaagtttcatcctaccgcagatctgccgcagactgttcctgtggcatactagtatgcggcaagtctgcagcaaaatttcatcctgccgcagatctgccgcagactgttcctgtggcatactagtatgcggcaagtctggagcaaagtttcatcctgccgcagatctgccgcagactgttcctgtggcatactagtatgcggcaagtctgcagcaaaatttcatcctgccgcagatctgccgcagactgttcctgtggcatactggtatgcggcaagtctgcagcaaaatttctttctgccgcatacttcggcatactctttgccgcagactaaaagtctgcggcaggtctgcggcagatctgcggcaggtctgcggcaggtctgcggcatacttttcactttcctatgggtatacttctttcaactttaagtaaaactaaacatcaattatagatgtaatgacatattaaatgtgcaatagatatctctagtctatcctatgtgtgggtacacagtatacacatgttatacatttgccatacaaattactgtgctactgtgtaagtttcatacaatgtaaacatcttaaaaactacctttttgatattgattttcataatgctcaaatatgtggtttaactaacctctgtgcctccataatattgtagaaacagctctcaggaacaaaggatgctccagaaaaccacagattttcctcacataacagaaatcatgttgcaaacatgatcatttcaaatcagccaacaacaggtggcgccaaacaagtttctgaccttcaaactagaaaaactttaaataagaactgtcaaagtaatctttgaccaaacgccctctgttgttctattattgcaatgtcaagctaaatcaataaatactaaataaaatgactttaactagcaaatacaaaattacaactttcacaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaattttcagactgttttcaaaacaatatcatgtgtgtcgatcatagttctatgaagcttgatgtctcatggtaatttaagcaatctaagcaacaatttttgaatttttgcgacaatcgttcgcctttgctgctctttaatactattatgacgtgcagtaacaaatttaacagttgattccacttggttgattctattgttcgggttatttagcagaacgagatagaaattgacattctcatggcttacgactttgcgttagtagttgttcatcgtctctacaatgctatttgaacaatatttggtgacaaaagacggaatttccatgtagcttcaaaagccatcaaataacaaaaacatggcagataaaaagatcctcagtactgggtctaataatttaaagaacacttaatttgaacccggccatattctctctctctcactcgtttgtcattgccttcattttccctcgcttacttcattcttaccacggaatatgtaatatgtatgtgtaggcctcattatgttaattagggtcaatggtcaaattgtctcaatatatcttccatacatccataatgatcaaggctaaacagtagaaacttgacatatggatagatcataatgggagaagcatttatataacaatatgacatcgtgaaaatgcattcttcattatgtaaatcatgagcatacgtatcacttaattcgtcaaagtgacgaattaaagtctagttataattattattatatcattgttatcatctgtattatcagcataatctacaatggcagtagtgtagtatagtacatgtagagttaggccttatagtagaggtatcattctgatcattattattctgattatcttttgcaaaacgtctagacgataaactcatgacaattgacaattgtcatgaatcattgtctttaagtttaccattaaatgcatctggttcgagttttgctcaggtatttggtactggatgatttaaaaggtagaaattaacttgtgtcctattcattctagtcttattcatttgcgttatgttttattcattcaagttctaatgtttctgactgttttcaagacaatatcttttgtgtcgatcatagttctatgtagcttgatatctcacggtaattttgagagaaaagcaatgcaagcaatgatttctgaattgtagcgacaattgcgttcgcctttgctgttcttcaataatatttgacaagcagtattaattaatttttcaatgactcatgataaattcgtttaacaattgattaccctctgttgattcttttgttcggatttttttgcggggaaaatagaagtgaatgtattattattcttatttgttcatcgtctctacgatgctctttgaatcaaaaacagcttttagtgttaggcttcctgaaagaaatttcaattgttgttaagaattttttgcttgcactctgtagattatgatgatgtgtttgatctttttttcaatacaagatcaaacacatgatgaaaatctactggctgcatgccaataagttcttgacaacaataacaaaacgtgagctagtgctattcggtttgacgtacacatggcaatcacatggtagatacaattatgatcatcagtactgggtcaaataaattaaagagaactgaatttgaacccgagccataggatatcccctctcgttctctctccctctctctctccctcttcgtcgccttacttttccctcttttaactccctgtgcatttgtatgcctcgataatacagaaaataaacaataagattctccctcttcctagtacatgtagtaggagtagtattagaagcagtatcacaataataatgacaacaattattattatggttagtggtgttactaatgttatttttgtaattatcaggtgggctgtatatcgtaaagaccaccttataatttcgttattgcctttgtttatttatttatttattatcaggtgggctgtagatcgtacagaccaccttataatttagttagatttgcctttattatcaggtgggctgtatcttatacagaccaccttataattttgttaaaatcgcctttattattctttattgttaggtgggctgtatatcgcacagaccaccttataatttcgttagaattgcctttattatttatttattcatcaggtgggatgtatatcgtacagaccatcatataatttcgttagaattacctttatttatttatcaggtgggctgtatatcgtacagaccaccttataattttgttagaattgcctttatttatttatcaggtgggctgtatctaatacagacctccttataattttgttaaaattgcctttattattaggtgggctgtatctaatacagaccaccttataattttgttaaaattgcctttattatcaggtgggctgtatatcgtacagaccacttataatttcgttagaattgcctttattatttattttacttatttcaaaccacttttttgtaagcacgattacttgaaaatggctcaatcaaatgccttcaaatttggcacacatttatgtataggcatatgtacaaaacacaataacgttttcaactatgacctttactgatgacgtcaactaggcgccattttgtaaatttttctgaaaatcaacttatgatcatatcttcataaccaaagccattttttattcatatttttcatgattgaggtcaatattcgtccggtcaatttcaggtcaaaaaacgcgcgcgtgcgcgtacgtccacgcgtcagtgcgcgcgcaaaatattaaaatgctcaaaatagtctcaaaataattgtacatacgttttaggccattttaagcattttataaaaaaaatctcgcacacgcgcgttctggcattttgcaacaaagaatcgccaatttttctttgtcatcatattttgcacattttcccaagcattttgataccttgttcacatatttctgaccattaataacggagtgagcgtccgtttaagatacacgtccgtgcgagctcttgtaatacatagcatatatgggaaaaaacatgcctatacaaaatctattgtaactctttaggatgcaaggtgaccccaattttgttttcatattttgatagattatgaattggagatatgatttcatgtctcatgtgaccctcaattaacgcatgacgtcttcataatggcctccgaactcaaaattccaatttgcatattatgacgtcagcatatttatggaaaattgattgtatctctgtaagtattgatcgattttcttccaaattttcatatgttctagctgagacaattttctacaaatgcggttcctattatttttcattttgacaaaggcattatggcggatttttgcgattaaaagaggcatatcaatttttcaaattttacgtgtattctcaataggacatgagtttttctcaaaactggattctacattcccgtctttcgcgagcaatatctctgtcgttttagcttcgtttacgctgaacttcgagtatgttgtagctgagacaatgagctatctcaaatgtgccctttattttgtctcaaattttagttcgaccagtccacctatacttgttccaaacaagtattacaaatttagttattctttcttatttctaaccacttttttgtaagcacgatggcttgaaaatggctcaatcaaatgccttcaaattctgcacacatatgtataggcatatgtacaaagcacaataacgttttcaacattgaccttgactaatgacgtcatctaggcgccattttgtaatttttttggaaaatcaactcatgatcatatcttcataaccaaaagttttttctcattcatatttatcatgattaaaggtattacaaagttttggtatgggatcatgaatttggttcaaattaacatattggaagcatatgcgttcctacaatattcattgatcgttgtcgcgattgaaatcgagtcttaagttatgaaattataaataataaactctttatgttgtatagctccctctcaaggtcaagattttaatttagctatgaaacaatgtttcttgactaaaatcgaccgattagctaatcccatttggaaattatatatcacaattacatattctgatattttcatggtcgcagctcccattgcacggccataggcgctattttaactttgtcaaaatttaccgggagcaccggtaaacttttatattcaatttttctcgaaaacagaagtgttttaggggctaatttttttagtgcttataatacatccacaggggcatccaaatatatcaaaattgtaaagattcactatcgacccaattttcaaaatttcccaaaactttgtattacctttaaggtcaatatccgtccggtcaatttaaggtaaaaaaatgcgcgcgtacgcgtacgtccgcgcgtcagcgcgcgcgcaaaatttaaaaaatgctcaaaaaaactcaaaatcatttagcatacgttttaggccatttacagcattttataaaaaatctcgcaaacgcgcatgcgcgcgcgttttcgcgcgtcctgacattttgcaaaacagaatcgccaaattttcttcgtcatcatatttagcacatttttttcaagcattttgataccttgttcaccttttcctgaccattaataacggagtgagggtccgtttaagatacatgtcagtgcgtgcgagctcttgtaatacatagcatataagggaaaaaatcatgcccatacaaaatccatgatatgttctagctgggacaatcttctacgaatgcagcgttcacaatttttcattttgacaaaagcatcatggcgtatttttttcgattaaaggaggaatatcaatttttcactttttgcgtgtattctctatgggacatgactttttttcaaaactggactctacattcccgtcttttgcgagcaatatctccgtcgttttagcttcgtttacgctgaacttcgagtatgttgtagctgagacaataagctatcttaaatttgccctttattttgtctcaaattttagttagaccagcccacctattcttgttcaaaacaagtattacaaatctagttattattattatcatcaacaatgtcaccggagcaagtgtcgcttcaggcggagcaaatgtcggcggagcaattgtcggcggagcaattgtcaacggagcaaatgtcggcggagcaattgtcggcggagcaaatgtcggcggagcaactgtcgttcgaggagcatttgtcaccggagcaattgtcgcgttttgcggagcaattgtcggcggagcaattgtcggcggagcaaatgtcggcggagcaattgtcggcggagcaattgtcggcggagcaaatgtcggcggagtaaatgtcggcggagcatatgtcggtggagcaaatgtcggcggagcaattgtcgcgttttgcggagtaaatgtcggcggagcaatcgtcggcggagcatgtgtcgggttaccatataaagccaatgtactcttgacgaccgccccccccccttcccaattcgatttgtgtaaagtaaatttgataatagagagaaaagtgatgataacgataatgataacaatgatgataacgatttttttttttttaaatctgtttctgtcaggacaatacaaattatacatttattcccatggccaatggagagacttttcgcccagacctgtctctttaggtggccataattatataacccttgtcaatgtttagatcaaacagaggttcaactcacccgattttgttctcgacagagtattcatatatatttttaccctaaaaatacaatttcacacttgactgatttgatataaatgacagagattattgccacgtacaagaatctgtagactcatttcacaaaaacttgcactgtattcgttcaggcatatagaagcgctataaactgtaagtcaacagcaaggcagcgacgtgtacaaacctcaattagcaattgaatattgggcaaaaggcgttaaaagtagcaaggataaacgaaaagagagttatatttatacgttttggaagttgaatgtgatcatttatcagtgaattgggtaagtacactatcgtgccactatttgtgcacacttctgttccaaacacttaaacgtgtagacaagtttcatataggttgatcaaaataatgttaaatatacttgattacgtggtgttctactttggaggttgatatagcatgccttctctttgagcatttgacgtatacatgctgttaaagtgactcggtaacattgttgaaggttgatgaaaaacattgcttaatttttgtataaaatgttacttattatattccttctactatactaaccctctgacatgcaaaaaaaattcctgaacaaattctcaaaccacaaagatatctatagttttctttgaaggcgtcgatgtgaggcaccctctaacagtgaataacagtaaattctcccaaccatttttgaattttcccaaccgtttttccgtgagaaaaatacataaaacaggctataaaaatctgtcaacacttaactgtcctggaatgaaatgtagagcaattttattgctttgtgacgatttacattcacctaaaatgtaattaaattgtccttgtcttgatgctgaagaggctttgacaagtagcagaatagaagtagaataatatagttgggagaattaaggaatcgatcagatcagtttttcccaatttgtaccatgaataatgatccgttttcactcaaactttcagattatctttaattgtacatctagcattgacgtcactaccttagtaccgctatctttcatctgaacaatgttacaaagtccctttaatctattgacaaagctgaaacaaaaagtgttcatggtccattgaaatgtcaatttgtgcagtttaatataggttatgttgatgatcaactgtaatttattatgtagggtttatttatttttgggaagtaaaataaccatttcaggtttttatttttcataatgatataaacatattcacattttcagcatttgcctccatttctggagggatatacatggttttataatattttcttctatctgtaaacgataatttaataggtaaatcaaaatatgaagaagtctctcttttggtcttttctttttaagttcttttccaacaaagcttttgtatatagtaaaaagtgcataattcaaaataatatcaacacttttttccttctttgaattaaaatcaataccaaacaatacatgacatggtttcaaattaaaattagacatgaaatatttctttatatccctttaaacttcactccaaaacttaatgacttcgttacaaataaaggaacatgtgcataaaatcacctgtttgattacaatataataaaattgctcagtggcatttaccttccatttaaacaaattatatggtactgcattttcagtttaacttaataaaatttggatttgactttaaaagattattattattattattattattatgaatttgaaatttaaattaattagtaaactgtcttttataccttttaacttaaataaccaattcaggtacatattcaatttccaaagtattacggcaaaattcctcccctctagattcttcgatttttgtattaatcaactcatgatatattcttttaactgtcaactgtctaactgaaatcatatcctcaaccaattttatatcattatatacaaacgctgtggatctaaatgttatatactctctatgttctacattcatatctgcaagtacgaacacatatgttgaataattgtctcgcactgcctcacggttatattgggagcatgtgattgtattcgatgaaggcttgcagagcaattcttggactataattatcttttctacgcccagctttaaaccttaattctcttcgggtgcttaatcaattgtgcgttatgtttaatgttggttaaacttcatgcgtcatgttgtggtgtgcacagtacaagcttcttatatacgtatcttacataattaagttttgtttagtagtattttagtgtattttgtatacttttttaaaaacttttgttttttgttttcgtttttttgttttgttgaaatggtacaacaatttccatgcgttcgctgtagtaaatgtgttaaagcaaatcagaaagcacttctctgtacttcttgccgaaactgggtacacatatcatgttcagaaatctctgtaaagagttacgatgaccctaacgagcattttgtaaatttggagtgttcaagaagtcttttaaaccatcttccaaattatattgtgaataattcagagtccgacgtcgacgattctaataacatagatccctcatgtaaatctggtgagaacatatctttaaaatatgatcaactttctagtaaagggattaaacttgtccacctgaatattgtaagtcttttgaaatatcatgaagaaatcaagcaaatcatgtttgaaaatgaaatacaagttcttgctctgaatgagactagattagacagctctattgcagacagtgaaatgtacatcccccattactcattacttcgtaaagatagggatagaaatgggggtggagtggccatttatgtccatgagtctattcatatcaacttagtcatgattctcttgaacgtttagaagcattgtgcataaaagtttgtttgaagaacacgaagccaattatttttgtaaactggtatagaccaccaaattcaaaagtcgaggtctttaatcactatgaggactttttggtttttgcaaatggtctcaatgggcaactcattattatgggtgacattaactgtgatatcacgaaaaaaccttttgaaggatatacgtaagtctataatcaaataaattatatatattgtttgaaacaggtaaatgatacattgtatacaagagtaaccgatagatcctgcatacttgttgaccatatgttaacggattatcccgataaggtggaatcgtttggtgttattaaaaatggtatgagtgaccattatatcagttacttggtgtggaaatgtaaacatacttcccaaagtgaaacatttgtatcgttcagaaagtcgagaaatgtagatttagaagctttcaggtctgatttgcgtaatcaaaactggaagaaagtaaaagagtttagtgatataaatgatgcagttagtgaatgggaaaagttgctgttggaagtagttaacaagcatatgccattaaagacaagacgagtgagaaaaaaacccctccccatggatgaatagtgaaatacttactttaatgaaacagagagataaagcaaaactgaaagccaaaaagagaaacagtgatgacatatggaaactgtataaacgcatgaaaaataaagttaccaccgagataagaaaatccaaacgtaaacacatatgtgataaactgtctgaagtcaccaatagaaatgaatcttggacaacactcaaaagtttaatgggtagttgtaattcttctaacagcacttttccaaagaaaattcaagtgtaatagcgaatgagtttaataaccactttgcagatatagcgacaaatgtatgcacaaataacacaagggctaataaccggctttattcccatggtgaaaaggtttctgacagaaaatttaaatttgttaatgtatctcaatcttatgtcttgaaacaagtaatgtcaatgaaaacataaaagtccgtcgggttagacgaaatttctatgtatattcttaaaaagtcaatatctgaaatgattgaatcttttaactttttaatcaacaaatctttatcggaaggggttgtgcctgacaaatggaaagtcgcaaaagtaataccaatacacaaaaaaggagataaacttgatttcaataattataggccgatctcactgttgccttgcgcctttaaagttatggaaagagtcgttcagcgacaattgcttgattatttaaagtgtcaacactccaccgtgacagcactagccgcagtcacagatgattggttttactctatcgataaaggtaattacattggaacaatttttgtagacttgcaaaaagcatttgatatggttaatcacctaatccttgtatctaaacttgaatctatgggtgtaattggtgtagaattacagtggttcaaacactatttatcaaacagaagaataagaacttcggtaactacgaaaggtgtgccgcagactataatcaccttgttgttgtacctctttatgtatgtttatatgatgtttgttttgtttgtttgtttgtttttgtttttgtttttgtttttgtttgtttttgtttttgtttttgtttttgtttttttgttttgttttttttcttttaagtatttgtattaagttttcgactgatactatgtatattttgtatattgtaaactggccccatggaagaccagcagcaacaattatagttgcagctgaatatgggcaaccagccgtatatttgtatttgtatctgattttttttattatacggaaataaaaacaacaacaacaacattcccaagtaagaagaagaggacgaagaagaagaagaatggaaacattaatagcacccacaccacggttacagcatgcctacccttcctaccagttcccatttttatttaacacatgggtttgaagagagccaaatgaaatacaatgtcttactacagatctagagtacatagatgtactttaggccacttaagaacaataataagtttcatgtgcccccctctatctctctttctttctgtctctccatttctagttgacatttcggtacaatgggagtaagtagggagtatctgatcttcagtgtagcgacgattgcttccgctacctttgtgattcttaccatatattcgggaatggaaaaacatgaaaaaggtagatattatgtttatttttctcttttaatcataattttgattttatttaaaggagagggggcttgggtaatacctcagtcatatctccagaccgactcaacactgatctatgttggcctttagggataatgtaatgctttttttttcgggctgttaccggtctgatgtcggtctcagtggtatgactagggtagatcaggccccctcttaaatttttaaaaatgcgatttattctaattaatcgcaagtccgccaatcaatcgcaagttggcagtctctcatctcgtatgtgcatagttgctattgatatcaatcgcaaatacgattaatcgcaactgttcataagacagggcctaaatagaagcccctactacatagtcaacacgtccctatgtccacgaagtgacggatgagcgcgcaattaaaagaaagttagtttcgaataaatcgctttttcaaaccataatctcaacctctttattgtatcaagggcaaataaaataatgttatatcctgggatacaacatatctcaatatttagttctatgtttaattatttccatattttcttatacagtgcgtcccagaaaaaacgaaaccgagaagtatcgatgttttatcataacttaatcacaaccataattaatgaatgatacatatttggaaagcttagagtctcctctttcagttgatgctactccgatgatgcatatttcaggcatgagtgattaaaagcaatttgaaggaaggaaaccaaaaagacatttggcgggcggtatctgaatttcgaagtaaaattcacatttctagaaagttgagtttctgccctttcgtatgacacctcaatcaggaaaaatgagcgaggaata

SEQ ID NO: 65022 - DNA, 22765 bp, Oryza sativa
tcaacgaaacggagttaagtctattgttaatttcgtttattgatacggcaggcagccagtgaaaacgaattcgtttaataaaattatggaaatgcaagcactactttaaacaaacagaactttgtcattcctcgctcattttttttcaattatagttgtgattaagttatgatagaacatcgatagaagacgacttacattaccattctcgacttcttaatccttgtctgaattcagtcccccccccccctcccccttcctcctcctgggcgaagcgcggaagctttgacgtattattagacaaagacgattcgctgtacctcagttcccgactctttttccctctttcttcgtacgtcctcttactttttttcttctctttctctctctctttttttttggccggcgttttttggggggcgaccgcccccaccgcccccctggctacgcgcctgttaggaagataacgttaccactattagactacggcaatgtattataagaatgaagggccaccaccaaccctagcagggttgttatgactttcttctgtccttcaatcagagcgataatccttccgtctgtggaccacgctgttgaggttttttcataggcgatgttggctgttttattggcattttcgtgttggttatattatacgcacaaccagccggcccatgtattgtcatttttaattaaataattaattaacggtcaccgtatttttttgaaagtggagctgaattggtatgattattttggggtctaaagttaccttcatagcaattttaggttctaaaagggcactagaaatgtcatagataagaataagagcgttaaccatgcactttgaaggcatttgcggtctgaaaacagaactcaactatccctttaagtgatgcacagataaaataacccggaactgcgagatagagtacactttcctctttctgtagctgctttattattcccctgtttgaacttttacatagcttggctacatcgtttagattagttttattttgtttcctatttcatcatatatatatatatatatatatatatatatatatatatatatatatatatatatatatatatatatatatatctatatataataataacattcaatttggataatccttcgtcaccctcattttacaaataataattaaaacgagggggatttttcattagtgatcaaaatactttaaacagctgaatgaaggattaaactttctgccaaagtaatgggattatttagaaaattagtaataacaaatgtggatatgttgccttgcattcctccgccattctacacgcgaaattaacattagagttttggtgtagctcatagaccaaaattataattagagtgtctaaatcatttagggattatgcgagatttctcatattggctagatgtaaaaagtgattttaaaaaaacacgtatttattttctttaaccatgtacagatcgagttttacaaccaagaatcacaatgtcacaacggtccaacgatcactttctgcagaactgtccggcaacccaggtataagaatgctcaggagcaggcgcgtacgcaggggtggggtgttttgggagttgaacccccccccctcaatttttgtaagggaggtgtttttaagaaccccccccccttcaaaaaaaaaatgaatacatttttttgtgggtgctaaagggtgacaaaaaaaatgagtttaccccccccccccccccctacaaaacgaaatatcggtaggcataattttccaattccccctcccttattcagcggctggctgagtccttcgaaattttcggcgcgattttcaaattttaaaagcccctcctcgaaaaattccggcgtacgctactgcttagaattatgacaaggccacccaaacataggtcgggtcggggcaaatgggtgagggggatagggtgctgcagtccacgagaattataacaacatttaatcatcacactgtgggcaccaagatgacgttttttcctttctattttcattagtggtggaatttaagatgcgtgaagtatttatcataaggtcatcactttctagtctttaatttcttcccgtaataaacatctcggctcttatatgttctttcacgtgaatctagatcgaattgaagctagatctacattattaagactgatcgcgccaacaatctgaaagtaagaatgaaggattataaagaagcaatgtacctagtcgtgtgtattctctcaaagttgggaattctttccttctcattctttatttccctctctttctctttctcccacaaacatgtatactgcacacacgcacgcattctctctttccctcccatcaccgctccctgtcttactcttttgcccctctttttctctctctatataaatattttaattcctccaccccccccccccccacctccctcccccattccccttctctctcttgtttgtctctcgctctctctctctctctatctctctttctctctatcacactaacgcacacacacacatacacacactcgtacacacataatctctccctctctctctctcgctctctctctctctctctctctatctctgtctaccctactctcatttccccgtccataatgctttctcaattctaatgtgttctttttttcttgtatcttttccatgtcgtatacaacacggacttgtggaccgctacaggctttgcgtcgacacacccaacgtcatggttgttcctccctcggcttcagtgacaaagaaacctacaagctgaacaaaataattacaaatccgagctaccttcggaatatctacgtctccgaaagataccgaaccatcatctgtctcattccgaaagcaaccagcatgaactgggtgagaactctaatgatactagagggcgcgatcaactcgacgaatggcttggcgccgcaagaaatagtacatgcagccaagaagcatctccgcgtgctaggccagtataaacctgacaagaggcttggtatattacggaattactcgtcggcgatcttcgtgcgcaatccgtattcccgtcttctgtccgctttccgtgacagactggagaagtaccccaatcggaatctgtcacatcgtaaatggtttaacaaaaatatctatttgaagttcgggaaccattctcccgcagagatgccggatcggtcgatgccaagcgagaaatacaacgtcactttcaaagaattcgtggacttttacctgagtgtaaaaaaaactcaggacgtgcactggcgagaacaatacaaagtctgcccaccatgtttcgattacgattatatcggcaacgtcgaaacgtacgcagacgattttaagcaaaccgttcagatatttgatgccacttcgaaagtgccacttgtgaaagcgccacatgcgaccaatagttctgaggatggcgtcttgcggaggtattatgaaacactgtcggatcttcaaatgaagaagcttgaaaagctgttgagttcggatatgaaattgttcggttattcgattcctcgagcaattcaaagaaattcattttaagcctcgttcacatgcacaaaacgcggcaaaaccgcggcagaattttaaccacgttaatgatgacgtagagtaatgcacttcacgttgctgtatcttatgacacagctagagctcggtcaatatgcgcaggatcttcgtggcacacagtttaattaatttaaatttaaatttaatcgtatttcgtttccagtggttcaccgcggcatatctgaacaagccttcaatgtcagtgttgataccttccaattaaagtatcattacacatgttaagcatgatgtattactccatatccttaaaaaaaatattttaaacaaatcatagatatataataatggtataagggacattatagatgctatgttattggacctaattatgttcatgaccaatgattagataagaaagtctagatcaaacggaaatatatatgtttgccaaaaacaaaacaaaacaacaaaaaatcgaaattgtattgtcgaaaaatacatgtcaatataacgagtacaaaaaaagcaattgtatttccccttttcttcattattatggctatcgctgtcacacatgtttttcctttcaaaaagtatatacaacattatgctattaaagctccggagtcttatctcaaaggagaatgacagcccacgagaccgccacagccggtctcgttttaaggaaggttaaggtttgggatcaggtatagtaatgggtctacggttgaagctagaaattcgagctcactttgatccatcagatctccgcgtcggatttggtcgttaggtttactttcgttaaaacatacctctatattcacgaaaggtctggtaaattgagagcaaataatcaaaacgattccaaagatgactctttagatgtcactctaaatgtacatttgtgaaaacatgccgatacacccagaaaatgacgaagtaccgatcgctcgccttttttaacgaaatcctatgatcatttatcgcgtctcgcggtgaacgaaatattgtgacgagaataaacgaagacagcagtatggtcagctttcaaacgtgtgcgctatcagccatcaaatcggaaatatcgtcaatcaaatttactgctatgtttaaacatatcaatgataacaatatgtcgtcaatttgtcacgaattatcatctaattaaatgaccaagatgaaaaggttcgcagtttgtgattcaagagtaacccactgtcgctcagaagatgtgtcaaatattctgatacgatagtggtactactccacatccccgagatttaaatgaactgagaagagaaataaatataacttgcattgtgatctttaatattcatttgagtttaattgaattgaattgaattcattattcttctgcaaaattaaattaacaattcagcaatataacatatttactacacacatttatctactgctttgtcctttttatttatgtggtaatgtagaaatttccttatttgtttgttaaccaaagtatttagagataccatacgtgtgaaagttttaaacatgtagtcagggaccgcatcactaaaatggtcttgttgggactaggatacattcactgagttcatgtagttttctccaattttaatacttgtttactttttatatcatgaatcagacgccgaatatgttttaattgtatgttggaaaaaatttattttcaggtaaattctatgtacattatagtttgtaagacgagaagtggatgaatatgtaagaccttggtcaagagagagggtggataatgagagatgataatgctgaaggtgtcagtaagaggaaggtcaggaggttccgagtttaggagagaattgtagtgaatctactgtagtttcgaggaatgtacaattaaaatcacatgtgattaaagataaactttagtactggtattaatgcgatttttttttacaaaccaggtttgtaaaaaacgcgtcaaaacgcgtcatatgacgtacataaacctcggtttgtcgacaaacctcctttgtgaattcgggcctgagtggctaacggtgataatgtatagttcgactagcgcacacttgctgcacacagacaatgggttttgctccgtgagtgtgagtttgctcacgcatgtataaaaagttttactctttaaatagacaattgagttatgtttaatgagatgtatatagcagtagaataattaaaggaattatagtacatgtaattgagtgtgagatgttataaagtgatttagtaatagcctacagggtgcacagtgaagcacattgttgaatgttgctcggcatggttttttttcgttgtttatttagtggatggtgactagtctaggtgtcagaccttacttggtcagaaccagttcatgagtatacatcaaattatatggttttgatatttacaactatgtaatacaataatatcatcaatagagatatgttttgggttgggttatatagtagaggatgcattagtgcaggtagcattggccaaatgaccatactaaatgattgatatgtatgtcttaaatctctagggggtctgcagtattagagacctgtgttcactagcagttagcagcaccttaattattgagtagttgagctggatcacagccgaggatactccaggtatgagttagtcttttatgtgaatatgttgttaaaagacaaaggttatattggtagttttgttttatgtaaacaaaagcttaagtagctaattatcattatgtatatgaatgtcaatagacccatgtagtctttaattattttgtatggttactcacgatactaggagtatgagtcatcgctagtagtcacattattattctttccattgttgattcattatttacccttgttgaagatgcaaattgtcgttctgtgattaaattataggggaagatgtattctatagtagtcgtagttataagagaagtatatccggaatatcgattatgtcacttactaactatacactgtatgatggttcttcataataatcacattatcagttattcaagttcaggatacattgtaataattgagtattttatctgaaacgactttaaagacttgtgtttctgtggaaacacacaatacattttagttgttgttcattgtagttacagttatattgccgaaattagtacctgcaaacaataaggataattgtattttgtttcaaagagttcacatagttccagaagagtgactgtatagaatggcaaggggtgagactgtgtctaacagtggttgttgttcagtttaaaccttagttgggtgagtcagtcagaatggccaagttatgttgattgtttgttttaaggaataaacagttggattcatttaattggattgatgttaacgaatagtgataaaagagtcatatgttcatatggatagatagatgatagataaatggtttattcaaatcaaatcaaacatgtaaacaataaatgttcattaattccatgcttcgtagctaaaaactaaattgcgcaatggattacagaattaattattacaaggtaaaattgcacttactaataataaactactatagataataatgcaactcttggcaccggcgtcgaaccgctgccatgtgtttctataataagataacagatgatgatgtacatgtatattataatcagtgatctaatattgatgcatcatcttgaagtgcttgaagatgaccgtggcctctgccgagtttacaaaataaaagaacaaccatgcaactgcattgtattcaatgttaaataagatataagtgaagtgattaaaagtgagcatggctgaattaattttgattgaaaataacaaaacatatttagtgaaatatttcgtgctgagaagtgcatttgtgcaaggtgcaaaaatttagcttggtggaacaaaaagagacttaataccgtgatattaattgtgtgttggttttagttacgggtgttaataataaatatatgcagggtccattcctgttgacaaactaagacagaacaattcaagacataacacatttaaatttctatgtaaggtctagtaaacttgaaactgaaagaacagattattaaacaagtctcctcatttaactacctcggcagcatgatcaccgaggatgccagatgtgagacagagatcaagagaaggatagctctcgctaaatttgcattttcaaagctaggcaaaattctgacaaatcgaacaatgagtatgaggaccagaataagattattgaattgttacatctacccagtacttatgtatggtagtgatacatggacttcagcctctgatactaataaaagcgtttggaaagttgcaaaatttggtttttaagaagaatgatgaaaatcccctggactgacaaagttagtaatgaggaagttcttgcacgagctggagtgcaaaagaaactgatacgtgagatgttgattaggcagttgaagttcatgggtcacattacacgtaaaaaaggcctagagaatcttgctttgacagggaaaattgtggaaagaaggagcaggggaaaaaggaggatactttggatggacagtctgcagaaattgttggaagagagaggattgaaagaactgggagtggtactaatacagaaggctaggaaccgagggttgtggaacagcatgatcgccaaagtcaatcgttatggcacttagagagagagagactaaactataaactgagttaacaaaaattaatgtgtgatgtgatgtatcatattttttttacacaactgtttagccatttttgcgaaaaaattccaagaagttctctggtgaaagagtctaggtcgtcagcgcactgtgtgcaagcacgtacatccagggaagggaagatgatagaaaggggaaaacaaggatagaggagaggatttggagaaggaaaaacaaggaaatacataaggaaagagaagaggataagtcaaaggaagaacatagaaatacaaaattgaagagctaagaggatcatagatctagactaaggaaaaacaggcaaatacataaagaaggagaaagggaatctatcagattaaaacaaagaaatagatgcatgacgaaggagaaaaggatagattgaaggagaaacaaagaaatacataaaacaaaagagaagagattagaataaaagagaacaaaataattacagaacgaatgagaactgggggatagattgaaggaaaaacaaagaaaattaacgaaggagaaaagggatagattgaagatttaaaaaagaaatacatgacaaaagagaagaggatagattgaagaagaacacaaaaatacataatgaaagagaagagagcaaggatagatataacccgaaacaaataacgagtatgtattatgtacaactccagcaatccaacaaaactgctgagggtaatgctagactctgtctctagtcgtttgcacagtatatttgactgaagtggctaaacagttgtgtaaaaaaaaatatgctcggccggtttgacctttatttatattccctacacttgactcaagccgccgaagatggcgttatcaacgaactcattatgctcaccagcccagcctaagccttcgcaagcattataatcgaatctcttttatcataattataggcctacataccatcgagatatattttaaaaagcaaatatctctctgtgtatctctatgccttatacaaaagtcatagacaccatcatgaactatgttggtttgtaatattaacagtcatagtgcaccgtgcataaaaaggattttcaccagcctggcgccaaatttgtcaacatgaagcgctttgaacatttaattagaatggataatggcgctatataaatctcatgtattttcatttttatcatgttttttgtgagcaaatattggaacaagaagagcaaaatcttggatgacatctagacccggtggggtcactcaatgtgacttccggaccgcaatgaccgttaccaaaatcgcggaaaaaggggtaaatttcaagcaatgtccgcggacaaaatattcctcgaaatatagaaaataggggtgcaaaggtgtcctcgaaattgataaataggggtcaggaaaagggaaaagagaaaaccgggaagaaaaattcttggagcagagttttgtccttgaaatatggtaaaataggggttaatttgcgaaagagtccttacaatcttataaaaaggggtattccaaagtacgattttgtccttgttttgacgtaaaaaagggggttaaatatcacaaaatgtccttgaaattgaccgcaataggggggtatttgcatttgtggtaacggtcatatgcgtcaccttctgcgaaagagtgaccccaccgggcatctagagcgttattaggatatctctaaaagagaacaagaagttcacaaacaccaatctctaaagcaatatatttgttataacaatagtgtagttttaattgtgtactgattgatattcgtagtatataaatctctacagcatccaatttgatatatacataaatgaacaatctagtttatgtacgtttttgagaagctatgctgtactgctataattaaaacatatgataagcaaacaaaacatttccaacttatacaccagactttctggaatagctgcttctgtttgaccatcattcctgtgatacttccactgacaaggggaggctttctaggtcttcatttagaagatcgtcatcttcagcagttacttccactgtataggaaagacttcctaggtcttgagtttgtagatcatctccagcagttactttagctgtgtagggaagacttcctaggtcttgagttagtagatcgtcttcttcagcagttacctcaactgtccttggaagatcatcatctccattagagacttctactgtatattggaaactgtccgcctctcgaattgatgtatcatcaccatttgcatgttcaaccgatatttcttctgcatatgggagattttcttgttagccattttcagtagaaacttgtaccgtacattgaaggatttcttcagtttgtgttttttagtattatcatgatgatgatcaccatatatgccgtttgttggaaccgccatcatgattttattccacttttcaatttcttttacagagttcaggaaacagtttttctctcttctgagccaaatttgcagaaaaattatccacttcttttcgtcattaaaggtacagtagcaacactgacgaatactacgtgaaaagatgagaaaataatgacaaaaggtggtgcatttaacaaccgcaaaatggttttaagaaacctgataggggcttgactctatataaaaaaataatattttgttcaagtcaaaattaatcattagcaagaaaacatttaagaaatgcaatgtgttcgaagtttgaaacgatgtaatttctttagaatgattcagtaataaaaagaacttaagaaatttggaattctctttaatatttatatttatataaatttgaaaatctaaaagctaaataaagaagaagttgacaataataaacgacattgtaaatacgtgtttttattctctaataatatcgtttttcattaagatttatgtaattcatgaaatcatcaaatattgatatgtatcattgatttctaataacaaaacaaaaacaaatatttgaaacatgcaatgcaatttgtatgtacattactgactcctatccgaattagcttcttttcttcctaaatgaaaggctcttcttgaaaatcagttgtcattgctattaaatgttaaatataatataattttgggtataatgtggaagaaaaggaagggggaaaaaagcatgctattttcatgcttttagattaatatcaagtatatgtatcatattcagtgctatacatatgtaatttgatcacgttacgtagtatagagttatgtggtacaggtcgccattttgaaaatgtttgaaaatcgacaatcaacaaactctgaaattgcgttcacttttcaattatgttttaaggtaattttcctttataatttacagatttatttaaaaattgatgatgtttagtaatactcttattcatatcactaaaagcataatgcgtgctttatttggatgctgccttaccgtaatatggtgattgaccactcactcatagcgtgaaaacgaattctgaaaatttgttacatattcctgaacttttagccatttatatgatagactggatgttcatattggttggtcattaacataagataggaaaagagtaaattttgcagacgtattcaaaacggaaatcatgagtcctatatacacacgggtatttgcctacaaacatgtggcgaacgtatgctggtctgttggaggcgatgcgtgggtttcgtatacagggggaagcccctatatagtaatagcggacggatcgttatagtgttggagatggagcttggggtgatatcggattcgtgtataataaaccaacgaattctgacattccattcgctttttaatggtgtttttaagtaattattcttcataattcatcatagatacatctagaaatgtataatagtaatactcctattttcataaaattatcattacaagcataattcctcatgctttatttggatgccgtttacaatatcgtcatggaccattcactcatatataggaaaacgaattctgaaaatgtgctacacattcctgaacctttagccatttatatgatagactggatgctatagatcatattggtcggtcataaactaaatataagaatataatacagtttgcagacttacgattaagctcgacggaacatgtcctactcccttttctaatcacgaggcgggtatgctgtgcgagcgtctgacagtctaaaacccaacaacattgtaataaaaatagtgttttgtaattatgatgtagagtgtgaggaaaggataaatgatgtttaaatataggattgtaaaacaaatatattaaatattttcacaagaaattaccaacttttatcaggaggaaattggaagataaaaatacaaggcatgaacataattatggacccggcgtttaatatctatcacgtttctataacaaatttgtcaacactatacaaccaatcaaatgcaagcatttcagtacaacttatattaaagctatcatgatttattattaataacaacttaaattgaaaaacagagccctgatttagcagaaaggaagaagaatactattgacttttaatcaattcaatattgaaattgcccttatattgactcctcgaaagtcttcatgatcgtgcctgcctggctaccatgactgccttcatcataagctggcgattggcgaccatatctgcactccttctgatcacttccctccactgctgtctattctgtgttgatctctatttgaggccatgacagtccattccttgatgttgtacaaccacagctttctctgcctgcctctagtctcctctttccttccactttcaataatttcatgtgctgctataggggccttccactaccccttaggatgttaccaagcaggtttcccagtttcaggctgactacctttccaaggagctctctcttggtgttaagttcttttaaaatacttatgtaagtttgcttgtcctttctgctgatcttcagcagtttcctccatgaccacatctctgctgccagtatgcagttgaagagcatctcatgtaacaaagtaagaaaatatgaattctgtgttgaactaaaggtcttagataatggggtacttcatttttattgcacatgtactatgtgtaggatttttaagtgaaagatagttttaataatatttgatcgaatgctgatcgctaaacaaaaattgtattgtattagaatagtttataatttcgttcttttatgagtgattccaaataaagttaccatgacatggatttggaggaagaaaagttgagtacgaaaggtttgaaatgatgaataaactaagcagaatcatcagagggtcttaccaaattcattcctactacacaataaaaagcagtcgtttattcttgtgactatagatatagggatgtcggcaatagagctcgctgaacagtcattgtaaatgtggtcttctagttttcaaaaataaagtgcttttacatagtaagtcagtcctctctttgttttgatttccctgacgaaccggtcactgatatttttgaaagatattatgctccatgaattatacatagtcacagttctattatcattattattattatcattattagaggtagaagtagtagtaatagtagtaattcaattcaatttattatttcataaaaaatcacaaacaatatattgtaatcgacgggggttacgattgggggtacatatcaaatacacagtgctttaatcatgttaattaggagactacccctcgatgttatgccagcttcagcattgtgccgaggctagctagagctcctcaaaacacatcagacctggtgtcatatactgacctttggaagaaattagaatagggttatgtttgaagattttggacaaatcaatatttcttcattgggattcccaaatgtttaaaaaaaaatagactgtcgtcatagaattataaaaaattatattttcgatgagccttaatgacagagaaaaggtcaaatagaatacgaggcgtattataacgtcacatccgtggttcgttgtttgacggatttaaatgaaagttgatatgaaggtacatggtatcaaaacacagcctaagttcaatttccgagtacgtaggtcaaaggtgaaaggtcatagctcattaaatatgcaaaaacacctaattatatgtgaaaacgtggttgacttccttaactagtaatataatagtttagtccaatggaggtaacttgttctgacgtacactgttggtcataatggtggaataattattttaccccaatttattgaataattttgacaatgattattcctaatagatgtagaaaatagtatacattctcagattttattgaatgataattggggagtgtttgttttgcgtgactgccaaagcatatgtgtgctactatgctaatcaactaggggacctacgtccttaagtcataactgacagtaatggggatcaatcatgaaagggcactaatatagcacatcgacacggtttttgattttagaaccacattagacgccttttcaggcacttcctggagtaatatgacataaaattgccttttcctaccccctccaagagtaggaatcttttgcaatttgagaaccacattttgcgcaataatgtccatcggcgcttcctggaagttagacgttgtacttgcttcgttgccgcacaatgcacaaagacggtggtccggtacttcaccagttgtactaaaaattatatcgagtgtataaactgtgttgttatgaggggcgttgctagatctttttcagtgggggaggggggagaggccaacgatcaccttcaaaacgagccaccaattaccgacaaatatattaatgccaatgtcaatgcacaaagacggtggtccggtacttcaccagttgtactaaaaattatatcgagtgtataaactgtgttgttatgaggggcgttgctagatctttttcagtgggggaggggggagaggccaacgatcaccttcaaaacgagccaccaattaccgacaaatatattaatgccaatgtcccaatgtctacaaatttaaccctgtaaacccggggccaggaactaagttatttttcagttttcctcctcccgcgcgcggaagctttgatacttcattaaattattagagaaagattacgatccgttgcaccgttctagactttttattcttgtttcgcccctcccgcgcgaagcgcgaaagctatgacgtttcatatatttattagagaaagaagacgattcattgtaccgttctcgactcttaatccttgcctgaattcattttcgcccatcccgcgcttagcgcggaagcttttacgtttcattaaattattagagaaagaggtcgattcgttgtactgttttcgacttacaatccttgtccgaattcagtttcctccctcccgcgcaaagcgcgagagctttgacgtttaattaaattattagagaatgaagactatttgttgtactgatttctactcttaatccttgctttcacatttcattaaattatttggaaaagaagacgatgcgtttccttaaatgtttactcttaatccttgtctgaatagagttcccccccccctcccgcgcatagcgcggaagctttgaagtgtcattaaattattagggaaagaagacgattcgttgtactgttttcgacacttaatccttgtctgaattcagttttcgccctcccgcgccaagcgcgagagctttgacgtttaattaaattattagagaaagaagacgattcgttgtactgatttctactcgctttgtctgaattcagtttccctccgtcccgcgcgatgcgcggaagttttgacgtttcattaaataatcagagaaattttctgaattatttttttcttttctttgtccgataaaaaagtcacagttcgtagggagaaaaaaaattgccggccgaccgacaataaacatctcaccgacttcaaacttttttttttttttttttttttttttaaagttttaactttaattaaattcagatcttttttactttaacggtctgaatattgagaccacgttgacaaggtagtctacctgactactggcacttcgccaggtaaactaaacgaagaattaaaacttttttttttattttttttttttatgtgttttattggttttcaagatacaaatcaacacatgaatcaaagaaatcaatttgaaaaaaaaaaaaaaaaaaaaaaaagcagcaatacaaaaatgttaacatagaattgtcgccagaagaataagacaaaatgattttcattcataaaaaaagacatgttaggtgttttccgcgttacttatataacaaacatggtacatagtacattgtacagggtatttttttttttaaagcatgttaaaagcaaaaatacaatttgcaaaggagctcaaaggtaacatattcaaatgttaaatctccatttccgaaaatgaatagggagtttgttattttttttggcaatacaatactcgagttctttattggccgtaatatagcatttataaccttcgaagtttggtggtttgctttggaatttgcatatataaatataatatttaagtaaaagaaacaaatatgtaaggaacctatcagattcgcaaccgaacattttttcaaatgttgagacatttagaggtttattagttttctgaataatagctttaacagtttcatcccaaataggcttaacattaggacattcaacaaaaatgtgactatatgtctcagggtcagtattacaaaatgaacaattgggggagaccttccttttaattttatacaaaaactcattcaaacctatagctctatgaaataacttaaagtagaaagagcgaatacgagtacttatagtgcatttaaagttattcacatgagtcttttcccaatcaacttcgtcaggttcttggaggtcattccaaaataagatttgacgttctggagaacatgactctagcattgtactgtatgcatattttggaatttttagagttttcaagagcttagttttaacgtcatcaaatattttgtcaggggttaagtcagaagtgactagcaagtcatttggtatatttctcaataaaaaattgtatttccgcctgtcttttttaccaatatcataatccagaataagctcttcaaaaagtttattacctgggtggggagggttgagtaaatcactgatatagacaattcctttgtccaaccaatcttcatataaaaaataatgttttgattttgaacagatatttctgttaaaccaaatacactgacaagagccaattgcggaaaagactgtaccgaactcagttttagcaaaattttctctaaatatataccatgtttgaagggattcagctaattgacatgaacctaatttgtttaatatgctttgaggagcatatgctttccatagtatatcctctctgctactgaaattatttaaaatagacatttcaatggacttccacacgctttgatatttatcatcaagaagcattttgacccatgacattttttgagcaatagagaatgtgtatggatctatcatttttaaaccacccaaagagtaatcattacacatgagccttcttttgaccctatcactgccaccattccatataaatttatacagtattgtatttaactgtctaaaaaatttcttaggtattttaatacacaacacagaaaaaaaataaagaacttgtggcagcaatagggtctttacgacacagatcttcccgaccagagataatttcttgcgcgccaacaatttagggtgttttcaatggatttgagttttatcttatggttaaggtcatataaatgatctgtggtcaaagaaaagtgaatgcctaaagtcttaaaagtaaatttattccacttcagacctttctcacaaaatggatacctttgacaacccttcaaagaaccaatccatattgcctctgattttgaaatattaagtttacagccagagctctcagaaaaaaacccaatagtgtcgaataatgatttaaaagagttatctgagccatcaataaagcacgtagaatcatctgctaacaaagaaattttcagttcattttctgcaactgggataccttgaatattaggattttgtcgaatagcaagagccatagattcaataactagcaaaaataaatatggggatatgggacacccttggaaaatacctctttccatattaagtggtctggtcaaattaccatagttagatacataacttttcctaccggagtaaaatacttttatccaatcaatgaattcattactgaaattgaattttcttagtacacaacataggaaatcatgggaaacactatcaaaagctttttgaatatcaaggagaaggattgcaccaggaatttgttctgattctgtatattcaattatatcaataattaatctcacattgtttccaatattccttccttttaaaagaccagattggtctggatgaatcaaatctgaaaggattttttttacacggtttgctaaagttttggctaaaattttgtaatctactgttaacagggatataggtctgaaattttttaagtaggaggcatccctgtctttttttggaatcaaggtaataactccgtttctttgtgagctagacattagtccattctgtaaggagaaattaaatgagtctataagcatatcagaaatatctttccaaaacacaatataaaattctacaggtaatccatccaaacctggtgacttgttatgtttcattgaagcaattgtatcaaataattcctttttagagatgggtttatcaagaagaaccttatcaacttcatttaattgagggaattcaatagagtctaaaaagtcctccatttcattatctgaattattgtcaccacagtgttttgtgtagagggtttgataaaatgaattaatttcctccagtatagcgtgttgattaacaataatatcatcatcttcattctttaatttgaaaatacttttcttctctccagttcttttttctaaattacaaaaatatttggagcttttttctccttcttcagcccatcgaagtcgtgagcgaataattaaacctttggtttccacatctaaaatatcatttaaagcctgggttaaaaaatccttttcattaataagctcattgttatttaaatcagcacttaattttttctctatatcttctatttccgccaaaaggtatttttttgcaaaatccttttccttctttttacgtgtacaatattctatacaaatgccagtaatggtgcactttaaagagtcccataaaatatttggattgcaatcgcttttggaatgaattaatttaaaatcttctattttgtcaatgataattctactaaagtctgcatcattatgtaaatatttgcaattcagtttccaaaatcctcggccccttagtggttgagcacctttaaaatttaatgtaacaagggaatggtcggattggattcctgggattattttagattgcaaacaattggtaacaaaattatcagaaacaagaatgaaatcaatcctggataacactctaggttttttttgatgtctcgtatattgcttcaggtttggatgaaaactgcgccaaatgtcacaaagattaaattcatccataagtgttattaacatttcctttgatttgaaatttgagtgggtgtccctacccccttgataatccatgggccccaaaacagcattaaaatccccagcgcatagaatggaggtgtaatcgagtttatccactttactgaaaacttcaagaaaaaaattggggtcatcattatttggaccatagagattaactaaaatcacaggtacctcattaatggtaacagataaaatcaggtatctcccatcggggtcaataaaagaagagttaaggaccaatgacacccgatttcgaatcaaaatggctacacctctactatttgaagcgtggctagaaaaccatgctttttcaccccattgttgtttccaaaattgttcatctgatttagaagagtgagtttcttgtaaaaatattatgtcactattaattgatcttaagtaatgaaaaatttttcttcttttgacatgatcttgtataccccgacaattaaaagtagctaacctaacattcatggtatatacacataaatacacaccaaatcactacacttgtagatgaagataacactgaaataagaattgtggtcataaaaaccagtcctatgtaacaaagctgcaaaatactgattgctgcatgatcatttgaaattaaaaaagtaattgacatacatgtagatgtaagcatcatcaaaacgacaagattaagacaataaaaaagagaaaaaggttgcacgagaacgaacggcaaaggcttcaaatcataaaacagcccaaaccaaaagtgcaaaggcatgcagaacagttctgagcagaaaaaagggtaaagtgacttttcgaactcccaatctaactaggaaaagagcattctgcaaacatataacaaaaaatgtcttgtgttgttggagtcagagggagaaacagtaagaattacagacaaaatgaaaatggcacagaacttttatactgttgtaaattgtaactgaccagggccacttaaactccacatcttgtaaaataaacttaaattacactcttatatgtttaaaagttcaccctcaccaaataaaggagagttagacatctgtcaataacatccaagttactgtcaactagcttgttaatgcaagttcttttgtacagatgacatgaacgtacggatgtatattctccaaacaaagtaagaaactttcaaataatgtgatgaataaaaaatgttgagtgctgtagactccacggtgaaatagccagaagcaattaattcacacctacgtgtatctccatagacctatataggaattcttcagcagaacgtcataaaacaaacataataatcagggatgaaactggaatgtcacatgaatgatattatcccataaaaggaggacagcagaaagttaagcgatgatcatctttccatctggattcctatgacataacttgtccggaaaaacgaaaaaaggccttttgccctcttccttgagacgcttgaatgaaccagccttagcttttctgagttggagaacacgttgcgagagatcctccgcaacgaaaaccttgtggtcttggtataatgatgtagtagccttaagcttcttaatgcaggcttttcgggccctctctttcgcagtgtaggcgccaaaacctaagtggatcctcctgggatattgttgagaattctcctttacctggggccgaaatgatggtgtacggtgacatcgttgaatatccttgataacatcctcaggcacctctgcaaaacgcatgaaatcttgaatcaccttcctgcagtcttccttgttatctgattcctggatcccaaagactacgagattatttcttctagaacgattttcaagatcgtctaacttgctttccagctttccattctctatttgcaaggcctgtacagcatctttcatattatcaacttcaaaagacagacatttgatcttctcttcatgatctgcgactttaaaagtaaggtcacccagttttttgtcgagaagtgactcaatacgagcctcttgtctattctcaaaatcagcaaagaattgtacgaaccattgtggtggcttgttcattgataggtcggctactgccgctggggtagagtgggaaactgatgagagaatgttccgtttcgctggggggtcgcacactgtaacgttcccggcggttgccggggaagcctggtgaggaactgctgagtccgcgtgctcattgttcaactttagtttcttactgagtggcgagttattctccatgattacgcataaatctgctcgtaatattgactataagtttaacacagtatcacagaagagttgaaattgatagaatttaccgtttataagtcacacatattcgtcaccggtgataaaattctgctcaaaactgctctcgacgcaaatcacgtccacatgcgaaacgcggccattttcgtccattctcaccgacttcaaacttcgaaattgatatagtacacgagctagatagagcaagaataccgacacagcggacccgacacagtacagcaacataatttatctatgcgtatctttcttgctccttcgacgtggcgactccacctaacattccctttgctctcttactcccacctctcttctcttaggctcttaataccatcctctctctctctctctcctctctttcgtttgtttttcttttgttttgtttgttttcttatgtttcctttttctccttttttttctttctccttttctttcttttcctttctttcctctccttcctcttttttttctccttctttcttttc

SEQ ID NO: 65023 - DNA, 12376 bp, Oryza sativa
ggggggggggggtcaagtacgccggcgacgaggggcgaggggaacaatggtgggcgagatcgagtagtatcagaggccttcgcgccgcgtggtaccccaacgtcgacgccgcgaggttcgccggcatggacgcatggtgagtttcaacaactatactctttcagtctttatttctatattttcgggggccaacaattatacgcgtactgtattgcaactgcgactacaccattgttagtctagtaggtctagcatagaaaatgcaacgagtatactttgcattctctccacagtccacaactccagattattgagtccattatgatcagtggggcctaaccttccaggcttccacgagctgaagagtgaagacagctcaaagccagacttcaaagtgagcataattgggcaagccagagtgcccagttaatcatgctatcataaagatgtgccagtagtactatactaagtaatctgtacatctatggcttcttaagttttagggaagaaaaaggaaggcttcttaaactggatgggagcagaggatttaatagtgtacagcagaagcacaaggaccagagaatcgtggcaaatgcaatagcaattcatcatttccgaaaggattgctttcttcatcaaatctggctataaaaaaagaacaaaccgcacgtaccaaccatacaagctacaacctcatacagaacaggacaaactcatgcacattcctacctctgcacaaacaattctgaaaattgaagaaaaaaaaagaagagaataaataatagatcctccacatctccactcagactaactttaccttttctttttttcccctaagttgtgcatacatccgaagctggcaccaatgattcaacattgtgcagctttggaaggactaatgatttctacaactaccacatcataaagccggcaatgctggaccagaaacaaaaggaagaggctttgcttccgtgccaccggcaaaatgagcaaaacctcccatgaaatcagccattatctttcaaaggtaccatcaccaaccaagtacttcagatcattccgatcgactcaccaaagccgatccactaaatcaatagcaagctacggtaatctgcaaagcataattgattttggacgttattgatggtaaacagctatctgaaaacagttaaggaggatatggactgtttcagtaacacagaattcagtactgtccaaaagtataaatacgagtgctagcttttactgtagaaattattgtctgcatattggatgctcttgatgttaatctataccaaaattatgttattttctcctgaaaatatagttcacactagtacaatcaaagatgcttcctaatgtataccttctgaaaagtatcacccacccattgcagtgtagtaaagaaaaaaaaaagaaatttccaggagtaggaaattaccacatgttatatataagaggcatgtgctatgctgaatttgcagcaagggcatcaccagcatgcttaacatgaagttccacgctccggagttcgcgaagatgctgcaagatctcttgaagaaggtccatgcccctgtcacctttcttcagggacttgatgcagtgcctgaggaactccttgtctgcctctagtgcttgcagtctctcgtatacatgatcaacctcctctattattgccagcctctcctgttcttttacaagcacagaaaccggttttgtcgaattatcaacttgcacatccccaacccttgcagatggtgtctgatcactgctctcatctccagctgcatcgaatagaggaagaagactctttcccctgcaaatagaatttcgaccttcaaactttgccttgtcactggtgatatcaccatttcccggagaatggagaccgtcagccgacagttcatattcatctgaagatcggcccacagcagcactggtgtcgttgatgtcatcatcttccaatgtgaagagcctctcctccaatgtcttgagctcttccaagatagatagcctttccatctcaaagtacgtcaaggagtcatcaagagccaccagatgtttcttgttttcttgatctgtcctggggctaaaagcagcatgagacgggctctgaagattgctgccatccggggactcacctagttcgcagtattcatcggagtgcccgtcactgtcctcaccactggatgacacagaagtgccattaccattggggctatgcccgttagccttgaagcttgccattctcctcctctccttgtcctcgtagtgtagcaccttctgcctgcacatatccagctccctctccagttcctgcttctccctctccctcttggtgaccaactcgttcagcaactgcagcgcctcctggtcgtactccgactgctcctccatcatccgttggtattgcagagcctccatctgcattgctgccttctcttcctgcaacctgttgatcattgccatagtctggttggtcgcgatggcagcggcgctcctctcttcctcaagctcggagtacaatgcgctgagtgcctttcgctccgcttgcagcgccgatttcagctgatcaacggtggaaggctcggacaactccatctcgcttgccacactcccgtccaaagataaggatagtgaccgtttcctctcaagcaaaactttttgtctgagatttgtgtggcaacgctgtaggtcggtgtctcaggtgccttgtcgtcttcaacctcgttctgttcgtttggtggctggtctaatctctggctcgccgtcgcctcctcctcctgttcggtttcacttgcttctaatccaaacataagaagttaacattaagttcataatcattttgaaagcatcttgatgggggacaagttaattactagtcaaatgcacaatccgataattgtactaccttgcgcagttgggtctgtttcatggagactttccaatggcagtggctgctcatctgggtacgccaatggatcagttggctcctcaaactctgctgattcatgaaacggcacgacatggtcatcttgctcccgttcgcatatctcacttccgattgatacctcacagttagtgtccacctctgctgatctgttgtcatcttcaggaactgcttcagtgactgaaaggaaaacgatgagactggcataccagatgacaagactggacaattgattgtcatcttcagaaacttcttcaatgactgaaataaaaacgatgagagaggcataccaaatgacaaaattggacaatcgagagaagccaatgatgatcttaccttcgggcacaacaatttcttcttcttcagctgtctcaacttcttcttcttcaactgtttcttcttcagcagtggcatctccaatttgagcaacatcttcaataaccaattcatcatcgtgggggatgatattctcatgaggatcaggtgggcttgtgacaggctctgcacaaggaacgggcacaacaaagtcgtcctcaatcgcgacatccgccgttgcagccgaagaatccaacatcctcttctcctcaagaacaactccgatatcaagatctctcaactcgtgctcgccgtcgatatggtccatttctttctccttttcacagcacgcctgatgcaaacctgactcgtcggcgattgtcatctcatcgatggctgccaccgacagcaagcgctcgccgtcgagctcgatctcttctccgacagccatgacttccaaggactcgtcctggacagcggccatcttctcctcttgctcgtctttatcgtacacctcttcttgccgctcttcctcctgaaattctccatgctcttcttcgttttcctcgtcgtgctcctcttgagccaaaataacatatccttggtcttcttcttcgccgtgctcttcttgagccaatggaacatacccttggtttctgtcttcttcggttgtcttctcctccgattggccttgtcctttatccggcagctcgcgcgaggaggttttcacaacggcgtagcagcaagagcacaccgtggcgctctcctcccctgcatcttttatgctctcctccttggaagaagacaggcaggcctcgcacatgtcgccggcgtcggcgagccgaccgtggtgcaggcagtacccgagcccggagatctccgccgcgtgggcgccgcagaggacgctccgcagccaccgcgcgccatcctcctcctccgtcgccttctcgaagaggcggtcgacgcgggagcagaggaggcacggcggcctgagcccgaagtaggcggcgaaccgggcgatggcgtaggagaagagcccgttgatcagcagcagcgcgatgagcgtccactccaggacggcgtacgccagcgccgacgtgaccctccgcgtcctcctgtggaacagcgccgccgcgaacctgctcgccgccgccgccgccgccgccatcgcgccctccgatccttacaagttagtacagccacagcatgagaaaaaaaattccgatcttcgcctcggccttgacgactgcttggaatctagctgccgccacgccaagccgagcgagaccgaatgaattcttgcgggttgaaacttgcaaaggcagcagatggaatgatttgggaggggtggaggcttggctggatgagttgttttgaagcttctagctttcaccttttgagggagaaagttcgggccattggaccccatgagagagctagctcgctctcatttttctccatttttttttcgcgtttgaatggagggaagggacggatgacgagggttaggaattcgtcccgtttgatgcggccgccggccaatgggtacgtacgaaccttggagcctggtaaaatggaaatgctgcaccggccatgacgacgagtcgacgagacgggcatgaattggcaaattgcgtggtggtgagcacgacttgggcaaggatggccgtgcaaaatctggggtgattgtctccagtaaccattggattctctttttttatggcgattcagtgtccctgtcaacaggtagacacatcttttaatttgtcatcggttggaaaaaatggtacggaatgaaaggaagaactggccttaatcatacatctcggcaccagcaatagaatccgatgcatgcatgctcttaatcgtacatgtacactggcaggaacaccggtcttgtattgccatcgacgtggtttgtagtttgtttgccgtaggtatatataagagtatcggtttgtcgctggagattttcatgtttgttaataaaacgctgctgcagagggtttagtttatctcatgaacctacagcgctgccttactgggaaaaaaatgcattcgcagattcgttgcatctgttgttgtaatgatagtctaaatatctctcaaataatcatggaaggctggccccttcaagaaaccagctaggttccatgaatgccttcttcatgacaggcatagccgtgaacaccaggggatccgcagcctctgttagtttcaggctttcaatggccggctcgctcgtgctggactattcgtactgatcttggttagttgcatcgacgttaggctaagagcatgtacaatagcatgctataagcccgctacaaatatattttaagaagataaatagggagagagaagagcagcgggctacagatttgtagccagctgtagcacgaactctaaggcacactgtgtgtatgataagtgagaccagatattaatagtgtagtatgtaactattgtgtaaatgagctattaggttagttatagatgaattggagctagtagttggctatactattaaacttgctctaagggcatccacaatgtaaccataagagtgagccttaagactttttttcagccatatacattgtggacatggacataaggcattaaatgcttaaaaacagctctaagcttatagttgaacttaagagattaaaaaatgatatctaatggagcctatcagcatatgattgtgaattggtggtatatttcttctttgatgggacccagtgggatccagcttgtttctcatccaaggctataaccattgtagagatagatatagctaaagctatctgcacatgggcccacccctatcgctcattcagcaacccaacattgagcctgccctaagatcagccagcaggacatacgtacgtgcaccgatgcactggtgcgctcacgcactggaaaagcaggccgagtttattacgcagaaatcaccacgtttcgcagcaaactgtacacgagaggcttctttcgagtgtagcatggggagaaaagctaacgttcggaaggactcggctagcgcccacgataaagccagcccaggacacggcgggggacatggagatgttgcgcgaacagcagcgggaatgatacgccccgtggcattattggcggcgagttggccacgggagcgcgcccgcgcgggcgatggcgctgatgaggagcggagcggagttggtggggagttgattgcgcgccgcggcgcccccacccgccaccgacccgacccagctttcggccgccggccggccgtctggatagtgggctacctttgcctttgatccccaaagcgtcctcctttttttttcccctctcgcaacggccagcacgtctccttcgcagcggcacccatcgtttccctggtttttcttgcaagatttgacgaccgtccgtgtgttcgcgtacaatagttgtgttacttgtgtcaatgtgtgggcactgggcagattaatagtacatgccggttcagtgtttgcgttgcgtgaaaggtgcaaaattgatggattctccgaaagcggcagttaaagttgaaggtagagaagaccgtgatgctttgctcaggtaaaaactggaagctggggcttaaagaacgtagcccggaatgcttctagacacctaggaaaatacagcctgttcttctcctaatcagagcttcgggcacgaaccaactaacgttccgctggcaaagctcgagatagcaaccacagtttagtatttcttttagactcaattttagtattggaagaataacaaaataagcgacatatatgaaatggagcagtgctataggatatacgtgctaaaaaaatattacagaattcttacaaataaaaatcttttttgcatgtgtaccattttccttttgcatgtgatcctgatcctaacaatctgcttattgaccgagacataaaaaccaatctcaaagatccctaaaagacttattcatgatgtgagaaggttaaacaaaagataggagatttataattaacggtgcagaaatgaagagaacaaataaaaggtgcttttctgttaacaagaatattattttccctgtttctcccaacagttttgaagttgacaatttagagggtgttacaaactcctctcccaaaattcacatattccattgttaccccgactaaagccaagttcccgagtttacaccattgtttttgagatgataggtgccactccaaatctttacctacttataaaaaattcatagtgttctgctgttccacctaacatacatgtttatcttttattctctttaaaaaaatagatttctcccaatcacttatggcgcccccctccccctttccccttctccaccgatctctctctccctcccatttttttcctggcaccccctcccctcatgatctctgtttgttcctttttttcttggttttttcctccccgacctctcacctctctctccctcgtgtttttttctcttttcttttgttggtttttttcttctcaaggaaaccggccaactagaaaaaaataaaaccttttcttctcaaggaaacttgccaactagaaaaaaaatgaaaacacaatatcatcgatttggagtaaaatctgttggcccgagaccgagtgaaatcatgtgactgtttgcaccagcacgttatagctcgtgtgttttgcatgcccaggagacgtggctccctatgattcagtttgcatgacaagttgagttagcggtgatctcaggttatttgccattctctgtgttgtatggcaaactgtgataagattttatttgcatggtaattggaatcaccggtgccgattggaaatgtcacatgcaaatgcaaatgatactaacaagaagttatgctgctgacccattctaataggatatgtgtgcgttttgtttaaaaaatagcttatgttgaaggtgagaacaaaaatattttttaaaaaacaagttatctagcagttcttcgtgaagaatattttctatagaagagttcagatcatatgaaaataagaccttgatcatctgtatgtgtatgcaattttagttttttcccgttgcaacacacgggcttttttccagtagactgaaattgaagatgatagatggcattccaaatagaaattcgatttgttgcatttggcacagtcctagaataaaagtaccaataatcataaaagaaaaataaggtaagcaaagtcacagcttgtttcctagccacttgcacacatactatcgtataggaacaggttgagaaaagaaaaggttagctatcatggtcattcttaaaaggctgggcaaccaaatgaccacacgctcaaattttgaaacatatatacaatgaacttggctagactttgtgaggcttcagcaatagtaacctttcaaccataagatattatatgaggggtacacacactgttaagagcaggtacaattgcagactataagccagctataaacatatttcgagaagataaaacaggagagagagaagcaacgagctatagatttgtagccagctgcaatacaaactccaagatgcatgtgtgtatgacaggtgggaccatgtattatatgtttatatgtaactattatatgaatcggctattaaattgactatagatgatctaaagtcgtagttagctatactattaaacttgctctaagctacagtggtggagccccaggttgaaatgatttttttttgagaaacgtgcttgtgagccttgattttttaagcgtaagagcatcaccaacaacatcctaaaattttattcccaaacctttttattatgggaatcttacacagaatttaaggtgttaaaattttcctctctccaaaagattgggtaaattggtttcctaaaaacaaaaaaggtgggccacgataaaaatccccagtggaaaaatctgttttacgctccttcctcccgcgagatcgtgtaacgctccgcttttcgtgagtcgttaaaaactatttcggcaaaatcctaattgcgaaaattttcgttctttgtgtgtgagtctaagttgtgccaaggatctcaattcaaatcccgttgttccctcttatcgccatcaaaatcgtccacctcaagattccaattccgactcaagtctccgaaattcaatcacatcccttgaatccccgccaaatacctatccccatttccgaaaatatcaaatccccatctcgaatcatttccttgagtctcccttgattcatccctaaaccctcgagttcgaatatcaaatttgaattcgaatccaaaccctaaatctctccaattctctccaaatcagtcttctctgcaaaagtctattttacctccctctggctcggtgggccgactcttccccggcccatctcctctcagcccgcttctcctcctccccgtacgtgcgctgcatgcgccgagagagagaggcatcgcctctcttcttcctctctctttcctcgctctctctctgcttcctttctccctctcctcggcgccgatctcccgccgtcgccgttcgaaatccggccgcacccccgcgtcgcgtgcgctcgctcgcgaggtggccgaccggccggtcgctgccgctgtcagccctgccacgcctgcgccgcgcagccgcccggccccgctccatgccaaaccgaccgccgccgtcatcgtcaacgtcatccatggcccccgccactccacaccgcacccgtccaagagtgggagaagcagctgctctccctctcctcctcctcctcctcctcactctccctcctccttttctcgttttggcaagggaccaagcccctttcccccttctttttccttttgcccgacaccgccggcgtcatcacctgccgccgccttggctacacgcgtcgacgaccgccagctcgtcgcccttgcatcccttgactgccaatgtcggtttccctcctccaaaccgacctctccccctccgctataaaaacccgagcccccctcagtgcctcgaccacccactcgtttcctcccacagcgccattgccgccgaaccaccatccccgccgtgctgccgccgtcctcgcctccctccgccgtcgcgcgtgctggtgaagccggcgtgcgcacgaggagctgacgcggactccggtcgccctctctccctcggcccgagaccgaggtgatcccgcctgtgccgtcggacacccttcccggcgatctcctgacgcggtagcctccgttctccctcctcactcttccttcccccctagcttgcgcgattgctagcctagaccttcctaaacgcgcgtggacgctgccccgagccccgccgccgcccggcatggcctcgccgccaatgccgtccgctcccggaggccgccgctcgtcgccagctgtcctcggtgctcctccgtcccatccggcgccggaaacggattccttgaaccccggatatgctcccaccccttttaatcgaacccccgttgctccggtgaagtttcccccttttctcgccgccggcgtacgccgccgcgattcgtcatcgccggcctccctccggcgaatccgatccggtggctcacttcctctcgtccgtcccatcgttccggtgtactccctctctctcgaatcgtcgcgacgagctccggtgaactcggccgccgtccgccgtccatctcggccgccccttcttcctcctcccgccggcccgcgtggctgccacgtaggcgccacgtcggcgccacctcggctttgaccgagccgagccggtcagccgcctccttcctcccccctctcgcgcgcggtccacggtgcaccaaccggctgcgcgtgggcccgccgcatccctggtccatccggtgcacgcgcgtgaaccgcgctcacccgaaaccctagcgccgccctcatgcgccgctcccactgtgagccgcgccactgacaagcgggccccacccgggaccccgcaaggtggatacggtccacccggacccatccccctctctcctcccgcgcgccccgcccgcttgggccgcgccttgtccggccatgggccgcctcctcgcgcccgcgcccggcccattggctcggccgcgccgtgcttggccgtacccgagccgcccaaagaagtctaaatcccatccctccttccatttcttatccaaaggattaataaatcctttttcctttgtcccataaatcaattccttattcccaaaattccacaaatcatttcctttggtcccgcgcatcagtgactgtcaataatattcttgagaatattatttctataaattccataaatcatctctcctattctagaaactccaattaaaactttcaaaattcatatcactcaattcgcaactctgattgactccgttccacttccagtaattccgtaaaattgagatctatttaatggcactactaattagtctaaataggatctttcttttggtccttgtttaggttttcgattgttgcgtatagttgcggttatcggattttcgtcgatcgcgggttttctcgaagattcgtgaagcttcgtgaagaccttgagcaaggcaagtcaccctttgaccaattgcccctataattgaaaaatcattattattttgtttgcaacttgcattgttagaatcacacttaacttgcttggcctcggtttgcgtgccaaaccgacggacctacccagtagtcgcactaatttccgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcggaggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggacaaaccgggttcctggtaaggcaaggacgag

SEQ ID NO: 65024 - DNA, 547 bp, Oryza sativa
atcattctctgacatgttcctcgctttcgcaccaaatgaggaccggggattccaccaacaagaacaagcagcagcgacagcagcagcagctcgacgtcggcctgaatagctagaatcaatctcctccaggctccacctcgctgcaatggagagcataattaaagatccatatgggtcctagtagagagataattagtaaccaagattatgagtttaaatctccatagtaacgaattttagattagattggttgcggagctaagttcctaatttaaatgaccgcatatatccggttatatatagaggccggtaaaaaatacccttcttaaaaaaaaatagagagaaaactgaactttaaccccgttcctcgcgcgctcagcatcgcggcagcagctactccggatctggagtcgattttcaaggtccgtggccgggaggttggatggagtggtccggggcggcgcggcgagcgttcattgacgggcccgcaacctacgagtgacggtgtgactcggactctataatgagtaatgaattaggcccatat

SEQ ID NO: 65025 - DNA, 27315 bp, Oryza sativa
tcctgcagcccggacgtcgagatccccatcgggccaggggaggagccggcccggtcggcgctggtggcggaggaggacgacgaccagttctcggagcacgccttcgcgaaatgcctgggcggcctcgtcagcgtggtgatgcaggaggtgcagctggagctggcgttcccgacgggcgagatcacggcggtgtactcgtgcggccacgggcagcaggcggtggcccttgggggcggtggcggcggcgcggcggtgagtgtctccctgggcgagatgtacgcggaggaagagcgggagctgctggtggagctgcgcgcgccgctgagccagagccacccacactcgctgtccgtgcggtgcagctaccgtgagccggcgtcgcaggagacggtgcgcggcgcggagcagcagctggtggtgccggccctccacggcgggagctcgtcgcggcggctgcacgacctgttcgtggcgacacgggcggtggccgagtcgcggcggctggcggagctgaacgactacgcgacggccatccacctgctgtcgtcggcgcgggcggtggtggtgcagtcggcggagcaggggctggttggcagcctggacacggagctgagcgacatgcggtggcggcgcgggcagtcggcaggcaggcggcgtggcggcgagtcggaggagactccggtggggacgccgcgggcgcgggggggagagccgctgacgccgacgtcggcgtggcgcgcggcggagcagctggccaaggtggccatcatgcgcaagtccatgaaccgtgtcagcgatctccacggtttcgagaacgccagattctgattctcatcatctatcaatctcagctcagcttgtaatcaatgataattttcttttctttttcattttcattttcattttcttcttatgtgaaatgaatcaacaaacacaagatatgtctccacgacgaagaagaaagaagaaaggcagaattaagaagagggaggagtccctgccggagcgcggcggacgtaaattacatctactccctccattactgttttctttttctcttctctttttgtactcctattcaaaaatttgaactagtttagacagtctcatcctctctaactgtcactttgccactcattctcgcttctcgtctcccaagtatcaaatcgttcgttatctaacaacagtatcttttgcataccaactaataaattttaccaaaatatgtaaaaaaaagatcgtacatgcacttccaattacacttatgtgtaaaatattaatctaaaattcactatattttagtcgtaacaaaaaaaattaaaatccctaatagttttaagaatataaatctgttagaattttgactctttttctctatgtatagaatgaatttgaagataaaatattacacataaatgcgatactactaaaagtacttatatattttttttcttcaatttttgatgaagtttgtttgttggtgtgcatgtatgtacacatacatcggatacattcccatctaacaaacgaacttatctttcattatctatagaaaccaaaaatcaaatcttttattatctaaaacgcgaaaaccaaaccattcgttatctaaaaaccaaaaagaaaatatttctttctttatttccatttttcagttactacgtactccctccgaccgaaagttttttttacattaatatggacactaaatccaaaaagttctttaaacatatattcgcgtaaaaaagtagatttattttagtgcagatgggggtagtatttagagtttggaatggattaagatgatgcaaattgcaagatgatggcatgcatgtgaggtggttaaggttttaaatcaatcacagacaagagggacagctccttcactgcttggtgctcatcattcagtccatgatcctccgctgctgttgtgttgtaggctagtgagtgccttggtttgatggaatctttgtgcatgacatggccatgggattgggagggagaaaccaaaccagttaatctgatcctgactgacctgacctgaccatactacctgagatgaagagtgggtgattaaaacgacattggagattatgatgattcatgcatcttcttcttcttccttttcatagccaagctgattgatgcaatgttcttcttgataagggcggttttggtgtggactggactagtgctagagcttacattggagggagagaatatgggagcagtagactgattgcttccatgtccattccttcaccacaaacaaacaagcaaattaacaaacagtgtgctcatgctcatgctcatcattcttcacctcttgtttgtgttctctgtgcttagcatagcagattagcagtccagccagcagtagtgtcgatttgggcgcaacacaacaacaattccgacgctttgtttggccgcttgcgcttgcctccatcgcactctctgcaatatcaggcatgatgagctagccgctgattgctgtagaatgtgcccacatctgcagcactgttgcagggatggacggctcagctggtacgttgtctacagtgtataccgtatcctctccactgtctctgcatacacacaacgatactgctctactgtgtactactagtaactgctatctctctctttcgtctttcagcaactgtctgtattcttcttcattcatcaaaggagctgaacgtggcatatactcgtatgatatatagtacatacgtgagatcagatcttatgggaccgttttcaaaaaaaaaaaaaatcttatggggccaatgcaagcaacatgcttgctctctagctagagttcccttctctctttttttatgccttctcctcctgtttgcctgattattctgtgtgtgtgtgtgagtgtgttcgttcggcccactcaatcacttgcttacacatgatgcaatcatttagtattcatttccactagggtttatcaataaaatactaccaaaattaagctagcatttcttgcctccttcactgtttctgaaaccttctaggcttcactgttactgtcagataatagtagtatcattgatcaaacttataagtgtgtataaataaaattattgtgtataaatgtaaaagtctgcctttttctctcttgggtgcagtacataaaacatgcatgctgatatgcaatttacaagaaggtttctgtttatgttttcttgagcctcccctagctagctacttgtacaaaaggttgtaagctggtatgtcacggattccattgacgtcctccagagatagctctctctccagctgctgctttgttgcttccagcacgtcctggaatttgccattttgattaatttgatcatcagttaactaattagattttcactactccaaatccaaatctacggttagttactccctccgtttcgaaatattcgacaccgttgactttttagcacatgtttgaccgtttgtcttattgaaaaacttttgtgagatatgtaaaattatatgtctatataaaaatatatttaacaatgaatcaaatgataggaaaagaattaataattacttaaattttttgaataagacgaacggtcaaacatgtaataaaaagttaacggcgtcaaacattttgaaactgagggagtactttctaggatgaagaaaagaaggaaacgtactttgaactgcatgtaggatgctcgcattgccagccactgggcatccatcatctcgaaagctatacagtacaggacgtcaaatgcctcttcgtgttctaccattaccatgcagtgaattagtagtatttcattgtaaattatacttcagaaaggcactgcccatgcatgcatgattcatgggagaagatgacaagatactaataataagcgatcatttgctcacctgacagcactttgataaagttaatccctggcaaagacttgggccgttctgagcagagcagcaaccaaattaattagctactaaaatcaatgaagaagtaaaagggcaaacagaaaacaaaacaaaacaaaaataaagggcacatcaatcatacctcgtggcattatatacactacatgccatctgaagaaagaaaagaaaacagttgaactagctactagtcctagcaagcaattatagaagcagcccggccagcagcgacaattcagtaactgcatctctaaccagttgcactcaaggagcacatgagcaataagagcctttcttgtgtcaaagcatatataataatttttcttcctgataattgttagtagttcgttcttggagttggctcaatgattaattctggctagatgattgtgtgtacaatatttatacaggtaatgataaatcaaatagcaggggcagagagggaacacacaatgagacgtactgttgggcatctgaatcagttagcagttagccatatatatatatactatcttcttttcgaataaatttttgcataacgtttgaccattcatcttattcaaaatttagtataaatgtataaaactatatgttaagattatattttatttaatgataaaacaagctagtcacaacaaaacaaatgatattataaattttaaataagacgaatgataaaattttatataaaaagttaacggtctcatcttttttttaaaaaggggtatatagtactactcattatgcaccatctgtctgtctatatgcatatgatatggtcattatcaaaccaaaccgcaagattcctctaattgtgcagactgcatgcacaagagaataaataaacacagaagatgccttgttgatgccagtacgtaccggaccattctaatatgtgcttaattagtactactacgtagttagttgtttgacttgtacggctgggcacatgcagtgtagatgtactcttctgaccaataccgatgcagtgcaatgtacatagtcaatgatgcacaggccatgctgatcagctgagtagtgattcttacgacagattattaatttagttatcaatcagttgcacatctacagatgccatgcacatgctggccccttcttaattaattgatctcttctgatttcatgttttgtttttgtcatgctttcttttgtgtgcaaacgtaaatgcaaacacaaacacaaattatgcatgtatatatatgctgcttcaattcgatcttgtgcatgatgtttttttttggtcatagatatagatacaaatgtatatacctacctgcgttgagctccagcagctggatcaacatgtatgagacgttaacaccagcaactgcaaaggggtactcccatgtggctctcatcccttgtttcttcagaagcagcctctggtaagaagcctatcatgcatgagtgcagtaatgtctgtcaggctcagctaaattgttgttactgacagacattgaaacagcatcaacataccgtaccggatatgttgttgcaaagaagagaagattctcaagtcccacaaatccacagcccctgaagatcaagagtaccggatatgttaattacgttgtttatttctagacaaaccaattagctacagtcaccagttagtataatgtagagttagagattaaaaaatatttatgtacctgaaatcagtcgatgggtttgggccctgccatcccatgtccttccactgctctgaaattaagcttgacagctctgcatccggaaatgaagcactccacagagccctgagagcttcctacaacaaattactatctacattactggtacatttctatttaaccttgctgatatttatatatatttgctggaatttcccacctgatgatctctccgagtttgatcataaggtatatttagtctttccttcagcttttgcaaacgttgctcctgatgagtgatgagtggcattgaacaaggttaattaattagttcagacttgagatgtgagaaatgctatgtcttgatgaatgctgttataaaagaagagaccatccaaatccagtctcgcttgcaaagttggctgggcagagttatcactatttactgcatttgatggtttagttgaatactactaagaacgagccatcagaaatgcaatgtgactatttccattatcgaaaaaagaaagataacgtggcttggtgtatgctaatcctaatacaacttcacctgaacagggctcagctcaaaggtcttctcagcattgatttggcgccttctacctgagctggtgaaaaggcccccaaaccatatcctattcccaaccatagcatcaactgcaatcaggatatttgcaaaacaagagtcaagcatagagcatgtctttgaacaatatgaaattatatatgtccagacgatgacatgaaaattatcctacatataatttgagaaatcattcccaaagctagaagaaagttttgtgcaaaacaagcagagcattaagggatatacgaaaatttgtttttttagtagagtaatattgaagtagtgtaaaattctgataacctcagtggtatgcgctttcgataatgaattactgtgtttcgtaaacatgttagaatataaatttatataaaattatgagctttgaatttgaaattcaaagccatgcatgtgtttcagcacaaaaaaaaggctaggcaactgtttgtggtaatattgaatttttgtctagttttatgtgataatgttgacgccaaaacaagataatggcaaagaaaagatggaatgatgatagttgaattggatgaacgcatacaaatatacctgtaggggttggagctgaaagggatgaatgcccatcaaagaagacgaatcaaaagccgtctagcacggcaaaataagcatacatacatgcatgcctgttgttatttcgtcttgttttgacatgcatacacgtaagtaggctaactgcagcaagcaaatcaatcaataggcttatgtatgtaatatttgaatttgattgatgttcttagctagctgcaacaattaagatacatacatacatacaagagaggagatggagatggaggggggagagagagagggaccggaggagaaggaagagaggaagatagagaggatggagaattggaaacggtttccaatccaacagcctcagcctcttcaattcttcccttcttcctgcccctccccttgcctgcctgcctgcctgcttgcctctacaacaccaataacgctgtgtttcttcacaaaaacgacagctgtgtgcatgcacgctccatatatttcctctctccgatcatccctccccaccattcgtacgttttattcattcattcttcccagaccagagcggggcaattgcaaattaaggacctatctatgtatatgggtgggactcacattgggccggccttgtagcaatcattcatgcaggcccaaatcaacaaggaaaaagtacaccgaaggtccctcaacttgtcatcgagttacaaaatcgtcccccaaccgcaaaaccaaataccgaacgtctctcaactaatcataaccgggcacaatagatccttcggtggttttgacccctattttatcctacgtgacggcggagttagcgtgggacccgcatgggccccacatgtcaggctgagtcatctcttcctctcttctcttcctcggtttcttctctctctctctctgcatgtaggcggtaggccggtcggcggggcgaggcaggagaggaggagggcggcgcggcagccgcgaggtagagaagcgaggcggcggcgaagaagacgtgtaagccgcggcgacggtggtggcagagcaggacgcgatagcaacactcgacctggttttgctctcgggcctcgcgaaggcgaagaagcctcctcgaccttgacgctcgtcgttgtcacgcccagaaatttaacccaaatttccagactattttgtgtattaaatccctgtccaggaccagccagggtacacacaaaacgacaagtaatatacagttccaaacgtaaataaagcgtaacatacttacagaagaggcacttagtcctcacaaagaaagagaacgacagcagcggaaaaaggccatcctagcagtgctttagcttcactccacaggcaaaactcaactggggtctaagccttggtcttctaacttcgtcttcagctcagaagcactacacttctgaaaagagggaataatagcaaggctgagtataaccaccgtactcagcaagccacaccaatgatgcaaacgtgcaaggggaatacaaggacggcttgtggctatttgcataaaggcggttgtaaaacattttattgagcaaaaaagtaaaaatgctgagtaattaaagtaacattaaatctccactgatcaacgctacaccatgttgaacaggcccaaccaacccacctgaactacagtgcattgagtcgatttattaaggtgggactgatcacggtgaatctggtcgaccgcccataaccgcgggcacggctattcgaatagttttactctgatcagaggtgtacaactgtaaccacaagacaaagccccacaacacgtttccatgcgccgacatgccaccacgacataccggaaagaggccgtgacatgacccttcgcataaccccctctagccaagcacaccacacctcaggtttcacccccgtccccagcgggcaacgggcagtcccctctcatgcctaggtgaatccggaagcgacagaggccgtcgcagggcccgccctgctccatcacgcccacccttgcttgggagcgtcggctagagaaaagctacactacaaacccagccgttgcccacgctggcttgtgataagtacaaggaattcttccagggtttcccgcgaaccggtccttaattgtcatgggtgcgactagcaaaaccatgcacccacagctcaccattcagtcgcattttagttggataattacgaccatgaagcatggcaagatgtctcgagcacgcagcttgtcatgtcactaagaggtctaatactgcaattatcccatcaactgagctagtggtaattaagcatggctaagcatatagttctagctaggtcacataagtaacatgagctagtcgatttattacccaaggttgacaaaggacagatatcaagtaaacatggcacaagcgagcagctaggtaaacccgattcccatgtaattggcaaaacatgcatatttatttgcaaacagtaaaacatttgtaaagtaggctcaacatgctcaaggggaatgtgtgacttgccttgcttcttcactttgatcttctgaactcttttcttcgcgacagcggacttccgaaacgacggattctacacgctggcacacaaaacgaggaaaaactctaataaacaccaagcaaacagtacataaaaagtaaacaaacatgtagatcttaattttagatgaattttgcaagttgaacggcccaatttggagttcaaatgaattagttatgaattttagaaagttttgagccattaaatgaacttctataattattaatgatttattacgcaattgataattactttccaaaggaaaaggcacagccgctgacgtcatcaagtgaggccggcgccgacaggcgggccccacacgtcagcgagacaaggaggtcggtccaccgtggaccgggaccacaagggcggtccaccgccggtccacacggaccgacggcccagatcagcccgagctgatcgggcggccacgggatggcgcggctgggcacgggcacggctcaggccggcccggccgagcgacggcgcgcggcggcgcggtcaccggcggcgacaatcggcgatggcgcacgcgggcgatggcagcacatgcaaagagagcggaggcgcggcgcgacgcggcaggggagcggcggcgcacgcgggcggcggcggcgcgcacggccggcgaagaggagggggaggaatgagggcttctcacccgggtggcggccggagcggaggaaggcgacgacgacagcgatggtccggcgacgttccgcgagcgggaaacggcggccgatggtcggagggaccgagggaaggaaatggagaggttaatagagggtaggaagttgcggtgcgcgggaaacgccggacaaaatgacgacggagctcaccgggaggcacgggaagatgagtccggcgacgactggcgaacacggagggattgccgagccacggacgacggctgcggtaccggggagggcgacggcacagcacggggcggactgaagaggcggcgcggcgcgtccggaggcggaaatggcgacggtagctctggttggtagtggggagggcggctcggtggtggattggaggaacgaggaggtggccggtgctcggcttggagaggtgaagccgacagtggcggtggcgcggcttggcggtggctagcgtggcgaggagcggcggccggagttcggcggcaagcggcggagagaggttacacggtgggcaggtggttccgatggcggttgaaggaaaccgggtggaggccggcgtgcgacgcgggacggcgaagctgatggcacacgcggtgaggcgcggcgacggcggtagcagcggcggcgcgcggctggagatcgccggcgggagagggcgcggggagctcgggaatttggggaaaatgggagagggggccccggggatgctttttataggtcccggaggtggagatcgtggtcgtggcgggcggcaacggccggcggagggagctcgtgcgacgtgggcgagtggggcttgaacggcgccgatttttgggggaaaatgggggagaaagtggaggaaggggaggacgtggggtggaccacgtccacacgcgcatgggagcgtggaggcgcgcggaggaggcggcgtcgtggggtggtttcggcggccatggaggccggccgaaggttggggacggtcctgacatgtggggcctcgggtcccacatgtcggccggagagagagagggagccgagggagggtgttatgtggacttaaggagaggagagccgggctgggccggaggggaaagaaggagggagggggattgggccgagggcggcccaaaaggaaggagagggaattttatttgttttcctttttatttaattggttagatgaactttgtgacattaaaattatttattgagctccgaaaatttacgggaaatttcagagagtactttagggcacagagaatattgcaaaatatttccagccaatgatttttaagggaaaattgtaattctcctataatttcacttgattggattgatttaacttttatttaatttttagaaaatgcattattaattgatttttaatcccaaacgaaaatcggggcgttacagtcgtgaagacgacgtgcttcaggtgcgccctgttgttggatgcgtccaccggagtgatgatcgtcgtctcgatcgtgccaccgccacgtcacacgcaggagctcgccgcacggtgtgactgcgaggtactgtgtgggtttgggatcagaggagtgactgcaaggaccaaggctcagaccccagttgagttttgcttgtggagtggagctgaagtcccgctaggtatcgccttttcgctgctgtcgttctctttcggtgtgaggactaagtgcctcttctgaagtattttacgctttatttatgtttggaactgtatattacttgtcgttttgtgtaccctgactggtcttggacagggatctaatacacaaaatagtctagaaatttgaggctaaatttctgggcgtgacatcgacccacctcactgccgcgacatcaacgaccaaagtgcgggttcggctgtgggggcagcgacgagggtcaggagtggctatttgggggcgagaggtggcggggttcgggggtggcagtggtggcagttgggggcgaccgcggtggctgcgagtgccggtgcagcgcaggtggtggtggagtcgggggtggcagttgggggcagccacggtggctacgagcgccggtgcagcacaggtggtggtggggagcagcggcgcagctgccgagacaggtgcggtggaggaatgaggagaggcggcacgacagccggcagagcggtggtgggcagcaccagcatcgccgcttcaccccttctcctcttgccttcgtcatctatctcgccaattctagtctcctctctcgcatgtgcgattcaacatgttgacccaggggtagaaacgtccgagaaaaagtgtaattaaggaaaagttatttctagatgcaagaaaccaagaaaatagcattccaacgaacacccacggcttgggagcggtattcatgcgaagcccattttagtgaaggtattctaacgaaactacttttttgcgatggtagatatgcaattttctcagagagaaaattgattttatttggagctagtgctttgtgttggttaacctggcgttgccataatgatgtagtttttaacctaaaaaaatacccaacatcatacagattatcttcatgtgttccaactagctccattcttagtgtatgatgttttcacaggaacaacaggatactatacgcaacggagctacacgcttggaattggtagccaagaaatttttattccagtttggatatcgtagacataattttttttatagaatctatgtgattttgaaaatattattttagtagatcatcttattggtagaagtttggtgtttgtcccatcacgtctttttttaatttcttttatgtttacttatgagactttttggttatgtgcccatggacaaaggtcggagatgtaatccatttctattatctaataaaattaaaaaagtggttgtccaaggtttacaataaatccactctaacaaaattaaattgaaggtttaaagaatttttaatgcaattattttcttttaaaaaataatagtgcgtatcacaacaaaaggaaaaccaactattatcattggaacaaattaatttaggtttatgtcatgcccacgccatcgtgacactttactgcatgcttcatcttattcggaaaaaaagctgcatgcttgcaaacatgcatcgatctccaccaaacaccggaaaggatagtcgatcccgaccttgatatatgcaaagctgatggggaacgtacgaaagagctatagtacctagctatcttcttgcttgaaatgtcgcatcatgatgcagcagcactttggtgcaccaactcccctccttcagattcacacgcgcgtacgctagctagctcttattggaggagtttcaaatttgttggaataaatgagctggccacaatttactctcaattaatttcataggtccacaattaatactatagagattaatatcaccataaaaatttaagtggagatatatcaacttaaatagagagctatattagagagtccctgttaaccgattaaggtggtgatgggacagccacacatgcgcattgttgggccaggccagatgggccgttactacgtgaacattgatgcttattttataaaaagcatgctcatgttgctcatgtttagcatcatcactagatcaattctcattgcaaatgtcatgtttattatattctggattaaaatataccgaattatgatcatattttttttaaaaattacattaattatttcttatagagattgtttagaggaacttccatatggaatttcccagtggcatgcatggctaatatatagtgtgtatgatccaacatactactatatatagctgtaagtgacgcaataatctgatgaaatattgtaatgtattaatgatatgcatgattagtgcaaaatttgaaattgagtgatcttttgtcactaaaattagatgcacatgcaatctactccctccgttttacaatgtaagactttctagcattgctcatattcatatagatgtttgtgtacaatgctagaaagttttacattatgaaacggaggaaatataatttaacaaatgtttttccactgcatgtattatgttcacaaattagagccgtggcatatatatagttcacggtgcatgaggattacaacgtgtcacatacggctatatatacgtaataaatcaaggtagtaaggccttgtttacttcctaaaaacttttcctaaaaacattatatcgaatctttggacatatatatggagcattaaatataaataaaaagaaaaaactaattgcaaactagcatgtaaatcgcgagacgagtgttttgagtctaattagtccatgattggctaaaagtgctacagtaacccgcatgtgctaatgatggcttaattaggctcggaagattcatctcgcggtttccaggcgagttatgaaattattttttttattcgtctctgaaaaccccttccaacatttaatcaaatgctcgatgtaacatttaaaaattttcatttcaccaactaaacaagcactaacttgttaagttttcttcccaaaaagtttcttattcgcttgcatgtactcgcttggttctaaccctagaaggctggaatttgttggtgttgccttggctcgcgcaccaaacgtcgtacgtggtgtcacccacgcgtcatttttccgtgcccgcgcgcacacggaaatatcaatattttatatatatatatatatatagggggtcatcagttgaataaaaatggtgcaccatttttaagtgtatcggagttggtcaacacaaacgtagacgtagatgagcacagcaaaaatgttgaccactagtatgggtgggcgtggttagagtgaaataattttgatttgaagttgatttaatgtgaccagcagtaccaaatctcttacactataggacaaatttagaagggattaagggtctgtttggattccaccttaaaattttacatcctatcacatcgaacgtttgaacacctgcattaattattaaatataggctaaaaaataactaattgcacagattacgaccactttgcgagaagaatcttttaagccttgctccatggtttgacaatgtggtgctacagtaaatgtgctaatgacggattaattagacttaataaattcatctcacggtttactgacagatactgtaattaggttttttattagtgcctgaacaccccctacgacactctatataatacttgatgtgacacgtcaaaactttacaccctgaatctaacaccccctgaaaataagagatatatatgatgggatttgatctcgctgatctagaaggagctactactaccatcagatatattctcttccgcatggaaaaagtgctaatacatggaaacacctggcaaaatatcaagtaaagtaactgattttgtaagcaagctatcacatggaaagaaaatcagtagcataacttacgttcaatttcttgggtattaaatggaaaccaatctacacgaatatcttaacgagtttgacccgtaattttcaccaaatacccatttgagtgcagcacgaatcctaaagccagtgaacggtggatagtattggagcccggacaccatagagcatcaaatatatatatatatatatatgtgtgtgcgcgcgcgcgcgcgctaccagccgcagcagatgcactgatcaagcattaattctagcgagtcatccacgcaatcacagtgtatgtatacataaattttgataatttgattctttgcaaaaactaatttcacaaatgaatcgtggttaaaacttattttaaaaatgactcttttgttcagcgccgaacttagacacttcagcgttaaatagcacggcgctaaatgcacgttggcacgccgactcaacctcccatccgtggtggcacgacattcagtgccagttgacgtggcgctgaggtgtcatagttcagcgccatacgatttgtcgctgaaagaaagggttatttctgaaataagttttggccgcggtttatttgtaaaattagtttttgcaaagtgtcaaattgttaaagtttgtatgcacagatcaatgtgatatcattaggattgccttttcgatgtcgcaaaaaattcaaaattaatttaaatatgattaaattctatgtgttggaaatactaatatttatattattgtgatattaaactagacataaaatatggattataaaatgcaatagaggagaaaaagaaataggggctaagaaataaaggttgttgcttgagttagaacctttctagagtcccgaggaaataggggtagcccccatttaacctttagggattcttaggccctgtttgaatcttcaataaaagttggataaacttttggataaaagtgacacgcttttcaaactgctaaacggagcgtttcgtacgaaaactttccatatgaaagttgttctaaattttttaaaaatctatttttcaagtttgtaataatttcaactcaattaatcacacgttattaccacctcgttttgcgtaaaacacttaatctttatcttcaggagattcaaacaccacctaaaataggagatattgctgaagatgcttagtgaatctaaaataggagctattgctggagatgctcttactctttacttcttgagttaaaagaaatgtgttcatatcaatcaacttccaatttagtatcatctcaaaatagctacctagttgatttcttttaaaaaatacaccatctagcagtttaagaaatgtgcacgtgaaaaatgagggacatttctcccctttgccttgtctcaaacgtccacagccttatgttgtttatattttatacggaacacatatgctatattttgggacgaactacggctacctttcttttagtttcatattttcatatgggattcatctactatatgctacctccgtcttaaaatataaaatattttagagttgaatacggaaattaaaaagtaggtagaattaaatggaaaaagattgtgattagttgtgaaggaaaattagtactatgtgacaaatttgaaaggtgaaaggttgtgattggttgcgcaatgaatgtacgtagagaagttgttatagaatttagtaaaaaaaactgttattgttcttgaacgctaatatcaatattctaatttaatgctcaccctcacagtgaagatgatattgtatgaagggaactatacgtaaagaatgatgtttaatttaaaggaagcaaatagtttagatttataaatgtaaacttttaaaaagtataaaagtatacatatgtagatagatggcaattgaaaagtgacctcactataacatggtgcttcaccaactactccccatgtgtactgtctactctctcgtccaattcccgatgatatgtactagctctcagctcccggccactttcatttttttattacaaatagtatgtaccttttttgcggggacatatataattgtacttgtatagatcgatatcatttcacacaccggctaatgaatgcgaacctaacacataccaggagacggccagactagctagcaagcaagtcattaactaaattcttattgaaaaggtaaattcttatagaaaaacacttgcaaaagcctcatatatattggtgcgccaaaaaccattacacccttggtgcttacccctaaaccctaaacgtatcctctcttttgttatcatcacactggtggagaaatctttttactcctgatttataaccccctgtagtcctggttttccaactgggactacaaattcagggcagcggcagtcccggttagtttacttttttttctttcattgtttttattgctacttactacttaatccctaactgattttctcccgaatcgagtggggtgtatatccccgaatcaaaccccaaatcaaagtaatatcccaaataccataaatcaaatacatcacagattatacatctcagatccatacaataaatcacagattctaaaaaaaaagaaattatagatctcaatccatacaatgaatcacaaattcttcaacaaaaaagcacctgccgctgccatcccctccacgccgaccgccgccgcactcccatccgcctgccgctgccatcccctccacgccgaccgccgccgcgtggccctccgcaccaccgcactagccgtcgccgcggcggccgccgccgcgcggccctccgcgccgccgccagccgggctgccctcctcctgcgctcgctcagccgcgaactgtgaaggaaggaaagagataaggctgtaaactgtgaaggaaggaaagagataagttagagaggaaaattaagagagaggagtttgtgtggacgggagaagaggataagtactagggattatatagtgcgttttgatctttagtcccggttagtaacaccaaatgggattaaagtcctaactttagtcccggttaagccccggttggtattactaaacgggactaaagatcaccgggatctttagtcctggttgataaccgggactaacgatccgaactttagttccggttggagttaccaacagggactaaagattccggagggccttgacagcccctaacagcatgtgaactagtcccaggactaaagatcatatagtcccgttctgtttataaaccgggactaaaaatcatctttaatcttgatttttattacaatcaggactattgtgattttttaccgatcggacaaagatggtttctacagtagtgtccgccgatcaaagtatatatatgtaaaactctgtgatttccttccaacgaagaaaaaaaggaaaatcatttttataataaaatttctcccattagagatgaacggctacgtgtcattgcagtagagatgacaaggaaaatggtttgaaacctactccctccgttaaaaaaataccaacgagatgtgatccaatataggcagccctttatccaaattcatagtacgaggagaagattgtccttttcttttgagacgaagggagtagctaattcctgttcattattaattatatgttggaacgggaagatataatatgtaggtgcaatatattacttctggagattattaaattaggtgcaaatatgaggtccaaacgttcaacacggggtccatgtttgtttaatggaattaagtatagatgcaagtacaaccggtgaactggacacaaacttaaggctgcattcgggaggtgagttcccaaaacggagcgatccatgattaattaaatatttactattttttaaaaatagattaacatgatttttaaagcaactttcatataattttttttaaaaaagtaccgtttagcagattgaaaagcgtgtgcatggaacacgagaaagaagagttaggggaaagaaagttgggctgtatttagttcatgtgccaaattttttaaagtatacggacacacatttgaagtattaaacgtagattaataacaaaacaaattatagattccgcctgtaaactgcgagatgaatttattaagcctaattaatccgtcattagtaaatgtttactgtagcatcacattgtcaaatcatggcgtaattaggctcaaaagattcatctcgcgatttacatacaaactgtgcaattggtttttttcgttcatatttaatgctctatatgtgtccaaatatctgatgtgacggaaaaattgaatgtttgaagaaaaaattttgaaactaaacacggccttgatcaatagttttcgctcaatggtttgactggggcaggctatacattttccttcttctagaccgtccgtaaaagtggatgtgcgtgaaaatggtattttactattttttttattgtagaatttagaatctactgcgtaagatctcaatttgataattaaactatacagatagcaggcttaccagtaaaaatatcacacatagatagatatgactattttcataagcggtgctttttaagtgcatgaattgtgtaaatagtgagccctacgcacgaccgacgatgctcgaccaccgcccgaagcaaagtcaaagatatatcctctttgcatcctcttcatctccttccttcggagctctcccctctcagagtcctcgcaacaccgctgcctcctatttcccctctcaatcgcagcctccatgaaaccaagagtgtcgctgcctccatcacaatcgtacatcctatctgcgccaccctctccctcaccagtcagagctaggatgcaccaatgataggtggagtgactagcgtgacccaagatccggtgcgaggaggctgtcggcaaccacgcgagagtggtagagagggccgccgcacacctctcctcctcgagatgcgccacatatggatggcgaccagctggggagtagtgaggaggccggatcgggacagcggggtgacaacaatgactacaacgacggtggcttcactgatgaatttttgtgaatctgagttttgtggaaattattttgctggggagctagggtttgtggagaacttttttttgcaaaaatattttccaatctggtgcctttcgattttcacaggaggtctactaattgaaccgtgtatgataatcgattttcacatatataattgtgtggggctacctatgaaagtcccaaattttacagaaatttggttacagacagatgctccacctagtaatttgggccgtctgaaaaaacattcttggtaatatagtgattaattcattccaaaagacagtagcgacatctatttaaatatggagggaataattattatacttaaataaaaatagaagttgtataggtgtactattatctacgaaagctttcgctataacaaatttgaatgtgtcattttcatatgcccaaaatttaaataattattttcttaaaatataagtatttttagcttgaatgtacttgtccatatttcgaaattagaagttgttgtatattataatggtcaaaatgaattaagttaactgcacgaattctaaggtaaaacttatttgtaactagagagagcaggtaaatatgcttaaaaaatttacgtgaagataaaacacgatccatgcctcttcattagctaattcccctgtttcaaaatatagcaataatcttagaatcggacgagacattatgagtacggagatccaatggtaggttatcatcctgggacggagggaacggagggagtatatatatatgtctataatagtgcgtgcggtgaaacagatcagtaaggtaggatggcatcgttgatggaagtgcaggtgccgctgttgggaatgggcactacgatgggcgccctggctctggctctcgtcgtcgttgtggttgtgcacgttgccgtgaacgcctttgggcggcggcggcttcccccgagtccggcgagcctaccggtgatcgggcaccttcacctgctccggccgccggtgcaccgcaccttccacgagctggcggcgaggctgggccccctgatgcacgtccggctggggtcgacgcactgcgttgtggcgagctcggcggaggtggcggcggagctgatccgcagccacgaggcgaagatatcggagcggccgctgacggcggtggcccggcagttcgcgtacgagtcggcggggttcgcgttcgcgccctacagcccgcactggcgcttcatgaagcggctgtgcatgtcggagctgctgggcccgcgcacggtggagcagctgcgccccgtgcgccgagccgggctggtgtcgctgctgcgccacgtgttgtcgcagccggaggcggaggcggtggacctgacccgcgagctcatccgcatgtccaacacctccatcatccgcatggccgccagcacggtccccagcagcgtgacggaggaggcgcaggagctggtgaaggtggtggcggagctggtgggcgccttcaacgccgacgactacatcgccctgtgccgtggctgggacctgcagggcctcgggcgccgtgcggccgacgtgcacaagaggttcgacgcgctgctggaggagatgatcaggcacaaggaggaggctaggatgcggaagaagacagacacagacgtcggcagcaaggacctgcttgacatcctgctggacaaggcggaggacggcgcggcggaggtgaagctcaccagagacaacatcaaggccttcatcatcgtaagccagcacgcacttttttctttctttctttcttaattagctagtggagtggagtactaagatgatgcatggatatgatgcactcgatcgatcaggacgttgttactgccgggtccgacacttcggccgccatggtggagtggatggtggcggagctgatgaaccacccggaggccctgcgcaaggtgcgggaggagatcgaggcggtggtggggcgggacaggatcgccggcgagggggacctgccgagactgccgtatctgcaggcggcgtacaaggagacgctgcggttgaggccggcggcgccgatcgcgcacaggcagtcgacggaggagatccagatccgagggttcagggtgccggcgcagacggcggtgttcatcaacgtgtgggccatcgggcgagacccggcgtactgggaggagccgctggagttcaggccggagcggttcctcgccggcggcggcggcgagggcgtggagccgcgcgggcagcacttccagttcatgccgttcgggagcggccggcgcgggtgccccgggatggggcttgcgctgcagtcggtgccggcggtggtggcggcgctgctgcagtgcttcgattggcagtgcatggacaataagttgatagacatggaggaggcagacggcctggtttgcgctcggaagcatcgcctcctcctccacgcccacccgcgcctccaccctttcccgccgctcctctagctacccctacctacctaccactcctactcctttcctgtccctgtaacgcaccgtaatacaaccattataaattaattaccactttactatattgtaataattaatgtgtatgtattccctacctagacctattgcatgtctctcaaatcaaatattccaagcaagcttgattgtgatacagatgggacagatttcagagctactagcaaattagtatattgttgacagtcgtcacagcacgggcagattatattagtcaacgaaccacaggatacgctaccttccacagtactcctaattaaatgtaccacctatttagacatttggctcctaaattttgacaaattggctccgcatctccacaattttattggctgctaaggctgcgtacgttcaaggaacgttcatgtctagcacggtaaactgagcgacttattagcttgaaaattttaaaatagatgaatatgattttgtaaaacaacattcctataaaacattttacaaaacacaccatttagcaatccggaaaatatgtacatgaaaaataagaaaataaaggttgggaaaagaagagccaaacacaatcttagagtggatggttcgttttaacaacagagggagagattcaatgtgcacactttctatcttttttttatcttttttttagtgtgcacgttttttgaactgctttttttttaaaaaaatatttataagaaagttgcttcaaagattcatatcgattcatacttaattagtcatgcgctaatggcttacctttatatatcttgtccttctcttttacccccatctcaagtaatacaaccatacaaccttaggatgcattttgaccataccgacaaagttcctaggttgattgggtcgatgaacatgatacactatttatgtgaggtttctacaagacgaaaatgaaaatatctgataatcctggtttgagaaacgctaccatcaattctgtttttagtgactatattaacaaattgcctcaatgcatgggaaacaattctaaactctcgagggaacatttctcgttgtttgcatgtcactagcttaaatggttatgattttttttaaaaaaagtttcaacaagatagattaatatgtgatagaccactttgcaaatatgcaaaatcatatttaacttatacaagttgcaaaaaaaaacaaatttaactgtaaatatatgttaactagttatagtttaattttttctcaacttatagaagttgaatttgaacttacatgtttgtggggtgatctatcttctttattttttattttgatgacatgtaaaaaaaaaatcccctctagagtttaaaatcccatcccatcaatgtatagcatcttcaagtgtagtaggtcctactaccatcccagctcccttatcaatgtcagtttggatctcccatacatgatcccactccaccaacccctctccacccaaccaacccaagtccatgacatattgcagccacttctagtcggctacatcaccgttgtttggtgccatgtcaactcacctcaccatttgctttgctttatttttcttccttaatttgtttggagttcaattgttgtcctacaaattttagcaatatttcttttcccacttgactcctaggttatttatttgaggaaaaaaaatcaaaaatttaatgtgagcgttcatcttgcaaccgaagttattataaaccgaacattgagccccctaaacattctcgaaaggtccgagctaccccagaaaactgttgttgagtagatttgcctacacgctgcatcaagccattgacccaacggttttcctttctaacacactgacttaattatatattttgacacgctgaatgggaatggatcctgatgaaatcccatgggggcaaaaaaaatgctaatccaagtgtataatgatttggcatgactacaagacagcgtcggttgaaaatagtgtagacgctacaatctttgtttgtcaaatacaaggttgcggttctgtttttcagttattttgtttttcaagccaaagaccacggcttacagtgcggtaactgcacagtaaccacgagaaaattttgaattcaactttttaaatatgaaattcacgtggtttgtgataactaccgtacggaatgtggcctgtgggggtggccgcgggggcggacacatcctcgaactcacagatgcaaatgcaatgagagtaccatattttaggaaaccttctgcagcactacatgaattagcaaacagtgttgtgatgttcattgaccattgtgcaatcaaataaaaatttaaaataacacagcgagacagttaagtacagtcaacatacagatgcaacagtttgcttctatttggtctttatcccatcagtacctttagaaccaccatcatacgcagaaaggaagaacgaactctggttcttctgcagaaacctaccatgaattccaaattggtttagtaagcattttggctttaagtatgcctaactatcagggattgctacaatctggtaagcatgtaactaaaattatggtattgaccagaaaattgattgtgggacagattttcaagcatgtttctaaaagtcaggctaactagagagctgctagtatatacagaagaaaaataacggctggaatttcatgaagaaatgaaggtgctaaccgacttcacatatttgtgtatattgatgggaaatgaatatgttgccatagtgacgccaacaataaaatcaagaaatatttgcttacttgagaatgtccagcaatttctgctgtagtttgttgagtgcatcttcttccatgttaacagacgcaagtagctccggcaatttcactgcaaagcagcaagaagtgaaccctttcaaacattgtacttagccttccaaattattctgagtctcaacatcctaccgacagtccgacacaaaacattcatctcaaacaaaaccttgtatttcattcagctaatgggggttccaatttattcatacctgtgaacaattattacccaggctctagttcaaattataatagaatacacaagggttacaatagtcgatgttaccctcttcaactatagccctaacctaaaaatccaaccctcaactatgaaattggacattttcaagctcaactaccaaaaccagttacagctgacatggcaactatttctacattgcttgcaaataaggtgccatgttcagcaaaaagtagataatttggatgccaactctgcaaaaaccaccgtaaaaatcatattggactggtcttaaggggctcttttgattacgctgttttgtttcatagctgagaattgatttctagacaacataatagatgaggagggtaaaataaattttactcagtcataacaatgtattcaaaagtgaaactgatataattggtttcaacaagagaaggtttagaaatgcaatgaaagcttgaagaagtaaatttgcaagttacattcaggaagaaagtgaaattttgaacagacaataaaccttgttcctaattgtttccttactttactgaataatttattcattggtggatatctcatataatcgagaactgcacataccaaaaaggcgcagtagatgctcggctccatatataattgagggcgaaacatcacctttaacctcttcagtgtactgctgttgttctttcttatataaaagcattgcaggcaatgctttatcaaagtagcatcgcaatcctttcaaaatctcagcataagagtcatttatccttcagtacaaacaatacaaagttttagtgggtcttttcaagaaaaatatatattttttaaaaaaaatcttgacagacacagatgatgcaaataggttttggataagaataacataacatctaaacctttgttgcataaggacagaatttccataattatggttattaatatgaatattaaaatgattttataagttttgggtctcagacatttagatgtagtgaaatttaatcagaaagagttaaaggtcagtttatggttttgtggatatacaaagaaaaaacagcaaaccagcagtctgaccataggaaaccagaattggcaacctcaatggttctgtttgcttcatggactgctcatgcaattagacaggtaaaaacaggcaaatcagaaggttacatatgaaacctatgaaccatgaaaatcttgaaccatgcagccaatgtgcaacatgaaagatttgtccagggcatggaccaataaatgctggaactctccttgtgaaggcacacagtacaacagaaataatcccaccagtgaggccaaggcgctgaacaagaacagatgcatttcaatagctggtttgacttttggtgtatggttttcagtcatgttaagagaatagcatgcacatagtaaacatactattggattatgctgcacataataatcagtaaccaagcacacagaacacacaggatgaattacaaaccctaagctaagagtggaaattctgtggttgtgctgttgcaaaac

SEQ ID NO: 65026 - DNA, 638 bp, Oryza sativa
cgtgctcatccaagctgagctgagccgtagtcaagctaggcaggaaacacattacacatagatggatggatagacggtggatggagtgctccttccattccaaaataaatataagtatttttagcgcagtgataagtcaaatattttcaactttaactattaataaaaaaataaaaaaatcaatcacgtaaaattgatgtcactagatttattattaaataaactatcataatatataactcttttatttaaaatatcttacttttatatagattttgttggtcaaaatagtatatcagaaactatgttagagtctaattttatgactgagggagtacctgatttgtcgtcgcccgagcggtgagggcgatggtgaggcgacgaatgaaggtacgtgccatggttaggagggagcaagacagtgttgacatgcatgcatcgcctactctcaaactctgttttgatttgatctgtttccttatggttttcgttcagcgcccttcgaattgcctcacgaattaatcctcaggcagccaggcgatgcttactttgaacctggcactatgacaagggggctactacttgctccctccgttttatattgtgcatcatatatttttttttaaaaaaagcaaact

SEQ ID NO: 65027 - DNA, 1518 bp, Oryza sativa
tagccagttcaaatagagaaaagggatgagagagtgagagcccggccccccccccccccccactcagtgttatttagggtacgcatatgctcgttccctctttttgaaagcaccccctatctgaggactgccaacatttccgaacccccctttcgcgggcttttcgcgggcttttcctgccttggagacccccctaaatcatgaaaaatggtcaatgtaccccccttaattcggaataatttcttaggagtgcaaagagatgagagagaaaaagaaaaaaaacaccccctttttaaagaaatctccgggtgaaaagtcaaatacaccccttttttttttacaattctcgggccggactttgtcgcacgaaaagtacccctttaccggacattttggcaacacgcatgcggtcatttcgaaccctgagtggggggggggggggggggggggccgggagtgaaaggaaggataaaagtacatgcaatataaaaatacgaatgaatggcagaacctgctgtgccaatcatcatgacagttaatataggttttcccgcccaacttcgtaaacttagcatccgaattaacgttacgttcattcaacttcgtgcgaaattgaatgattatgtagatcaacattcaaaaagctaattgcgtcattcaatttgatttagtaccatgcgccggacagacagtggtatgtcttcgtgcattcaattccgtgattaggcatacatatgtaacatttgtgcattgcttttcatttgatgttaatttgtcacttaatatacttctgtttgaataattttattcaaaatttacttggaggaatggcatgcgtattcgttacattacacaggtaactgtccccagagaaggtgcacaatttgtgacttctcttctaagcacatgctatatataaacagatcttggacagaggtatagttcaggtttaatagacatgatggaaacaaaataaaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaatttttcagactgttttcaaaacaatatcatgtgtgtcgatcatagttctatgaagcttgatgtctcatggtaatttaagcaatctaagcaacaatttttgaatttttgcgacaatcgttcgcctttgctgctctttaatactattatgacgtgcagtaacaaatttaacagttgattccacttggttgattctattgttcgggttatttagcagaacgagatagaaattgacattctcatggcttacgactttgcgttagtagttgttcatcgtctct

SEQ ID NO: 65028 - DNA, 2067 bp, Oryza sativa
agattctccctcttcccagtacatgtagtaggagtagtattagaagcagtatcacaataataatgacaccaattattattatggttggtggtgttactaatgttatttttgtaattatcaggtgggctgtatatcgtaaagaccaccttataatttcgttattgcctttgtttatttatttatttattatcaggtgggctgtagatcgtacagaccaccttataatttagttagatttgcctttattatcaggtgggctgtatcttatacagaccaccttataattttgttaaaatcgcctttattattctttattgttaggtgggctgtatatcgcacagaccaccttataatttcgttagaattgcctttattatttatttattcatcaggtgggatgtatatcgtacagaccatcatataatttcgttagaattacctttatttatttatcaggtgggctgtatatcgtacagaccaccttataattttgttagaattgcctttatttatttatcaggtgggctgtatctaatacagacctccttataattttgttaaaattgcctttattatcaggtgggctgtatatcgtacagaccacttataatttcgttagaattgcctttattatttattttacttatttcaaaccacttttttgtaagcacgattacttgaaaatggctcaatcaaatgccttcaaatttggcacacatatatgtataggcatttatgtacaaaacacaataacgttttcaactatgaccttcactgatgacgtcatctaggcgccattttgtaaatttttccgaaaatcaactcatgaacatatcttcataaccaaagccatttttgattcatcatatgaaaaactttcgttcatctgctccgcacgcatcgcaccgtgagctacaacacgtgaaattccttaccatttcatgcattacctacgctaaatcacagcaacagcctaactaaacccacttttaataccatctcggcctgaattttaaagttcaatgttttctctttaagatgatataaatttgaaataatttcattcgtggggaaaggttgcactttttgctttaaaatgtttaaaaaaaacctttcacgacactttctctatggaggtcaacggattttcgcccaaaatccgtcaactctccatacttatcttggctgtataactgattcgatcggcgaattgcaccatttcgcatatcaaattgaagcagaggtttcaaagattccagtaatgtatcattcattttgattggataagaggaaaaggttgcacttttgcatccaatgatttgctgtctctcatgtatgctccttttcgcgcaagagcatgacatatgccacactacacgagttccatagacgtacacattagcgtgcgaacttttgcgttgcatgtgatttgaaacagcacgtctcctctcggaatgttcttcgaacttgtccattttgtgtagttatttctttcaatatgtgagttttaaccttaaatatagaaagaagaagacatgtagactgtagtaatgataattaaatggtgatacattatggatttgttgtgtaatttgccagtgaccatgaagaaacacaaaggattttgtaaaattgttcgtcgtaaacctcagaccctgagagaggaatgttccatttgattttggggttagatatataattagtgaactccttgatattgaattatcgatatgaattcaatcttcaacagttttaaagtcttgttattgtttttgtgtcgtcttagagtttcattaaaagacataaacatgcaaatgaaatcgtccttgttttatgttcatgttatgaacaagacccattctccctattttgtcataatggacgcacccagtgatctgtgttacgcgccagtgcacactgcgggacttggtgcgaagctctgtgcagagttgaccgagccggtgagcaatccattttatgaacgaattccgcggatcctctccctatagtgagtcgtattagcggccgcaaatttattagagcaatatagtcctacaatgtcaagct

SEQ ID NO: 65029 - DNA, 1531 bp, Oryza sativa
ttttggattgataccaaaatatgccctaccaatttattagtaccttaaatagtaatcatataggtttggattgaagccaaattgttagtcatacctatgattaatttgtcactaatctagaaccttcttctctatatcatcaatacttgtcatcatattggtagcaatccaaacatatataatgaatctctacccaaccaaaaaattgatagtaccaaaacatgtcaagaatttggcactaccaatgatttggtaaggtagagatctaaacagcctcttaaagtcgtgtgactttatcgctgatatgtgaacctaataaatactacatccgttttttaatagatgacgccgttgatttttctcacatgtttgaccattcgtcttattaaaaaattttatgcaaatgtataagatataaatcacacttaaagtactatgagtgataaaagaactcataacaaaataaattataattacgtaaatttttttgaataagacgaatgatcaaacatgtgagaaaaagtcaacagcgttatctattaaaaaatggagagagtattggattcatatgtcagtgacttgtgactttgaaggtggggtatcttgatcaatccccacctcaccaactgcagggcgggcaagcaggttgaaaaagaaaaatacaaagagaacccaagtaatcaagtggtaatataaccgtggtctgagtcctctgataggtaattaggtagatatctgatgctaccggaaatcaatctgcaatctggcatgcggagcggacctcatcattttctcagttaagtggctaattaacgcctgatcttttccgggcatttttatctgaatccgatcgataatacgcacgatgcaattttcacaggtactccacagtgtccgtcgatcggcatgcacgtacgcatgaatcaacacggcagcttttcgatgggtagcatgttaattaccaccatggccaaccgacgttaatttgcatcaaaaggggttaattagctgccagagtgacacgtcgaccactgaagctgtgaagactgaagaatcatcccgctccatgatttgccgcgcccatcgaagcttttaaacgtacgatcgacaaggctttgctttttttttgggtagcgatacttcaacgagagagaacaatacttccatcgttttgttttcccacatgatgatgttttgcacaggtattcagaaatgatgcagagcaagtgcagaatatacaatataatgcactcttggatactttggtgggtgtagccttgtatatatatgttcagaaaataatggttgatacttacctccaggcataatcaggaccatgggttaaactattcctagggcttggtaaacaaaaccatgacagatgtacgggttagaagagatgtctttaggccttgctttgacagtttgactgcatatcaagttatgaaccctatagctaagctagctagctaaacctgcaatgcatttgcactgtatatcttcttctataaaaggcctacaacccccaaca

SEQ ID NO: 65030 - DNA, 1053 bp, Oryza sativa
attcctgcattcctgaatgttgctttggcacatgcccatgaatatgtgttaaaacaatcatgtgagttgtgggatgtaaagtgtgaccttttatatgtgcctaataaaaatatatatttttttcagttttttggcaccagctggtgcactcctatagggttttcctacaagtgtccactcctgttttttatttgctcaggtcagtctagttcacaccgtttgattgagagatttaaaagctgatagagttggagttagaactctgttaatcaggcactaaaagaatacttaatttaatttagtcgctcgttgtcgccggatctcacacacgatgaccagaattaaacatcacccgcgagacgcgacaaagctcatagcatgtagcaccaggtggtaattaggccctgtttttttcagcttgggattatcataatccagattattagaagtaagctgaaagaaacagacaacttattgaagtagcttattataatctggagcccagcttattataatctgataagctcatttaggtgagctttttctagactattgggtgaaaaattacccaccatgccaccccacttcctctttagatttgcaaacccaataatctaggctataataatctaggaaagaaacaactaaccacttattctactacatattataacaatctagcttatagtaacctgattcaataatctagattataataattccaagctgaaagaaacagggccttaatcacctaaaccaccacgtttttggagtataaatgattacggcgtccaaaacccaactactccggtgcatgaatcacgcctccgagcgccccgcaagtacagccaatcaatcaacaacgagaaagcactcgtactatatactccatccgtttctaaatactaaatatttgacatcgttaactttttagcatatatttaaccgctcatcttattataataaaatttatgaaacatgtaaaaccatatgtatatatgaaagtatatttaacaatgaatcaaatgataggaaaagaattaataattactt

SEQ ID NO: 65031 - DNA, 510 bp, Oryza sativa
gagggaggggggcagcaagaggaggggtggtggggaaaggggagaaatgagcaacattttgaatgaatttaacacggctaccacgacgagctcaggggcgcgacgcgaagagctgatctcaaaaagaaaagatatgcgggagcatgcagattcagaatttacagcagaggattctataaccccaacctcggtcccgtctcaagcgcctgcggtccgctttcgccatcttcacagggctgctgttccactctgtctgtagcctgaaaaattgagaaagaaaaggaggagcttgatccattagcttcatggagtatatgggaagcataaattctgaatgttatgtggattggccaaagagaaaataattcaatggttaatctgcttttccagctaagatctcagtctgctgtgtttagataaaaagaataagcagatgacaccatttggatgtgaagagaactttgaagctgcttatagagataggaggggaagagtgacaacctccctata

SEQ ID NO: 65032 - DNA, 8134 bp, Oryza sativa
attcctgcagtccgtataatataatagcagctgatgaactaatccaatctcaggccggcctgtggcaggcacacgcaagggggggccctcgaaagatcagttgcaacaacacattagtctctaatgatctactctctccatcccaaaatgtttgacgccattaacttttttaaaaatgtttaaccgttcgtcttattcaaaaaatttaagtaattattaatttttttctatcatttgatttattgttaaatatacttttatgtatacatatagttttacatatttcacaaaaatttttgaataagatgaacggtcaaatatattttaaaaaatcaacggcgtcaaacatttagggaacgagggaatactatacttttcagaattatggatgagaaaggctgctgttttggttgaggcccttttgggttactttggccttgacacctgttgtctcctcttcttgtcatggaatatatctcttcttgtctatgcttgcatatgcatgcttgcttttcacctgtcaaaatatgcatggctctcgatctactgcctatatctatggacattttgtctctccggttcatcattcttgagaggattggggctatatgatttgatttgccgtgtcccacgtgtgatttgagtttatttagagtggaacctgtcgaaagagatattttccagcacactgttgaaatagatattttccaagatttaaacagtttaatttccggttctctctttttttcctgctacagatatgttctacgccgtttcaaaatataagcacttttacgtgcttttcaagttgtaccaggacacatccctccatctagatacattttagaaaatcaatccgctgaaatatatatatatgcttatattttaaagcagggggagtacacatgaaacaaagtgtcaagaaaaagtccattttatacttttaagttttataaaattctgaaaattcaaataggacaatatttgcctcttaacttttcaaaccgtacgttcacctccaaaactttacaggcaaagcttttggctcacctccaaaacacaagcactgtattgaactgtcaaaattttctatgttaatcttgacacgttccctagacagaaagcgatgcacgcagtgacctgctcacacacgtaaaaaagcaactagtctccaaccttgattgcagctttgaagattagaaaacactaaaaacttggaaggggacgcccttacccttgttccaagagacacttgggccaagatcctgcaacaatattccagcaggtatacatgattaaatttaagtaaaggaagaaacgcacgcttatttatgtgagtagctagcctagccatcgtctccgtgatcagggagaaagtggagaagatgacaacgtttggagttggttggatcttttgtctagatcgaccaccacacatcatgcctgcatgttaatttcttcagtttttccatgatgctagctgtgcattgacctcttcttctgcatgcttgctgcatgcagacgtcggtggtaacttttcgttttcaccactttccacttcgctgattaatttatggataatatacagcatggatctttgatgctatgatcaaagttctgaaaatttacttgttgtagagctccgaagaaaaatagggatgaaaacagtttcgaaaaattccagaccggccgatcgagtatcgcttccataatagttacagtttgaccgttttccgattcaagctatatataagattcgtttttttctaacttatgtcagtatcatgttgatgccattactaaatatatagctaaattagtagatttagatttttcacattttcaccacttcacttatggatatagtagcatggatcttcgatgctacgatcaacttctcaaaaaaattacttgttatagcaccgatgaaaacggtggtggaaattccatacagaccgaatcactaatttctatccgcgtctgttggtttatatatagtcgctaaatagttaaactggtaaatacgaaaaaaatccttctttgatcaacccagaaccgtttatttgtgcagacatgattgacatcgattccaacccaaccgtgttttcgtcctcggatgataaaatcactccacaagttgaagcttgaaacgggatcagttgggatcgattcggtcccatcgtaggtactccctccgttcaaaaaatcccacttctaaatttgaatctagacaagtaggttaaaattcgatcgggttaagcacttatgttggaccggttaatttcccaaccgaaagctggtgtgtgtgcagctgcagctttatctggtggtcgttggcttatcctttcttggatcagccagcgagctagcgctagtgcgccgcacgcgccgcctgcggctgcccatgcatgtctcggtccctagctcgtcgtccttttcgcgcgctgctcgtggcggccacacgaccacgggacgacgtgccgcgcgcccgcgtacgcgcgtgtgcacgccgccccgggagcccgcccgggatgatggccgccgcgcgcgaggcgttttgtcgtgtacgcgtatacgtctccccctacgcgtcggttggatgggcacgtacggccgatcgatatggatccgatcactcccatcacacttgcgacactagggattttgaacagatgagatatttccaagtactatagatctatacaggactccttatccatattcattatactagagaatatctcatctgttcaaaatctcttatatttcaggatggatggagtataatgtgctgttttgatccaatttgtagagaggatcaacgagcagtgttttcaactaggcatgcataaggatagatagagctaattaaaccgcccatttatagcagtttaggcaccaccgggagacagttgaaattcaatcccttaaatcttgttttcaaaatctttaatgggatttaaagacatgaaaatatgttagcctctaacatatagcttataatttgacttcccagaacaattaaacatcgggccgtgccaaaatgaatcggtcatcgatgacggggatatattatcctctctccatacgcacacgactccacctccactcggcacacgctccgtgaaggaagaaggtccaagcggcggattgagagctagggtcatcttccaatttgtgggtacagggtttggggatttgatggaaagattttctttaacctaaaattctgtaattttgcgctttgggagtagtctagggaactcttattggtgcttttaattaccccatacgattttgttagctgacacccttttccatgcggtggatcccaccaaccgttctctcccaacccgccgctgtaggtgccaccgttatcaactatcacccattaccagtcagtcactaccccgtcacccctctaagatccaggaatcacgacaagcggtcggaatccattcacgtgttgaacacacacgtgtgtgttcacccattatacttttcagagcggttgaaacccgttcgtgcaacgagcattaggcttatcggatatatattacattgatagcctttatgcagtaaatttggccagccttactgtgtcttagctagtaagtactcagttatgttagatttcgtacgttatacatttagcttagttaggcacctatgtgaatggcagtatcatagcagaaatcgaactgtgaataataattgatacctgtcatatccatccactatagaagttgttttaaaatatcaaatatatccatttaatttgttaagtttgtagtaattaaaacttaattaaatatactaatagctttctcattttacgtgcgccaacttaatcttcatcttcatcagttttaaacactaccacagtagcttaaagcaatcaacagctgttgcatatcatgccatgtttcgtaattggaatcaagagtccttaatctataaaggtatttcacaggtaaaccactttaggttaacgttcttcacttttaacctccaaattaaaaagtcatatacatgaaaaatagacgatgtgcatttttaagataggaaagcaaatattaccacctaaactaaacatgccactatggcacaattaacaaattttgctccactaccattgaggtatcaattaattaatgtcgtgaaaagaaaaacacattaattcgagttcaaaagaccttgtatgaccaaacagccataaatcccttcttggcaaccatccaagcccaaattggtcatttcaccaatgctctaacccctataaatcccctccccaacccttcccatttcgctcacacatcgatcacagaaagctaagctaaagtgctaaactaagcacgagaaaatctaatcaaccaagcttagattagatcattagctatatatagctaggcgatttaatcatccacgagctagcttattagctaagcagtagcagcagcagaagatcgaagatggtgaaggagttcgtgcaggacgaggagaagcagcggctgctgctggacgagcacaccgagaagcacttcaccgccggcgaggtggtccgcgacatcatcatcggcgtctccgacggcctcaccgtgccgttcgccctcgccgccggcctgtccggcgccaacgccccctccgccctcgtcctcaccgccggcctcgccgaggtcgccgccggcgccatctccatgggcctcggagggtaagcccaaaaccaaaaataaataaaaataaaacaaaataaaactttcctcctcttcttcttcctctgcaaatctctttctgttttttctttgatttctcaactattttgcttggcaaaatggcaagcatatgaatgcatgcgttttcacagccaaattaattaattaattacccttttttaccatgttttttcgctgcatttttctctcttggaattaaagttaattttgattgttattggattattttgattttaattataggtatctggcggcgaagagcgacgccgaccactaccaccgcgagctgcagagggagcaggaggagatcgacaccgtgccggacacaggtaattaattaagtcggtaacagtaattaatttctctcggagtttttttttactacatctgagtttattattaccacggtggtggttcgacggctgagattggtttggccccacttggcagaggccgcggagatcgcggacatactgtcgcagtatgggctgggcccagaggagtatgggcccgttgttaactccctccgcagcaaccccaaggcctggctcgaattcatgatgaagtaaggggaaaaaactaattaaatcgaattaaatttaaattaacttcattattatggaatttcatatttcttatgacaatagaaatgatttacatctcatgatcagtgtgggtgtcgtgtgttaaatacttggagaaatatataataacttatcggggacacatattataggtttgagttgggactggagaagccggaaccaaggagggcgctgatgagcgcgggaacgatcgcgctggcttatgtggtgggtgggctggtgccactcctaccctacatgtttgtgccgacggccgaccgagccatggccacctcggtcgtcgtcacgctcgccgcacttctcttcttcggctatgtcaagggccggtttactggcaaccggcccttcatcagcgccttccagaccgctgttatcggcgctctcgcctccgccgccgccttcggcatggccaaggccgtgcagtccatctaagtactgtagccggagctccggctgcaggcatccaagtaaatgtaattaatttagcagatccaataagtattgcagaaatgtatgtataagtatttatgtacgtttgctgcgtgcttgtagtgtattagatgttctggaggtgtatccgtagttagccctaagtgtaccatgtacacgagtgtaatcactcattttatatcgtcttctattttggctcccttttttatattcggttgggattaattaataatgtattgtcgatttgtaagcaatgatgtgctttgttatctatacttacttaatttaattaggtagttcggtgcattgagaggaaatgtggatgatagttgatgggctgtgaagaacagacacggccaagattaattttcagtgcaacccaatatttgtcaaactatcagcaaaattctttattttttcagagaacgatcatcaacagttacattattactaaacgtgacatatgcagtgataaaagatattttttataaatatttgagtttctcgcaggataaaaattctactcacagtggtttattattatatatgaaacaatgatactctatactctatatgttcctcagttaggcggtacagatgaggggcctcatcggtgctggttgttatccggcacctataggttgtacgatttgaaaaacaaaaaacggacttggctcaattcgaaccgatgctccaaatccaccaaaaataaatcgaaaagcgagagagaaagggagtacaatttcatcatataaatcaagccgatgattggataatgaagaaacagatacccaagaaaacaaatcattgaataaacacatcacataaccaatatttacaaaattcatcacatggatttggaaattctaagaccactcgttgctgttgttcaccatggagaacttcagccacctgctgccctacagataactactgatgttgagatcatagggatagagggatgaaaggagggagaataagaggggaggaggacacaaacctttggcgtcagtgtggaggatgaggccagcggtgggaggatgtcacaccctgaagttcttctctcaagcctaaattgaatttataaatcacctagagaaaataccggtgtcaaagcaagagaaaccctaataaattaatgcaaataaaaatcggaattggcatgtgggatttttcttgagttctacatgtcgaaatatgctaacaagatttttagtggaattttcagagctttagaaataattttaaccaattaaaaataagcacaagcattatttaatccctggaaattcttctcctttttctttttcttccttttccccctccttttccccaaatgggccgccggcccatttcctccccctcccgcgcctttgttgggccggccgaaggccacggtccagccgctcgcccgagcccccctccccctcggacgctgacaggtggggcccacctgtcaggcccatccctaacctccggccgcccgccgtccgcagccgccgcctcacaaccgcccgcgcccgccttccccgcgccacgtcggccaagaccgcacgtgcgtccgcccctcccgcacccctcaaacccctctcccgctcgcccgcgcccccgagacggccgggattcgaattttgaatcccgcctctctctccacctccacctccccacgtcggccggcgaaatcgggccactcccggtcgttcccgacctctccgcccctatataatccatccccgcatcctcctcctcatttttcctttttccgccagcctctcccgagctctccatcgctcctgcaccgtacacccacccgccgccgcctctttcactactccggccgcctctagccgccgctagggccgccgccgccgttgggttcgcgcggccgaggtccacctcgtccacccctcctccgtcgaggttcgccgccggagccccatccctgtcgtgtgccggtaagaaacgccatggccgccgccttcggccggcgtttccgccctctatggtctctctctccctctctaatcctctccatttcgttccttaggtcgtcccggaccccgtccgccgcttgtcgacctccctccgttgttcctcgtcgccggtcgccgtcgtttccctccacgccggtcggaccccttcggtgaggacgcccctccttccccttccttcttcctcctctcttttccctggtagcaccgccgcttagacgtcgtcgcgccgccgccgtctgccgaatcgccgccgctgtccgccggtcgccgccggtgccgcgccgccgccgtgccatagccccgggtcggcttgagccgcctgcgcgcgccggccgagggtagatcggtgccg

SEQ ID NO: 65033 - DNA, 1310 bp, Oryza sativa
aataggttattgtcacggattatttcctcaacatctttagaaatgtggttttgtgttaaacaaatgtcttctacaattctactactacattgcttaagcacttgttttaagctattcatttttatatttctaaaaattatataatttatttctataattaaatacttccttcgtctgtccagatcgatccgttgtcctagtaaaggtcaaaatcccattgtaggtgacaatattttgagacgaagaaaatagataaaccataccaataacctaaagaaaaatttgttctgtacagcgtggagtcgctgagagaggaatggactgagcgtactgtggaggcacatgagagatgatgagatgctgtgtggttaaagttgcgtgaagcaacaacccccccgtgttgtgtgcgtgcttgcagttgcaggtgaggtcggtacggtgctagcttggcctctccgtgtttttctttcttttttcttttttttttctggcagcgtggcgcatgccgaattccccgagaggaggcaggttgggtttgggcgtttggctaagggattacctattcatttatcgataaatcttctcttaaaacggttcaaaaatcaacaaattccgaggaagaaatttgccaacagatttatagcaaaatagtttgggcaaaatatgacgatcaccaaccgagcgcaaagagtgtttatgggcgaaaaaaggtttgtaagcgagcttagaagcttactctatctgttcacgtagtattaaaatatggccctgtttggatcctatcttaaaattttttatccgtcacatcgaatgtttgaacatctgcatgaagtattaaatataggcttaaaaaaataactaattgcacagattgcaactaatttgcgagacgaatcttttaagcctaattgcttcatgatttgataatgtggtgctatagtaaacatttgctaacgacggattaattaggcttaataaattcgtctcgtggtttaccaacggattttataattagttttttcattagtacccgaacaccccatgcaatactctatataatacctgatgtgaatgggggtgttattataccctatataacacccccatatatcacatctcgtattaatttttttttgttttgtgatggaaggagcacacgagccaaggtaggcgccgacagtaaacactttacagcacaggtacgtgtctgtaggtagccaggtgggtacaccggtacaacctattccctccgtcctaaaataatacaaaccctgtgtttccgtgtacaacgtttgaccgtccgtcttatt

SEQ ID NO: 65034 - DNA, 1446 bp, Oryza sativa
ttacagcctgattggtaacgattgatcaatttatctcctgtcatacaacagaagggtagaaatgtcatggtgactgtccttttatttactttaagggattggaatcgatcatttcaaactttacacacacatattagctgtgcgctcgctgaaatgttgcagaatagtcattgtctttatgttgaataacatatatttataatggtcatagctctatggcattccccctgataccgacttatctcaatcttcaagcaacaaatttttactatgttacatagaatttcatgatgccttccttttatcttttagttgtgtacttatggcactaccactttaattgcgtaactaccagttagtgatatcttcatttgttgacattctgaataaagattcatgcttttgtcttaaagaaacaacttggttacttttcatgtgtaagaagaaaatgcacctaaatagctaactgatgtttgtgggggacaaacaggttcagatcgcccaaacatatgagaaaaatggagcagcatgcttaagtgttctcacagatgcaaaatactttcaggtcagtaatcttttcccttttgacaatttggctactcctctgatgcattacgaaattatgcatgctgaatttgtttccgtttgttatgtaatcagggaagttttgactatttggatgctatacgcaatgctggagtacaggtctgtaaatttgctcatatgttgtacttccacttacagcagtcaaggaaattcagttgtgtggttcgaatgtatggaaaggctcattctcttgaatttctaaatgcagtgtcctctgctgtgcaaagagttcattgttgatgcctggcaactttactatgcgcgtttgaagggagcagatgctgttcttctgattgctgctgtcttacctgatcttgatatcaagtatatgttgaaaatatgcaaaatacttggcatggctgctttagttgaggttagctgagttatttgtgatatgttttacatgtcaaagcacttccaactctcttatgttagctgctttggagtcattctactagtgttgcaacttccaattcattttcttcttccaagtaaatcaaatgcaacctcaatattcaaattttgatttaataaacaagctaaatgtgttctgaaggtgcatgatgaaagggaaatggaccgtgtgttagggatagatggtgtccagctcatcggcatcaataaccgtaacctcggtatgttattcttgtttcacatgtttagacaagttactttggcacatatattatataacaatgtatggattcaactgccagtgtgaccacacaattctttgtcagatttgttccctataagtcactgtggctaagctatcatggtgccacctgaaaacctgttggctcatattgaactagtggcttgtgcattttcatctatcgc

SEQ ID NO: 65035 - DNA, 8679 bp, Oryza sativa
catagcccggggtcggcttgaaccgcctgcgcgcgccggccgagggtagatcggtgccgtcggttcggctgcccgcgtggctgccacgtggccgctgcgtgtgcgccgcgtcggcgccacgtgtgcaccacgtggtgcgccgctccttcccggtctgtggacccggtccaccgtggaccgccctacccgagtcactgccatgtggggcccgcatgtcggcgccgcctctctctctaccagggttatttattgcgcaataaatcaaataaggatttttctgttcatagtaaaagcacattgaatcttctaaaattcatatctaattcatccgagctccgtttaagcccattcaagtctcagtaaatcaagcaaaatgtgtaaaatccattaaaaatggttttgttctctgtttcagtagtcttatagcatgtttgtattgtttgttttgtttgtcgcttagattccggctctcccaacgctctggtgtactttgagatagtcgccgaggttcctccagcagcagagcaaggcaagtcatgcttgtcacttgaacatgttgatcctatattgcaaatgttctattgttttccttcaaatcatgcattgttttacaatgatactatggggtgtttacctactgttacagccatgctatttttgtaccatgctcctttgttagcttgtgttataaacatgactagagattggactagggattgcttagccatgcttagttcaactagcacacaatgggggaaatcacattaatgcttagatatcggattctagtaagacgttggttaatgccatcgctccggtgttggttaattaagatatgttaaatggtgggctgtgggtgcatggttttgttggtcgcgcccatggcatttaaggaccggttcgcgggatgccctggaagaacttatcgtacttaccacaagccaacgtgggcaacggttgggcttgtagtgtagctttcctctagttaacgcatccaggcaagggtgggcgtgatggagcggggcgggccctgcgacggcctctgtcgcttccggattcacctaggcacgagaggggactgcccgttgcctgctagggacaggggtgaaacctgaggtgtggtgtgcttggctagagggggttatgcgaagagtcttgtcacgacctctttccggtatgtcgtggtggcatgtcggcgcacggaaacatgtcgtggggctgtgtcttgtgggtaaagttgtacacctcttatcagagtaaaactattcgaatagccgtgcccgcggttatgggtggtcaaccagattcaccgtgattagtcttaccctagtttagtctgatggaactgattagttcaggtggttggttgggcctgttgcaacgtggtgtagcgttgaacagtggatggttaatattgattaattattacaactgttttactgttttcaactactgtttataaatgttcgctttatgcaaaagaacctctctagctatcctttcgtaatatcctgcatcataccccctgttccgatatgacttgctgagtacagtgggtagtactcagtcttgctttattttccccaaaaccccagagtttgagtatgcgtcagatggtggcttttccaaggagtagccttcgtccgtggcgtcgaggatgcctatggagtggtgttcccgctgcagttaaagtcaaggcttagttccggttatcttttgtttttccgctgcatttatgtaagacttttataatgtttgtaagacgtggatctgtatgtcaaatttgtcgtttgtgtacaccggccggtcctggacggggattttaatgcacattctgtttggaattctattcgggaatttctgggcgtgacaagttggtatcagagccgaccttgaccgtaggacaagccaaatggaaaaacctcagagccctctgaatccttttcattgcatatgttctttgcaattggatttgtttcgggaaaattgggatctgttcttgtggtgcaagggaaaaattttggtcgctcgtttaagtgagatttgtcaaatcaagtcagtctggggttttagtaaaattatttgagatttattcgacagtcagtcgggatttgatgggaagaatgcattaggtcctaactcaggaatatgggttgcaaggtatttatgctcttattattagtagtgtgtatctaatttctcattattttatcgctatgtaagttcgtcttatttattcgccctcatgcaaaaatggtctatacacaaaattatgctctctttagttcactttcattgagtcttttactgctttatttaaattggatttgagcatgcattgatcctacccctttgtcttctctagatggccgatcacccacccaaccaccgcggagaaggcatggatgattttgtggcagagttggctcgcatgaccctagtggtgggctaccccaacgcgccggagtactcgaccgttccaccgctcaatggcgagcttccccaccgtgttcgtctggaggttcatggctatgtgggcacctgcctcgctaatatggtggttgaggcatctgggggcactgcagatcatgcctgctaggaggcagcatatctgatgatggccagacttcgtgagcgccacaactacatcttctgcaacacggcataccatttccaccctcgtcgagcaagtggtgacgatgtcaacaccttccgcccgacagccggcgagaacgacaccaccttcggccacatgtgcgccgtgatgaggggaatggacaggatgcactcggatctgcacaaggcatccaaggccttgaatgacaggaagctcgtgaggatcatagctttaaaggatgagatagcgcgcctgaagaaggagaacgcttagttgaagggtctctctgcgctaggaggagttcggatccgcaccacgccccgcaagtctacgactgctcccgtgcgcattcagcttgcgcccaggaacccacctcctcctgcagctcctcccgcagctcctcctgcagttcctgtagcgcccgcagctccaactccagccccagctcctgttctagtgtcagctcccgcgtctgctctctccttcgctccagcgtcagccgccaggggtctagccagtggcagccacgaccgcagcagtagcagttccagtggctcagagccgggcagcggtgagacgtatctgccagactccaggagccgctcagaggaacctggcgacgagcaggaggacgcattcgactccaccgaccgcaggagccgttccgagcattaggctcgttttcccttagtttatcgactgcttagtaattgcctgttagtttgtgtgtctaggtttgttcgcttgtgggtcagtcgacggtcgatatcatgtgcctatgatacgactgtcttaataaggatttgcttgccgttttaagtgttttaattcagatcagaacaattgcagtttaaattcctatataataaagcttagttcctgagcatctgtttttcttgttttctccccctccgtctgctctcccttcagatggtcaacaccaggaatggcagccgtgcagcaggtgaggacagcaacagcgaagaacgcaccgatggtggacaccccaacagcgcctctggcaacggtccgccactgctccccgagaacccgacgctcgcacaagtgatgacccatcagactcagatgatggcagccatgatgcagcagcagcaccagcagatgcaccagaggatgcagcagcaaaccgagcagcagcagcagtagcagtttggtccccctctcccccagttcaagctgccggagtttctacgtgtcaggctacccaccttctctagcaccaccaaccccatggaggcgaatgactagctccatgccatagagaagaagctcaatctcctgcagtgcaatgatcaggagaaggttgccttcgccacacaccagctccagggtcccacgtcagcttggtgggacaaccacatggctacccgttcgctaggcacagaagtcacttgggcggagttctgtcgcagcttcaggaaggcgcaggtgcctgacggggtggtggtacaaaagaagagggaattccgggcactccaccagggcaacaggacagtgactgagtatctctatgagttcaatcgtctagcgcgatatgcaccggaggatgtccgcactgacgcagagaagcaggagaagttcctagcaggcctggatgacgagctgaccaaccagttgatctctggagactacgccgactttgagaagctggttgacaaggcaatccatcaggaggatcagcgcaacaaaatggacaggaagagaaaggcagcgcagttccggtccaaccaaggaagccaccagcgaccacgcttctttcctggacagcagggtggacctaccaccatgatcgtccgccagcatcgccctttcaactcaagcagcttccaccagggagccaatggcagccagaaccaccagggaggtcagcccaaccgcagtgcagctccgcgcccaccaatggcaccagcatagtcagctccatcagcccaagccaagaaggagactggaacaaagccagggtcctgcttcaactgtggtgagcatggccactttgctgacaaatgcccgaagccaaggcgtgccgggccaaggtttgtccaggctcgtgtcaacaacgcaacagtactttttgattctgcaccagaggtcgtactgggtacgtttcctgttaactcaatccctgcaacagtacttttcgattctggtgcaacacattcgttcatttcaaagaagtttgttgggatacatgggttaataagagaagaacttagtacaccaatgcgggttcataccccagggaatagctccacttcggttcaattcagcccttctataagaatagaaatccaaagatcaccatttctagccaacctcattcttctcgaatccaaagacctagatgtcattcttgggatggattggttgaccaagttcaagggtgtcattgattgtgcgaatcgcacagtcaccttgaccagcgagaagggagaaacattagtgtacaaatcaccagtctcaccaaagcagggggcctccttgaatcagattgaggtggaaattccagcggtcaccgaggagaagagttcgaggaaattggaagatatccccatagtctgcgagtatcccgaagtgttccccgaggacctcactactatgccacccaagagggagattgaattccggattgatttgacaccgagaactgctccaatttaaaagagaccgtacagaatggcagccaatgagctagcagaggtcaagaagcaggttgatgagcagctgcagaaagggtacattcgaccgagtacttcaccttggggtgctccggtcatttttgtggaggagaaggacaagacgaagaggatgtgtgtcgattatcgcgcactcaatgaggtcaccatcaagaacaaatacctgttgccgcggattgatgatctgttcgatcagctgaaaggagccaaggtgttttccaaaatagacctgcgatcaggctaccaccagttgaggattcaggaagagaatattcccaagacagccttcaccactcggtatgggttgtatgagtgcacggttatgtcttttggacttaccaatgcacctgcattcttcatgaacctgatgaacaaagtgttcatggaatttctggataagtttgttgtggtattcatcgacgacatacttatctattcaaagtctgaagaagaacatgagaagttgaaggagcaccagttatatgccaagttcagcaagtgtgacttctagttgtcggaagtcaaatttctgggtcacgtcattacagctcagggcgtggcagtcaatccattgaatgtggagtcagttaccaaatggaccccacctaagaccgtgtcacagattcggagttttcttggacttgcgggttattactgtcggttcattgaaaatttctccaggattgccagacctatgactcagttgcttaagaaagacgagaaatttaaatggacggccgagtgcgacaagagttttgaggaactcaaggagagattagtgtctgctccagttctgattttgcccgaccaaacaaaggacttccaagtctactgcaacacgtcccgccacgggcctggatgtgttctaatgcaagagggcagagtggtcgtttatgcctcgtggcagttgtgtccacatgaagggaactatccaacacatgacctggaattggcagcagtggttcatgatttgaaaatatggaggcgctatctgattggcaaccgctgcgaagtttatacggatcacaagagtctgaaatatatcttcacccaacctgatctaaatctccgacagcgaagatggttggagctaatcaaagattatgacatgagcattcactaccatccgggcaaagccaatgtggtggcagatgctttaagcaggacaagctactgcaatgctttgtgcaccgagggcatgtgtaaggaattgcagcaagagcttgaacacttcaacttggaacttgttgaacacgggtacgtggccgccctagaggcacgacctacgctcgtggatcaagtcagagcagcccaagtaaatgatcctgagatagctgaactgaaaaagaatacgagggtcggaaaagcccgagacttccttgaggatgaacatggcacaatctgtgtcacgcccggaaattcactagtaatttccgaacttatttgtgcataaaatcctcgtccaggaatcagccgaggaacacaaactgacaatttaatatacaaatccatcataataataacgttacacacttacaaaagaaaagaaaacagcagcggaataacggtctagcgatggcttcagctccactcccacatgcagctcaactggggtataagccaaacgtcttctccttctggatcctttttcttcaactgaggttgattgattattgcaagagtgagcatatgacatactcaacaagccacacagcaaatatgcaagtgcacaaggataccaaaggatggcataatataggctcatttgcaaaagcagcatttagcaaaacatttaagagaagtaaaacagtcgagtaattaatcagaaattttaatcaacactgaatagcacacccatgctgcacaggcccaactatcctgaacaaccatacccggctgtacagatctaactccaaaccaggagctaaacaaattattaccagttatagcatcaataattattgtgagaggtgtgagactaatcacgaaaaacattgctcaacccgcccataaccgcgggcacagctattcgaatatttttactctggccagaggtgtaccactgtacccacaagacacagcctcaacatcatgtctaccatgcgtcgcgatactggaaagtacccgaatagaggctgtgacaataccctctgcacaacataactcaccacagtgcaccattcctggatcataatcacccccttatgaaacaaggcatggactccccagcgacccccgtgggcttatctccgccacttcttagtctggtgctccgcaatgaaccatgttatacaaaaggtaaagccgttgcccacgctggcttgtggttggcacggttaatgtttcacaacaatagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatttagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaatattcggtcttcaattaatcttcttgaacactcccgacgcactcacgaaccttcgcaacgacggaaacgacaagctaacacgcaaaacgaagaaaaagactaataaaaactaaataaacagtaaaaaaacaagcataaacagtacatgtggatatttttaacatgtagatctcgattttagatgaatttagcaacttgaaccagtcaaaaccgagttacgatgatttagttatgaatttccgaagatttaatcccaattaaacctattaaagaaaagactattccaaattaattaaataatttacaaatgatttataactgagataaaagattaaagcaacctccgaaatagattagattatatttggtagatgacatatattaaaaagaaataatatgccactgaaaagagcgaatggatttatatggctgagattaatcttgaccgagtcgaccaagattggatggcttagattgatctggcaagcgggcctcacgagataccgactcaacgagtcaattctacgtgacacgggatcacccaaatgatta

SEQ ID NO: 65036 - DNA, 14952 bp, Oryza sativa
aaattttgcgcaagtttttgcatattatgggtataacatgaagatatgaatcaacaatacatgtcattcccatgtccgatacatacaggatacagccatatgcagcattccagtgtatctggacatgtcattcaagtttagcatttaaaattaacaaaatgagatacagcagacccaccatctgcatcttatataaaaatccacgattagcccaatatcatattaaacccaaatccctctgtggagtatactagaaaacttgagaaaactaatgagcattctggaggaaatgcataatcagaaattcagaaaaccattttaaggtatcctagggtgaaacatattagttgaaaattgaagggaaatgcagcagatgtcacatggaacatgcaacttgggtgtgttcctcgttccggatcgaggaacgggaactatgtggaacttcatcccgaaaatggatggaacatggatggaacttcatctcgagagtggtcccagtacaaggtatgatagaataacgagtagagcagtatgatacagaaatgcagcacaatggagcaaatgatggaaaggcaatccaaaatttccaagcaaaatctataatttgattaactttcactaaatttgaactcatctggatgggacgaacgttgttgttgctccctcgctgctcgccaacgtcctgctgtgcatgtacgagcgtcagcaacatcatgcagtggagaatggacaagcattgccctcgtcacgctgtgggacgaccatggagtgatagagggatgttccaaacaacttaggaatgtgttccaactaacgttccatgttttaggaagaggtatacccctaacgttccatgtttttagaaaatggcatcccgtgttcctcgttctagttcctcaatccatcgatctgggaacttttgtgaccacggcaccaagacctgtccaaaggtgatagtccctatctttgttttacattatctttgtatatatgtgggaacctaccaaaattcatgaatattcatctgaatagccattttttttataaaattctataacacactacacaaaagtaactttgcctagtttgtcagtgagtaatcttaaactcagcgattctcatgcaccagcatcctcctgtttttttttctgtttatttgttaaaattagagtaacttccaatactttctgaaaaatacatcaattataattcaaaagcatgttagactataatatctttccacattttattttatcccttcttccaattaaaagacttgtaacttctttgcacctctgaaagtttactcgaatactcgttactcgttcctttattttccactcattctctcaatgacatgttggtccagggtccacatgtcagcaagacattaggggtaaagggatcacatggattttcaagtagcaaataaggaattgcaccaatgacactaacatttgtttaaaacatcatggtgtatgcctcgatacctacagtagaattccatatcccaacactgtttataacttgttgtgtcaaagatatgccaataaataagaatttatgtttatatagaatgcttacttgttatccttctttgttcggtgctccaagtacttctttagaatatcatcgacagtgggggatcgaggtagcttcacaagctgcagaacaaggaaattggctcaggaaagaagctggtgagaatgataaacagttaactttggcatactgataaagtgataactgaggacaaactcatcgtatttgtagttttataacaagtaccttttcctgtcaggaattagtgcaacataatgacttgaaacattcaagtctgtctagttgttagtaattcttcttgaaatagtaacctttttggggaaccttaattcttacaattttccatactacacaattcttacatgagaaatgaacatgacaacatgttggcatcagtcaatcatgttcaaaaaggtgcagaaaatccagctccacagatacacgaaatatacaaaatatacaggatatatctaggtaagtttgagtggcatatatcaaggttgtttgtctaacagtaaggtggtatatgtcaaaatttagctgcggaatgtacaatgaacaatatatccactggtcaagattgctagttttttttttctgaaggaaataaatattgctagttttcattctcttattagttcctatttgatacaaatatgcttctcttaagtacctgttgtttccatgccaattcagagacaatattcaattataattgaacaatgaggagtgtgctttggacataaataattcaaagacggctcagagaaagaattgaataccttacccagctgcgtgacaaactcccaatcatcaacaagttgtttttttagtgttgaaggaaaatgtgacatgaagagactctcagatgattttctttctttctcctggatcaaacagggcagagttgtcactatgtttacaaatatgtcacaagaaaacttgatagataaaatgttctaccatatgattgccaaatatagctgaaagcttcaaaatgtaaaatttatcagtctgcaaataggtaggtcacgaattctcttcgcacaatgtaaaacattagtttatagttccagtttaaatttaacatgtgttctaaatttatccatactacacaattcttacagttagattatttttgctggtaaccaaacatcatttagtccagaaattggattgttgtgtaaagaactaaacgaagcactgaagcaacatgatttcctattcatcattacaatttagaatgttgagaaaataaaattgtcatcatcatacaacaaaaggtccacgtcgaccatagaatgttcccattttccacatgtatgctgcaaaatgagcataattgccaaaccatgtagtactagaaaataaaaagaaaactaataaaaaagtattattagttcaaaggagcagaaatatgcataatatcagtagtttagaaacgatatctcaaaaggcaaattgcagtattataattgatagaaaatgaaattcatggaaatcaaatacttcacaataaaacatatttgaaagtgagaggcacctcagtcccaccaggctgacttttgcgtttcttccccttgactgcagttttaacatcgcagagatcaaatgtaataagtatcatacaaatcagaagaaccatgaaggcatgaaccaccagagacaatgatacaagaactttgaaaaatgtataagtgaacttaccaataatcttggtgtcctctttatcagtttttgcatctgctgaatgcaattaccataggtaagtaagatatatttaattaaaaaagtaagacattaagtggaaacccatccttaggtggaagcatgggaaaaattttggtataaccactataacagcatggtttattccattcccaatgtagcaaatagagtggtagcacccctttaaaaattcaatgtgccagaaagaaaaataaatgttgcaaataggaacttctatcttttctttccctttggtttaccattggtcatcatttcttatttctagaagtacaaataaaattacagttcaaattcaataaacagatagtttaacaattgaaaagaacatatacaatgttctaagagttttcatgctgaattggtatcaaagccatggcaattttcatgattggactgagagatagtttccaccataaaacagaaatatgatcatgaattcataaccataccaatatgaaaaagtatgaacgggaaatttcagaatgtcctatatgcgtagtaccaacacccataacagtaatctaccacgtactgtacactaactatcacaaaattactccaagattggttcacaactccaaactttggaagaaatatctcccagggtgaagtttgagcttaatccgtcaatgtaaatgatcacagcattcagttataagttataaccatcccatattcacaatctctttgccatttggcatttctactcttttaactacagattaagcatttccaagatgattgattctattagcaaaatacaaaatttataatagaaacataacactcacagctatagaacatagtaaaaacgaccatttggcaaaatagttcctagaaaggaagctcccagtggaatagtctagacatgatccaacagcacaaacattgatttaacacacagatagcttgtcacggatagaagtaaaaactatcgacccagtaaaaaagcatgcgtaatcaattccaatggaaacaatacggagaagagggaggaataagctaaccattagaaccttttggcttatgctgcgctgaccgtccagattttacacttttgtcaactgcttggctcttttcaagctcttgttgtttgcggatattttcgtcggtcaatttcagtaagcgatcatttgtgacccattcatcccagctgtactcattgaaaataaacacaataagaagactgtttacttggattaggagagcagaaagacaactaaatagcctcagtgcaatgatagaaacaagcccctcaataggattcacgctgtactcattgaaaataaacataataagaaggccatttacttggattaggagagcagaaagacaactaaatagcatcagcgcaatgatagaaacaagcccctaaacaggattcatgaaaatattaagaaaaaaaattgcaacgtaagggcaaagatgtgagactacccaaacatggtgttagacaacaatatggccctgccagaaaaataaaaagacactagaacatgcataaggtaatccatatccagctcaaggtccaaaatccaacttagacacttttaaactgtcaaaggcctcagtgaaatttttcatccggcacaagtattaaacaaatttgtgttgccatcacttcaattcacacatggaaaatggattggtcataattaaaaatatgtcaagtcatctgggctccaggcactcactcaggtcctaaatcaaagtcaacaaaacaggcataggatcacttccccaactgagacataacagatcaagttctagagatgatttcatcaacataatcattcaatcatcatatgtttcacaaacgaatctaatggtttcatttacaagtgaatctataaatagcatttgatatattggtggtcaaaactataaaagtttgattcgacggtttcaaaaacatcatatatttccattacacaacaaagagacacagatgtagcccaaagtctgttctgaattctatggctttgacatgatgctatgctgtagttctgtattaatcagattgaggccagtgcagattcatgagaagatttgcatactttcacatatctcatggtactacatgtaaaaataatgtcaattgcttgatagaataaaacatcaaatgcatcatacaggtacaggtacagatcttccttgtatggttagaaaaatattcacatcaacataaagaactggaaagcattggtaataagttatcagctataggtaagcatggaagacttatcgatcatccatggtatgcacttgcctcttactccaaccctagaaaagaaaagaggaagattaaagcaagacaaagaggggggaggaggtgccaaatatattatacaggtaacgtggatatcgtaagggaacacccaaagttaatgcatcatttttaagcacttgtcatggtgtacaatggcgacggagacttacaagataatgcacgtgataccgccactcatcctccttgttttcggacttttgaaccttgagaaatccagaagacaaaatctattggggaatgcaattaacaagcgaaagaaggctaggaaattcaagtatgggagcggagcaactatggaggccatttgcagagaagcaaaattaaatgaacgaaatccggaggggaggggaggggaggggactagaaccctaggttggattggagtggaatgggagataggggcggaccttggcctcgtagaggagggggccgtggtaggcgagcactctctcgccctccttgaaggacggcgatgtctcgtcgtgcttgtccttgccaccgccgcttctggtgttggtgttggtgttggagctcccccccatgccaaatcacccaatcttctttcttgtagccggcggcggcggacggcggacggcggacggcggtgggcaaagaggcgtgctaatggcggcgcggcggggcggagagagagactatgccggggcggttttgaacgttggaagccaagcagtaggggctctttgtggatcggaactgccgatttctgctttactaaaaagaaagtcgcaacgggaagaaaagatatttacatcgaaatatttggctatggttggatttaatctttagtaaattagtcatcattaataacactttttcaaaatttgttggaatttctagagtttaattgtcaattttgattatataaacatcattcatttcagtatttatttaaataaaaatcatcattcctctttgggccattttcagcccattcttccttagcccgcaaccgagtcggcctactttcctctcttctcctccccttcgcctcagcccgcaagcaagcgtccagcccagcaagcaaactaaagtctaatcagcctctccaagtactactctcactatcatgtgggccctaactgaaagtataacctaagcgtagtgttggacccgacagacagcacgtggcccagcaatgatacgacccgacgatggagaccagctcgatatgggatcgatgtgagcatctgagtcgtcgttcgttttgatggatggctcagctcagatcggttccaaatcaatcaaaaccacatgtgccaaaaaaaaccctgaccctatttcattttttccctccctttcctaccgtcggccgcctctccccctctgtcgctctctctccatcgcttcccctcccccaccggcagcgccgctccttctccccctctcctcccgtgtcgcaggcacggcacggcgacggtgagagtacgacgcgatgcagcaatggtgggtacggcacggagacggcgaagacgacagcgacggtcgtcccacctcctctccctcttcccgtaggcctcgacgccaagggggagggtacagcggccataggcgatgacaacagtgatgccgcttcccggctaagggctggatgcaccccgacggctcacatcggtggcttaatgctccatgaatccggtatgtgatccaaattaaaattatttgccacttatatagacagatcaccctatataaatatatgtatcggctaggttggattgaaatcaatccggaggggaggggaggggactagaaccctagttggattggagtggaatgggagataggggtggaccttggcctcgtagaggagggggccgtggtaggcgagcactctctcgccctccttgaaggacggcgatgtctcatcgtccttgtccttgccaccgccgctgctgttgttggcgttggtgttggagctccccatatgccaaatcacccaatcttctttcttgtagctggcggcagcggacagtggacggcggccggcggtgggtaaagaggcgtgctaatggcggcacggtggggcggagagggagactatgccggggcggttttgaacgttggaagtagtaggggctctttgtggatcggaactgccaatttctgctttactaaaaataagtcgcaatgggaagaaaagatatttacatcgaaatattcggatatggttggatttaatttttattaaattaattaatcatgattaataacactctttcaaaatttgttggaatttctagagtttcattgtcaattttgataatataaacatcatttcagcatttatttaaataaaaaggaataagttcactttgggtcactctatttgtcgcccagtccgattttcgacccatgaccacaaaaacgggtatgacccatcccccaacttacaaaaaccgggcaaacgtggtccctcggtggttttaaaggtggttttggctgacgtggcgcatacgtgacatgtttgactaggtctccatcccacgtgacattgacgtggcgcttacgtggcaattatacgtaacatcctcaaattttaaactaaattttgactgcatcatcctggcttttgattaaattagtgtgctttaaaaatctatttgactcttcaattggttcaagtattactttcttagagccctactaatttaccctaattattccctttattccaaaccttagtgaatttgagaaaattctctcaaatttcaaaccatagattatttccttagtttatcctaatattagtgaggatttgctatacttcaaatcctagtgaaactctttcaaattcatagattaaattcattcttttctagggaaatattcaaaaattcctgaaaacactgttcattgcactcaaggtgctcgacaaaatgcccagcccagctagagcagcccaatcaccacccaatcttgtgcaaagtctagaattgatcctaggggaccacatcccactcaaaaaaccacggtttagttggccttctcctcccccttgcgcgcgccgtcctggcgtctgactttgccgcgcgccgagccgccgcgcgtcggtctccggatcgatcgcgcgtgtccgaccgccttggcgtgccgctagccgttcgacgcccttagaccaccaccgctgcaccaatcacgacgacaacgaagacagaacgaccaccgccgcaagaaatcaccgctcgacgccgtgcgcacccgtccaaagccgccgccgagcacgatttcgcttctaccccgggtgaatcgcaccaattcttgccgcacagttggattaaagttagacggtggtttcccctctcacaattcaaaccattcacccccaagtcggctgttttcaccctcgccgccgctgcgcgtcgcgcccggattggcgctaacacatcgccagccgatttcgcacgcggtcaagccaatccttcgccggtaagtattcaaacatggcctcccgccactcaaattgatcttgcccgccctctcacagcctctgccgccctagccatatccaaagctcgagctcatccatggcgatgacggtgcccgagctcatccattcctcccagccctataaataggaccccaatcccttccttgtccatcatcgatcatcaacaaccatcaaccaccatcaccccacaaccccaaagctctgcttcactaatccatcccatcaaccaccatcacccgtcggtcgaacaccttgtacgcgatcgactccacacctctccctccatcctccgccctaaatatcccttagaacaccttatatcaactatgttctagcatagtagaccctaaccaaagtcctgcgtcaagttctacctcgtcgcgccaagccgagcaccgccgcccccacgctgctctgttcttcgccgccgcgaggtttttccggccgcaatccttcatctcgacataactcagtgagttcttccgtttcaaccatctacatactacctagattccattttagcaatccctttgcactatcatgccaccctctgagctgccgacgtgagcacggccgccgcctatggcggcgctcgtcagcaactattctccgcaccttgccaaaggtcggcaagctgccggaatccctccaaacacctcatagatgctctagaacccctcccctagccatgtctaactcatattacttcgatcaccaacacggcctaaccgtgccaccgccgccctagccgccaacccatccacatatcaaattaatccctccgccgccgctcgccgtcgccggagatccctagctccctcccctcctcggccgcaaccactttctccctctagcgccgccgtaatcccaaaccctagcgccgccggcccgatttggggaacggccgaaggtagaagaagggaagagagagagactgacaggtgggacccgcacacagtaacatttcacttttatttgattttcaaactttaaaagcccatatattttaaaatatagatccaattccagtgaaacttggaccaatattcttctaaaatcattctctatcctttgagcctctttttgctatttttgcattttattttattttctctatttttcatatttttggattttatttgaattccttttaaatttgaattttatatatgtctaaccctaggtcttgaggattcttctgactcaatagataatatcaatcaatctcaggacatcgagcaaggcaagttaccatatacctgttgatcatttaagcttatattttacaaattatttatttatagccttctattcaatactctattttatatgcacaattcaaccaacaattcaaccatagaaacccagataatttagtattgcttactttgcttacaatctggttaaaatatcttatacttagattgggacagtacgtaagatttggttgattttcgggtggctagtactgtctcgatcgatataagttttaccaggtacttatgtcgaatgaacgggtacgaccacagtttctagaatggggacagacctagttattatattaattagcaatatggcacctctgtatagtggttcttatttttaagtcctcacgtaggaggcaactatagccgcgaagggcaactttaaccattaccatgtacaggtaaatggtttgtgatactcgagtatgaactatatggtatatttctaaaccttgatcgagatgacgtgttgtcatacgatcagttccccttaaatatctcgggaacgccagaactcctcttgctgctgttaacaatacgttcagagcatatgaggatataagttcatggaacaggtgccataattgttaatgacttaatgctgggccatgactaaagcgtacatctgctgcagtagaatatctttgaaactattcgaatagccgtactcatggagttgagtaccgggactcatatgctaccctggttagaaatctaaagtttataagttttacaaattcttgctataactcttccaaattgtttattactactttttgcaaagaaccctactatatgtcaatgcataacatatttccatgataacttgctgagtattgtaaatactcacccttgctcttataaccccttcttcagatctgggtcaagaggaggacccttatgactattactacgatgactccgataacttagagaatccctaaaggttatacctcactagtcagaatgtatagaaacttccgctgtgtattaaatagttaggtgagtacctattattgtaaaacccttagtattgtaaaactttaaggtatgcaatgaagaaccagttatattgtatgtatcaatatctactgatccagggattgatacattaattctagtcggatccaagttattagttttgggactcgacaggactggtatcagagcatatgttttgactataggacaaaccctaaggattactaactaagttaagtttgaacttatttcaagcttatctttttaaggggggtagatttaatccacaagcatgcattataatgacatttgtatatttcaagacaatggcagaagagcatgagcaagaacttgtagaaactgcgattactatccatgataatgactgcactgatcaactaatcaacttgatgactaaactgaagataaatgagaagccggaattctattcacatgcctatcaacggggagaacgttgggaatattatatgaccgtgaagatcaatcctccacgaggtgaacgtgatatgtattacttccaaacacatcataggtggaataccatgcgagctgcactatatgatgtgtccagggaggcttttctacgtcttaatcatatctaccgagacaggttgcaacactctcgctattcttatcatcctatgcgagagccaggcgaagattattgtaccctccagaatgtggattatcatgaacaaccagtgaaagcaactatgtctatctggatggaagccgcggatgacatgtatgaagaagctttggaacatatggatgtacaacataaacgtttggaagaagctgaacgcagagaagctgttctcaaacacaaatatcgtatacttcatgaattatatgaggaaagagaaaaacaaaattctatcctcaatatttgtgttgtaggagcagccccacttgcgattgcggtccttgcggatcctcgactatggccaaccttggtttgagcaatccgtgcggagcgtgtacgtgtcactgcacctgcacttgtagctgccgacgagattggccttgcgctcgcgcatttgctctgggattccacgcttggtggttgaggcgcttcctcaatggcagtaagcagcgacgtgtatggcgagatggcgggtggcggcggcacagagagtggcatgtggtggcgggctggcggtagagagtgccggcctgaccgcctgagttcctggcagtggcagcttgtcacgcggtggcggcgctgatggcgatgggggttggtggcggtggcttggcgcggtggaggcgtggagctcgcacggcggcggcggcttggcgcggtgtggagagctgcgactgcgagcccatgatgcgccgccgatgcgagatgcggatgccgagagtgccgagccgccgatgcgatgcgagagtgccgagacggcggcggacagggagtcggccagtcagggactcgcttctccctagggtgaggtgaaataggatttttttgatgggtctattaggccaaatgggccatatgtatgtgtgctgttggctgtggacctgacttggcctggtaaccccttagctcgttaaggctcgcgagcagctaacgagccaaaccaagcctgtcacgagccgagcgagctaatgagccacgagattcctgtccgcccctaaatatggatacaatccgagtagtcgttatcgtttccatataaaactctacttgtccttccttacgcggaactccttctatatacgatgtatgattccgtataagacttggtatatggtgggccccggcgagcttaatcgattaatattgggtatgtggtatccataactatgacacaaacttctataaggaaatcaatctataacaatatatcaaatagagatcaattaccaggtttgacaatctagccgatactgatctagacttatatatttatacaggggagggagaaatgaagtagggttagggtttttttttggccccggtgattttgattgatttggaaccgatctgagtcgtccatcaaaacaaatggctcagatgctcacatcgatcccgcatcgagccggcctctatcgtcgggccgcatcactgctgggccgcgcacgcctgatgggccacggccgttgggtctaacacaaggttaggttagatttttggttggggcccacatgacagtgagatgagtacttggagaggctaattagactttagtttccttgcttgcgggctgaggcggaggggaggagaagagaggaaagtaggccgactcggtagcgggctaaagaagaaaattggctgaaaatgacccaaagaggaatgaggatttttatttggaataagttcactttgggtccctctatttgtcgcccagtccgattttcgtccctcgatcacaaaaccgggtatgacccgtcccccaacttacgaaaaccgggcaaacgagatcccttggtggttttgaaggcagttttgtctgacgtggcgcctacgtggcttgtttgactagttctccgtcccacgtggcgctgacgtggcgctgacatggcaatcatatctcggaaaaataattaaactaattctctctggctctccccatctctcagctccctcctctcgccgggtggcgtcaagcacagcgggcggcggtagatagcacggcggcggcgtggcgacggacagagcatggccagcggcgggcggcgcggcgacggacagcgcattgccagcggcgggtgacggcgcgcgaggcgcgtggggcagcggcggccatctctctcttgcaccgctcgcctagccgtccgccgcccttctccccgatggccgccggcgggagaagagggagcggcgcgcggcagcgttggtggcgagagaggagggagcggcgcctgtgggagaggagggagcgacgcacgcgcgcttgccggtaggccagggagctcacctagccgtcgcagcggaggagggagaagaagccgagggcggaggccgggtcgggggaggaggcgagggtgtggagcgtggtggtgagcatgaaggaattgggggcacaggggagggaggcgaggaggcagagcacggcgtcgagaggggagagcgcggcgtaggcggcttgtggaacagtggcgggaggacgacgagcgtggtgtagaggcgctcggcgatgccggtggtcggtggcgacacacggatggtggcatcgatggcgtcttccagggcgccgccgctctgctcgccttcacgcggaccggcggcgctccggtcggggggtggtgcaagagagagatggccgccgccgccgccggagctcgcctgctccgccacccacccgcgccatcctctgctggggaaggggagagaggggaaagggaagaagggagagaagggagagggaagaagagaggagtgagactgacatgtgggataggggccccaccattttaaatttatttttttttgcatgcggggcaacgctttttattatttttctgagatataatgtcgggtcccaaaaactaacaacttggatccgactggaattgatgtatcaatccctggatcagtagatattgatacattcaatatcactggttcttcattgcataggttaaggttttacaatactaagggt

SEQ ID NO: 65037 - DNA, 13409 bp, Oryza sativa
tggagaagaagtcttaggtggagtcctggcttataccccagttgagcgcctgtgaagatggagccgtaggcccgctttttcgctgctgtttatttttgattgtcaggccttaagtgcctttgtaataatgtaaatattatcgatataataaagatgtgtcttttatatcatgtttgtgtagtgtaccccggcttttcctgggacggggattaatacactagctttcgggaaaatgtatttttctcggtcgcgacaggagaggtcctggtacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgaaaagccaaggaagcgggcgaggtcacgaagctgagcgacgtggtgaccctcaccaaaaccgtgggaactgaagctggcgttcactgccatctacaattttgaaggagggagaaaagatcagtaaccattttagaaacaaactattgaaaataaagaaaccaaaagaagccttagcttttcgcaagtagttttgaacttagtatccttagggtcgtcctaaatgtcgggtttcgccctagggccaagcctgtgctctgataccatctcttgtcacgccccgaactagtcccgaccggaactagcccgtgacgctccaaattaacctgttaatcgataacagtcccaggaaacagtgctggtatcacaggaagacagaatatcacagcaacagaggtctctttattatagagtaggagtacagtcatgttgggctgcggacagatcccgagcttacaactgcattacaaaagggaagcggaagccaagacttggaccaaacatcacaggcgcgacttgggaactaggctgaaaccctaaaactcatcgtagccggcttgctcctggaagaactcctcgtcagcgggatccgcttcatcttcttcagcaactgggggggattatttatatagagcaagggtgagtacgggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtttttcgaattgaaatcaaggttggcacccggccaacaactttcaaacggccacccgggcctagctgatcccatcagctgcagattttccaaacatcaatcccctttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacctggtacgttccccggtccgcggttttggaaattcatttagttcacaagcaccaacccaggtgtcgggttttccaagtcttttgtaaaacccaagttttacccaagaagttactcagattttaagtttgaaggcgaccgttgatactagtgcagagtgcacgatttccgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgccttgctcgagatcttgagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaacccttttggaaaaagaaaaggaagagggaggggaagtagacttccctcgggcggctagggcgcggcccgagagaaaaggggcggctcggccgagctaaatgggccggtcggcccaagaaggcggcccagagcgcgcgcgcgggaggggaggagagagggagccggtggactgggctcacctcgcgtggtcccgagtgggacccgcttgtcggtgacacggttcaccgtgcggaacgcgcacgcggcgcgcgccagggtttgggggagggacgcggtgcacgcgcgcggttcgcggaggacgcggatgcggcgggcccacgcgcagcctcacagctcgcggtggaccgcgcgcgcgagggaggggaaacggagggagcggctggccgggtcagctgatccggtcacggtcgaggtggcgccgacgtggcgcctacgtggcagccacgcgggccggcgggaggttgaagaagacgccggccggaacggacggcggacggcggtggcaagcggcgaagcgaaacacggcgatctaggcgaaagcgagcacaccgggaagttgcgcgggacgaggggagtcgagccaactactcggatttgccgggggatgctcgacggcggcggattgcggcggcggcaaccggcggcggaagaagggggaaacagcgacgaggtcacgaggggccgattcccggcggcgagagcatctacgcggctacgggaatccgatgctagcgttggattgggtggaaacgcatcgagggaggccagcgacgagaggcgcttccgagctcgggcggcgacggcggcgagcacacggcgagcgacggcagcagtcggggcggcgccggctagctacggggaggctactcgtgctactacctgagtctaaggggaggagatggaacgaggagggagaacggggagatgcgctaccgtgcgggcggggcgcagtgacgatgggccgatggcacgggagtgatctctccggcctcgggccggggaagaggaagaagagggcacgcccggagtccccttccgcgtccttgctcgtgccggctccttcgacacgcgcaacgacgaacggcgacggcgaacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaagggggaaaaggagggaaagaaagggggcttgccccttgcctctttgggaaaaggaggcggggagcgggggcgacgcggcagagggaggaggggctctgcctccgtcccttggcagcttgcgcgcggtgtggtggggccgagtcgatgacgacggcgatgacggcggggcggtgtggagcggagcggcgacacggacggcaggcgcagacaggcgcggcagaggctgacggcggcggcgaccaggcggtcagccactacggcacgcgcgcgcgggaagcaacgggcggcgcggcgatttgagcggcacggctcgggcacgcgtgctgactcgcggcgcagacggcgcaggcgtggcacgggcggcgaccgcgcgggcgcgcgcatgcgaacaacggcgcgcgggaagcggcagcgagggagcgaagagggagggctcggctcggcgcggctcacgcgcacgtgcgcgcggcgcgcgggcagagcggagaagagggagagagagagcgagagagagagagagagagagagagagagagagagatagccgggggggaggggaagatgggccgagagggattcggcccatcgaacccgggggaggcaaaatagacttttgcggagggatttgatttgggaaggatttggattcgggattgaacttgacaatagatcggggattgagatctgagatggcacggacactagacaacaagcaaagaaatggatttcgcaaatagggtttttaagagataatttttccgctaggcgccacgacggaacgggcgctacagtgggtcaaattgatcagctacaatccatgtcacttcatagcttattagaaccttctcctagtactggaccgcccacagtggccatcatccaccagtgcataagcagtcgatccaatcactgatgtactccaggctaggcatgagccaattaatcgttgttcttccaatttggtaactacatgtccccaactccaaacccgtgattggtaatcttcattgcttgttgcttcattgattggtaaccttcatcgtgctagtaagtataccagttgtcaccgccattctgtgtgtgccgacacggtgccgttcacgtggccacatctttgccaatatgtcctgtggtatgtgaagtggtgcttgcctgcccgattctcttcagtagcacaatataaacttagtaatggtatgtgttgcgtttggttatctttatcgaacatctccaccaatatttattttatagccacgtctgtcaatgtgcactaagtataccaccacacatatcttgggcttttgaaagctgtatgcagagttgcagatatattttttgagtaaattagacacatgaaaagcatatatggttctaaatttatcaaatggttcagaaatgtgactgtgcataagcataaaagaataaaccatctcagagacagacatttttctcaagttcttttcaggtgcttttacacgggaagtcactctgccaaacttaccaatcgtcagtgccatctaccatgcatgctcctgtcaactgatgactcctttcagctgtagcatgagtaccaaggaggcaaggagacgttaaaatcaagcacgaagacatgtacaggggtaaatgcatgcatatgttcagatgcattgtactgatagacccatctagctaccattagcttttgcctttcgatggttgtgtcacacccttttttatcttccttttttttttgcctgtacttgggacgcacgaggagaaaaaagctgggttcgactagactatcacgcgtacaactgaactactccaataacatttgagctttcacaatgttgtcaaacatatgtaactacatgctttctcttcttataagatatatgctctcttgtatgatcctaattaagtgatttgccactctcacctaaggattggtatcctgtcccaaatccaaaagatctgcactttgggtattttggaactcaactgagtgactagcaaatcctggattgagtcctaattaaaatgcaaaccaagacataccttgaggcgaatcagatcgatgacaggccagggatatattacacgaatccgagaattgcaacatcggtcagatatggtgaggaccagacaggccgtgcaaatcccaaacagagaattaaaaacttcaaaccgatcatcatgttgcacaaacaaacaaacagagccaggcatcagagtgcgtcaccattgccgactgatcaaaaagctctctctctctctctttctcactctctctcgttagtcgtcacagctaagtagtagagtataaccgatggaggggtatggataggtgcgcacaacggaagtggcggatgacctgcgctccgattcagattataattagttaatttcaggcgaggagaaagatcgaatggcaacttggctttatcggcgatgcttctgatagctcctctttacgagtgatcgtacacatcgagcagcattcgatcagtgagataatcgactcgatcgggagctaatgacgatgctatcatgtcaatcggtcgctttaatcagttggctgtccaatcatcagtgacattcatgtactgctgccatgcatcaaggcagggtcgatctggcaaatgctccgggggtctaatcatgtgctctggcgtaagtaagagaagcagagggagacaagaggctaaggatgtctaagctacgcgtgatgcgccacgcactgacgcactcatgcatttgggggtacagatgccgattatgtttatctgatgactaagagcaagtttaatagtatagccaactactagctccaattcatctatagccaatctaatagcttattcatacaatagttacatactacactattaatacttgatcccacctatcatacacacattgtgtcttagagttcgtgctacagctggctataaatctgtagctcgctgtttttccctctcctcatttatcttcttaaaatatgtttgtagctggcttatagcctgttattgtacctgctctaatagcagattgatttcgtgattctggaatcttggatcggttcgtatcatccacgacacttagaaaagcacatccaaatccactgcttaattactggttagtaagagggtgatgaacaacttggcgatcgtggtgaaaaataacgaactcaatttaccttggcggccgagctcggaggagaagccagtgatggtgatgaacagcgagcagcagaactactccgccggcgacgatgcgcctggacgggagcggcgccagcgtcagaaacagatccaacaatccagcccatcaaagaccaattagagcccatctcactctccttgatttacgaggcagtgcggcccgtgcagtttttacaagtcagttatactagccacttagtcatgcgttgcacgactttagatacctgtataaaaagttatatatttgggttataataagcaattatacttttagtttcaaattttgcgaaaggacttgataagacttgagcatacaaccggggaatgaaactgtgagctgctgttgcaagatttaaaatgagggcttgtgcttagcagttctacgaatagacggagaatttaagctctgcttcatcaagtgaaagagaacaactaccacgtcaagaactcaactgaatcaactaaacaactcatgtcaggaatttaaggatactgaacatgtaccatgccttaatgccttgttagccggacagaattagaccaccacagactgcgcaaagagggcataatctggtttacacacaccactataaaacctaatcaaataaaccttttccaaatatggcaacacaatctatttaacatattatcatatatttgtttaaaacagcgaaaagatcagaataaagttgaagcacaacctagactccaaagagttattgagaaccacaattttccctagctattaatcagcttggctgctcaaggcttgctatcatatccaatatatcctatacccttcgccttctttcagtaatggactaatttgatcagcaatatctccaggaatctgagcagaaagaagaaggcatttgagcagaccaaatatcttcaggaatctgagcagctccagcatgctgcataattatttttttatagaccaaatatatataatagatggatagcagtagcttgcttcatatagccgaaatattaatgtgttgttggaacaaaatattttaacatcaaattatttttatgtattgttcatcattctatttaatatttgttctaggccttttgggttgcacaacagttagggggtgaactgtaagagagtactaaacagcagtatatgatagcaatatactacgtatgatgttaactgatcaactcaatctttcttgggtcattataattggtggttccttttgtattctaccaaattctgatatgctattgtttgaattacataaatatgtctgctccatatgatcagggtaatgatacgaaatttccaatttctattgttatgcatgttttgaagttgacagcatttcggaagtaaatttcaagctttagtcagcaagctgtgattatttatatagtatttcccaaaaaaaaaggttaatgttgagaaatgtttcagcatcctgaacagttaagtgctgttgaactgcacgatcagattcagtagtttatccacataatcattattttttattgagcaaatggataggaacaaaaaaaaagtcatatgtattacctttccttgaaacttttcatcgatctactgaccagaacctatgaaatgtaaagactggagactgccaagtatgaaaaagttattacctcagctttcataggacagaatcaccattgtgaacagcctaaatcttttcattgtggaacagccgctacacctacagcctagtaaatctgttcaatctgcacaaatatctctatccgacaataactaatatcaacacactatcctgcgtaaaaatttgtaaaatctgtaacatagtatggctgtatgattttgctatgtgcgtggagcatgaactgaaagggcaagaaggcattgcagtagaatctgtcctatacccaatgaagaccatgcaagggcagtgtgtcaaagttggcctcgtcctccaagaagccttgaggtcagcagcacgatgtcatgcatcctagaggctagagtacgatgctggtggtgccgctggacaccgtaatggccttgcatcctcatccttgggttcctgctggtaaccaggcagccctcgctcttgctggtggccattcgtcgagcaggagcggccagacgaagcccactggacaccagcggcagttcgcagcagtgcacgctcgatccggcgatgacgctctcataggaggacctagagtgaacgatccgacgcgacagggcctgatccggcgagacgcaaatgagtgggggatggacaggagggaggaggaggcaggggattaggagagactgaggccagggtaggagcttgtggggatgggaagaatggaagatgcggcggaggaggatgaagccgcggcggcagcttttctttttttcttttttttttaacgcgtggatgctgcctattcgcctacctctctcgactctgatcgaagactcctgaaatctcgtcttcaccttttgactaaagctatactgaggcctattcaaaatctaacggcatgggttcaatgtttgttgcatccaacggctaatattattccgatgacatggcgctttgtggtggtgaaaaactttagtattttcactactttagatttccaatcactaacaaacagcgaaacagaggtctgattagagatggcaattggcaacatgtcccataacccgagatcccataggtttttatattattattacgagtcacatttttaattctgatatccatggatttattaatgagcaaaattccttacctgttgggttgtgtcacgccccgaactagtaccgaccggaactagcccgtgacgctccaaattaacctgttaatcgataccagtcccaggaaacagtgctggtatcacaggaagacagattatcacagcaacagaggtctctttattatagagtagaggtacagtcatgttgggctgcggacagaccccgagctcacaactgcattacaaaaggaaagcggaagccaggactaggaccaaacatcacaggcgcgacttgggaactaggccgaaaccctaaaactcatcgtagccggcttgctcctggaagaactcgtcatcagcaggatccgcttcatcttcttcagcaactgggggggattatttatatagagcaagggtgagtacgggagtactcagcaagccatgggaaataagtgtttaatgcaggcttcaaggaaaggctgttgtttttgcagttgattttatttgaactcttttctaaaaacaactaagtgagtgcttctcaaacgacacggatgagacagtgtgtctcgtctggtcggagtatgtgtaatgtatcagtctttagaattgattcaaggttggcacccggccaacagcttttcaaacggccacccgggccaacaactttcaaacggccacccgggcctagctgatcccatcagctgcagatttttcaatcatcgaacccctttctacaacagcaatttcacaagcagtagtcaaacaaaactacgctaggaatcacctcacatccgcccatgaccgtgggcacggctgttcaaacagtttgttaacctctgcagagggggtacactttacccacacgacattactaacccggatcacccagcccgtgggaatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcgggaaaccgtacacccggtaagttccccggtccgcggttttcgaaatttatttagttcgcaagcaccgacccaggtgtcgggttttccaagtcttttgtaaaacccaagttttacccaagttgttattcagattttaagtttgaaggcgtccgtcgatattcgcacagggtgcacgaatatcgagacgcaactagatggttacaaggggacatgatataacaattaacaaaggaaggatcaaatgcaataaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgaccctcgaaatcctcgcactgcgggtcttcggtctccgaaactacacgcgaaacgggacaactcaacaaacggcgaaaataaagctctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagagggagggaatatagacttttcctcggcggctagggcgcggcccgagagaaaaggggcggctcggccgagctaaatgggccggccggcccaaggcggcccaagcacgcgcgcgcgggaagggaggagagagagagccggtggaccgggctcaccacgcgtggtcccgggtgggacccgcttgtcggtgactcggttcaccgtgcggagcgagcacgcggcgcacgcgcgcggccggggctgggacgcggtgcacgcgcgcggttcgcggtggaatggatgcggcgggcccacgcgcagcctcacggctcgcggtggaacgcgcgcacgggaggggctgaccggggtcggcccgacccgatctcggccgagctggcgccgacgtggcgcctacgtggcgcctacgcgggctggcgggaggaagacgaaggcgccggccgcgaatggacggcgggcggcggcggtttctccgggacgccttgcgacgatgaggggcgacggggcgtacaccgggatgacgagggagaatgagagggagcgagccaacggcttggattcgccggagggtgtccgtcggcggcggattgcggcggcggcacccggcggagagaaaagggtgaaacggcgacgaggtcacgaggggccaattcccggcggtgagagcatctacgcggttacgggaatccgttgctagcgtcggattgggcggagctacgccgagcgaggtcggcgacgagcgggtgctacggagcacgggcggcgacggcggcgagcacatggcgagcggcggcaacggttggggcggcgccggctagctacggggaggctacacaagctactaccgaaaactaagggggggagatggagcgaggaggaagaacggagggaggcactaccgtgcgggcggggcgcagtgacgagaggccgacggcgcgggagtaatctctccggcctcgggccggggaagaggaggaagacgagcgcccggagtccccttccgcgtccacgaacgcaccggctctccctgcgcttggcgatgaacggcggaggcgagacagagctcggaaggctacggcaacggcgcggacgagaaacggggaggattgggggggagaagaggaagggagggcgcctgggcttacagggcggcaatgtcggtttggaaaccgactttgggcggtcaaggcgcgagctggcactcggcgctcgcggccaaatcggcgacagggcggagggaggatgacgccggcgggaggaaaaggggaaaaggagggagagaaagggggctcgccccttgcttctttgggaaaaggaggaggggagcaggggcgtcgcggcagagggaggaggggctctgcctccgtcccttggcggcttgcgctcggagtggcggggccgaggcgatgacgacggcgatgacggcggggcggtttggagcgaagcggcgacatgggcgacaggcgcgggcaggcgctgacgacggcggcgaccaggcggtcggccaccacggcacgcgcgcgcggcttgcaacgggagtcgcggcggattgagtggcgcggctcgggcacgcgcgctggctcgcggggccgagcggctgcgcagctgcaggcggcagggcagcgggaccgggtgacgcggacggcgcagacggcgcggcacgggcggcaaccacgcgggcgcgcgcaagaacaacggcgcgcgggggccggcttcgcgggtggggagctcgccagggatggggagaaggagagcgagggggagggggcgctcggcgcggcgctcgagcacgcgcgggcaaagcgaggggaagggagagggagagagagagagagagagagagagcgccgggagggagggggagatg

SEQ ID NO: 65038 - DNA, 11223 bp, Oryza sativa
cggcggaagacgggacttgaggggatgagtagaggacgactagggggtcctttatatagcatgggaggccgggatcgagcccacaacgacgggaaaaactcgggaaagtttagatcttcgccggaaaaagaaaaggttgaaccgcgaaattggaaaggatttccatataaacttttggggatttcttggggacaaggaagaggagattgagaggattccattcccgcaaccaattcggaaataagagcaacggagaggttggattttggaaggggatcggcggcaacaggcacggcacggctcggctctggctctggctctgtccaagctggaagatgaacagtagctcagggagagaaagtagacttcttgccgggcttttcttttctcagcctgattagaagagggagcaaaaccagactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatacttggacactcaaagtacttaaacaaattataattagaccatttaatgattaatttaatatgtaggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataacttctaataataatttattaaataatttataaatcctgaaacaaaaatcaggatgtgacaatctggatgggagaaagattgtgcgtgcctgatgacaaagagctaaaagatcttatactcactgaggctcatcagactcaatactccattcatccgggtagtaccaagatgtatcaagatctcaaagaaaaattttagtgagccagcatgaggagggaaatagctgaattcgtcgcgctctgcgatgtttgtcagctagttaaggcagaacatcagaggctcgtaggattgttacaacctcttcagatcccggaatggaaatgggaagaaattggaatggatttcataacaggtctgcccaggacatcatctggccacaattcaatctgggtagtcgtggatcgacttaccaaagttgctcatttcattccagtgcataccacttatacgggcaaaaggttggcagagctctatctctcgagaatcatgtgtctgcatggagtacccaaaaagatagatctgatcgagggagccaattcacttcaaatttctggcagaaattgcaagaggaattgggaacccggctgaacttcagcacaacctaccatccgcagaccgatggtcagaccgagcgggtcaatcaaatattggaggatatgttaaaggcttgtgcgcttgattttggtggagcatgggacaaaaacttgccgtatgtggagttctcctacaacaacagttaccaggctagtttgcaaatggcaccgttcgaagcgttgtatggccggaagtgccgcacacctctcttctgggatcaaaccggcgaacgtcaactgttcggaacagaagtgctaactgaagcagaggagaaagtcagaaccgtcagagaaaggctgagaattgcacagtctcgatagaaaagctacacagaaaaccgccgaagagagctcacttttgaagcaggggattacgtgtaccttcgtgttactccgctccggggagtacaccgtttccaatcgaaaggcaagttggcaccacgcttcgtaggaccatacaaaatcttggaacgaagaggagaagttgcttatcagctagaacttccatccaacatgatcggtatccatgacgtgttccacgtgtcccagttaaagaagtgtttgagggtacccgaagaacaagccgactcggagcacatcgatatccaagaagatctgacttatgtggagaagccagttcgcatccttgagaccagtgaaagaaggactagaaataaggtcaccaggttctgcagggttcagtggagccaccattcagaggaagaaacaacctgggaaagggaagatgagttgaaggccgcccatccgcacctcttcgccagctcttccgaatctcggggtcgagattccgtttaaggggggtaggtttgtcacaccctgaagttcttcttccaagcctaaattgaatttataaatcacctagagaaaataccggtgtcaaagcaagagaaaccctaataaattaatgcaaataataatcgaaattggcatgtgggatttttcttgagttctacatgtcgaaatatgctaacaagatttttagtggaattttcagagctctagaaataattttaaccaattaaaaatgagcacaagcattatttaatccctggaaattcttctcctttttctttttcttccttttccccctccttttccccaaatgggccgccggcccatttcctccccctcccgcgcctttgctgggccggccgaaggccacggcccagccgctcgcccgagcccccctccccctcggacgctgacaggtggggcccacctgtcaggcccatccctaacctccggccgcccgccgtccgcagccgccgcctcacaaccgcccgcgcccgccttccccgcgccacgtcggccacgcccgcgcgtgcgtccacccctcccgcacccctcaaacccctctcccgctcgcccgcgtccccgagacagccgggattcgaattttgaatcccgcctctctctccacctccacctccccacgtcggccggtgaaatcgggccactcccggtcgttcctgacctctccgcccctatataatccatccccgcatcctcctcctcatttttcctttttccgccggcctctcccgagctctccatcgctcccgcaccgtgcacccacccgccgctgcctctttcactactccggcaaagtgtgggatatcaactagttacatgtaatggctaatgaccttcttaagtggtagtacctcacatctgtcgaataccaggcaatatctttcttacacctgatggttcaaaaatatgcagtgctaatgatttatcaggctttgttttggatttaatataatgtactctacatacagaaagtctgcatatttataggcacttgagtgggggccttcttccgctagcatctacaagatttgatcgttcacgattaagatttccagatgtgtgtatgtcctagttgtttagtaattattttatggtggctagctagcatcatatgttcaagtttgcagttaaaaagttcagtttgtaccattgaactgaagatgttggctcaggaaaggtgttcttttgctgtatgatgatgcttgtggtgcatttctgttcttctttttataatgcagtgcaaccctttattattactcccttctgttaattgttattctgacatgactagtctggtttggctacctatgcaatcatggagtcttaaacattattctgttaaaggaagtagaagtagcttcattccacattcatcccaatcgcaatggtttggttgtttgcaaattaatgagatgcctccagtagtcatgctattaataagtaatctccatttattttcttttattgtcctcagcagcttcattctactagtatgcatgtcagaaatgccatttatgtcttacgggtatacaatggtatgctgacgaattctctttatccagcttgtagatatatcaatgcgttatcttaaaatctgattcaaaaagccatttcaaattaatcagatactgaccaaatcaaacaaccgattctgatcaaactaaacaaccagattttgattctagatgatttactgccacctgatgtcttaagattaccggcgttgttccaaatatcagaaaataccaaccatagtccatagaaactcagaatagccttaacctcaagctctgtagtaggcactaggcagtaaaacatcgcccctcgccaccatcaccatggccacggccatgagagaagaaggggagagggggtaatgacatttgggtcccaccactcactgacatgtgtgggcccaatatatttgtttttattttttaccttaccagattcccactgacatgtgcatcctattaggggttttgtttttaaattttgttggtatagtgccacttaagccgccacatcggacgaatacaagtcaataagcgccatgttagtcgaaaccgttggtaattcaattgagggacttgatttacacccgtattagaagttgttacccttcatacctagttttacagttgaggaaattaaactcaacttatagtcgaggaacatccaatggacctttttcctttaccaagccaatctgtgcttgcaaacatgcatgcccaacttgagaagccaacgccgacagcggacccctcttgctccaccctctccaacctccgccgtgacctctcccggccggtcgctgtcgccgggcctcactccctcccttgtgcgcgtatgggaaggggaagaggagccaaggatgggaggaatagagaagaagagaggaggagaaaagcaagaggtagggggaagaaagcaagatagaaggggagatagagaagagagaggatgagtgaaggaggtgggtccattgacatgtgggtcacactattttcttattttattgtttgactaacatattggcctatgtattttgttttttaaaaaaaatgttaaatattacttcatgtgccacattaatgccacgttaaatgaagacggagtcaacttagccacgtagatgccacgccggctgaaaccactgtgcaatctccaaacttggaatctatattgcaccgattttgaccattgagagacgtattgcagtttaagaacgaaaatcaaactagcggtcaagttaagggacctaaattgaacttattccttaaaaacgtgagttcctcaaagctgaacgggccggattccaaacaaggcccaacacgatttttttttcttttctctttttacacaaggagaagaaggccgggacccgggacgtatctttcatcgactcggttctctttccttttctacccccaccgaaaaaggaaaaacaaagaagaaaaaaagctatggcttcttcgtcgctgctccgatccgccggcggcgcgctccggcggtggatccctcggcgcctcttccccagcaccagctaccgggtttggttcgggaggagacaatctggctatgaacaggcgttcgcggagagcccgcggcggcgccatctcggctccgattgcggcggaagtaccgacgacaatcaggtataaatctcttcctcttcctcctctgggaaccctaattccctacggcctatgttctttttttcctcgaacatcacaaaaggattgcacatcaatatattagaagaaaataatatctgttacacaacgcaattagccagaccgacttatgctaagaaggaaaaaaacaaaagaccaaggaaagcaactggtttactaccactctaaacagcgggaaggggcagaacccactactctcctaacaaaaccccaaaattagtaatgacagctaacgaccatagatggccctctgagaggattgaccgtaggacctccgagaccaaagatacggcccatgttcggttaatcctcaagtgggggtgattggttggaggggattattccacacctaaaccaaacaaggccgacatgtgtgtgaattcatcattctagtgagttttgttatggggaatcagggccaggattaaacagatttagttttgtttgttccattcggatcaacttcgaattataagatgtgggtgagagtcaatcgatagcctaatgcgagcttatgagagtggtagcatacagcatactagcacggcctgattcacgaaaaggaaaaaaaaacaaaatgaaagcattgcctgtagttaaaaaaaattattcctgctgatggggagcaaaggttgtgatattcaccatacgccagattttagtgcaagctaatgttttgttccatctgtccagaaacttttctcaatggatggcttgatgaagcatgtacttttaagcaaacttgttgtagatccagacaaacttttcgtaaattctgaaaatgagtaattctaagaaaaacggcgtcactctaaatgtcctgaaaatgttatatgtatgtccatcgtcctgactagtctttttgtttttgaaaattctttttagataatgtcctggctagtcaattaaaatgcagaaattaatgtttccacaaatcctttgcacaaaaagaccttccactgtttgggtgtggaattatttaaactgcttatttagttcaaattcgtaaggatttgaatccaaatccccagtattcaaacatgccgttagtggataaaatatatcactccttgtacttcactttgctaatttaaattacataagaaaaaataatgggagtagtgggcactaccaaaggagggagatatcttgttgtggacaatttcaaccatttcttgcaaactatcatgttcaaaacttcaaaatgaaaatattcaccacaggtttttattgtctccaacagctgaaaagatttcacaaccaatgtcaacaagaaaaatcctaatcataaagtggtcttagcagaagaacttggcagccttatcatgctgatagtttaacagtgagccagtgattgacaaataaatcttactccctccgtttcatattataagactttctagcattgcctatatgcatatagatattaatgaatctatacacatatttgtctagattcattaacatctatatgaatgtgggcaatgctagaaagtcttataatatgaaacggaacggaagaagtaaaacagtatatgcgcaactaccttcaattgaacaaaatgatgtttgtcacagaaaataaaaagtacagtccgcacatgaaaatgccacacgaagatcgtgattaatattgtagcacacactgtcaaagcgaaaaattgaactcttagatccttatgctgcaactgtttctttacaacttttaacacattcttcatttgccttattcaaagtggcaaattttctagtaatcagtgttcagatataacttaatctggataacattccatctataaattgttttagggagaaaatgtggcttaacaattcaaatagtagattttactaatatagtggaataaataaaacatatgttgtgtttaatgattcagtgtcttgcattgcactattgcaagtgaatttccacatttgacatagttaaactatatctgacacagaagtcaaaacgtcaaatgcatttttttaccatgaacagtaacttgaatttaaactggtataccttcagaccttgttattttcattaatggaaataggaagcgcttaaaactaaccactaaatctatatatttacatggaaaatcttcctgacataggtagcatggcctgattataccaaaaaaaaaagaaagaaagaaagatagcatatgctgatattgtgtacaccagatgcaagttaatgtttttttattctatctgtccagaaacgttactcaatggatgaattgttgaaatgcaaaaggcaattagagaagaacaaggagggagcttttaggcccgctgacattccagaccatgaaagcaagaaagacgagctctatagaaagatgagatcgacttttgacaagctgtgccactgcttagatgagcaggaacatatacttcgagaaattgaagatcaagttgacaatgatgaaaagtgtgtagttcagttcattgttttggacacatgttttttgttcccttttcctaataatgcttctttttgtacatacaggtttgatcaagtcaaacaatatctggtggcgatccctagcttcgtttgtattggtcttattcttgataggatgcatatgtttggttgagagattgtgttatgacttttgacttttggctagttagtgtacccgaggtattgaccacgctatataggacttggttgtggacacagcaaatcagcaatatactctgtgatgtgatctgattgataaaggtgtaagtgggtaacccgtttattttgacttataggtgggttcatgggttagccacttatccttaatgattgacctcattgatgttagagagaccgctactacttgtatgatcgttttgaacgaaggaaataaggaagcgcaattcaaagggatcttatgattgcctcgtttcttttttcctttggaaagcagtgtcttgtgattttcgaatgctgatttccacttttctgccaagcataagtaatttttttggcaaaaaaaaaatcaaaaaaactgcaagttgatcaatgtctcaacaattgttcatgctcactgcatttcaatcgataacaagtgttaatctgtggttttcattttgccttgtggatcaattagtagttcctagaagggctccatactagggctcaccggctaccacactgtcgagaagtcagccgcggggtgtcctatacattgtaggagtagaatgttatccagtataagatgattttgtaattaattggcgtctagcaaaactaaattaaaataaagaaacaaacttaaaaaaattatccaaaacaacaaataaactgtccctgcagtcactgcatcatacctcatgtgggctgggcctgaaaacaaggtcaccgacggttttctcctgcgctgcggaggattcaggcgataagagcaagttacaattcatctatagccaatctaatagccaattcatacaataattgcttactatattattaatgtatggtcccacctgtcatacccacattgcgtcttagagtccgtgctacagttggctacagatgtgtagcccgttgctcttctctctcatcgtttatcttattaaaatatgtttatagctgattaatagcctgatattgtacctgctctagtgccgtagagcccttgaaaagaggaggggagaaggattcgccgggttgatttgaataactgctacatatcgggttcctgcacgacgctagcgctgcctcttctgctaaaagtagcacttacacacgattttttaaaatttgtttgctttaattaattttctaggtttagggttaggtctcgagactccaagaacagcttcgattcctcagtaggaggaggaggaggatggcttcgtcgtcttcgtcgtcgttgctccgatcagtcgcccgcgagctccggcggtcgatccctccgccgcgcccgcgcccggccatgtcggtgatggaccgactcgccccgcgtctcctcagcaccgagtcctctaaccacaagatgaacccctcctcctcctcctcgccgcttctggacaacttcttccgctccgatcgcgctaagaggatggataccagtaaggtataatcatctccttcttctccccctttgtttttcccaatagattgcaccgtagttaatttcccacgatttgtctcttgcaacaccaagtgtgtttcttcattcagtcttgggaggagctcccttatcagatgaaaaaaaagacaagtacatagaaaataaataagcgcatttggtcttctttaattaagatagaggcaaaagaaaaaaaaagaaagatcaattttgggggaaaaaattacttttaaagctcagctaatgtaatgcctaatgatatgtcaccttgttttaagtggtgcctcgacttatctcacatttgtctgatacatggcaaattcttctgaaaaagatattatgagtttatgtttatgacctacaggatttgatgatactaatccatgttttattctgtcttcctaggttcaattctcaaaggacgaccttaaggaatttgataggtatttggatgagaggacgaagcaagctgagaggaacttgttgctgtctctggacaagttctgtgatgcctgtgaaagacgggcttctctgcttcgagacatcaaagcgatgttagaggctagaaataaacggtctgcccaaaagtaagctttgactttatttatttggtcatatatgctatgcacatatattccattcattcctttatatctttcttcttttgacattgcaggtttcttcttgttaagcaatgggcagtgttaatttcttactcctctgttcttggttttgctctttataatctgcatttgtttagttgagaagaaaatgtcagctgcaagctctatgaccctttgctattaaagtatgattgtgttatgagcttgtggtcaatgtcttatcaggctttgctttggatttaatgtactccgtatactgaaaatctctatatctatagagatttgctccggtccaacaaaaaagtatctcgagataccagtacctcgaggtacttactttttgttggaccggagcagatctcatatctataggcacaggagtgggccttcttccgctagcatctagaacatttgatcattcacgattacgatttccagatgtgcttatatcctagttttcagttttttttttttggtggctggctagcatcatgtgttcaagtatgcagtgaaagaaaaagtttagttagtaccattgaactgaagatgttggctcaggaaagaaggtgttcttttgctgtataatgatgcttgattgcttgtggtgcactactgtacatttaatttgttttgttgtcctcggcagcttcatatgcatgaaagaattgtcatttctgttttatgggggtatatacatatatgctgatgatattttttatccagcttgtagatatatcaatataatgcattatcttaaatcctgattcaaaaagccacatcaaatcaactccgtcgccagattcatagttcgactatctcaagtgaagttcttttaatagtttactgtcataattgcttttaggttgcactgattaagattttgttataggctctgtttattttgttaatgactagtatcaataattgtatttttatcacgctgtttagtttggttaatactatttgattggaattttctacgcttcacctttttttttcgaccagcc

SEQ ID NO: 65039 - DNA, 7475 bp, Oryza sativa
atccgcctctaccgccggccaccatctcctccttctctagccatagacgcaaagcaagagagagagggtgagagaagggaagcagggggaatgggattagggagggattggtgtgaggaaagagatgacatgtgggcctagatatttttttatgttttattttgctgactagatgccatgttggtggccaagtatgcagattgaagtcaaaaccgtccaaaacagtgttcgggggattatttccggtataaatagttcaaggtaaacgatgtctggtcttttagtttaggagggtaattcggttgattgctatagttagtggggaattcgtacttttaattaccttctcttagcaagttcaaacactatcacaggaatacctatcactgtcgactcattgttgtgggttccattagaaccgacagtgataaatggattcggggtaaaaagaaatcgatttgtaacagtcgagcaacactgtcgattacttattgtcggatcaactataggtctttcatctggcagtgttggaggtttatgtgatagtgaaagcacacgaatttctttctcttcccccttttgttatgctttaggacacatcccttgaaaactttcctcaatttctcaaatggagcatataagcatatctttttgggagcattcctcaatacctacaacatactactctaatgctctcacctaatactccgtcttcatctgctacatcgccaacagacttttaattataccatttctgaatattttttccacttactctacgtgttatatatgacaaacagtcttcgtgtacccatcagttcacccaagagagcctcatatccatgacgaaacatgaatgattcacctacacttcataagagaccgctgttcaccactgtcctctccctatgcctctctcaagtcctttttctttgagaaccaaagagaccattactaaaatgtgggttaattggatccatgccattgcaactttaccaaatttataaaatgacactactatttgtcatatcggctatatgccactggaagtttctaaaattggaaccatgccactccagccaccttttccgtcctcctctctcacgccgtctctgttcccgtcctcatccccctatggtgcatgcatgcagtttttgttactgcattcatcaattttgttaccgaagtaaatgtactacgaaagagtttttacttctattggtctcgatgcactcatgttatgtgtgatcaactggaacaaagccacagaggaagtatgacaataatgtttaacaaaaattataacattgtaggagtacttacaaagaaaaagcaacacatctggttttaatgttttcaaatcaaatatgttgagaactattcagggtcagtttttgaaagtttgatccaaaaaaccatcggacttgctaaaaatatgatgccacagtttttactaaattttagtcactgttttccacagaggaaataggaaagatactggcatatttaaatacagagagtagttagtttttatacatccattagttattaaaaacacatatccatccatgacaaggtgtctcttgtaacttcactgatcccaaaatatattgtcatggtctctcttagagatgctcgtaaagacaaggtgtatatttatatgaacaagtatacccgtatgtatataaacgcttacgtttgtatcatattttcttaaaaaaaaaataacgaaacatgaatgattcacctacacttaattaggagaccactgtcctcctcccctctctcaactccttgcctttgaaaaccaaggtgaccaccattttcttttttttttctttttgcagtactttgtaccagtaattaatcaactaactaatcatgggattaaccaaaactaattcttgtgtaaatgtagtgtgcaatgcccagctgccccttacctctcaccaaccaaccatatgtttcgcccactcacacacactgacactgccacctcactctccactccactatatataccctcgctcgcgcgcgcgcactccactcgcgcactcgcgctcgctcgcacgaacgcacgcacgcacgcacgcacgacgcgcggcgcggcgcggcgaggcgaggctagctcaattggcggcgatggaggcggtggcggaggcggtggcggcggcggtggcggccggggtggagccgttcccggcggtggacaagtgcgacgcgtcggggcgggaggcgcacgcggtggcggccgacctggaggggacgctgctccggtcgcggagcgcgttcccgtactacgcgctcgtggcgttcgagtgtggcggcgtgccgcggctggcgctgctgctgctgctggccccgctggcggcggcgctccgggcggcggtgtcggaggcggcggcggtgcgggtgctggtgttcgcggcgacggccggggcgcgggtgcgggagatcgagtccgcggcgcgcgccgtgctgccgaggttatacgccgccgacgtgcacccgggcgcgtggcgcgtgttcgcggcgtgcgcgcgccgccgcgtcgtgctcacggccacgccccgcgtcatggcggagccgttcctcgtcgactgcctcggcgccgacgccgtcgcgggcaccgagctcgccacgtggcgcggccgcgccacgggcctcgtcgacgaccgccgcggcggcgtcctcgtcggccgccgcaaggcgcaggcgctcctcgacatgttcgccggcggcgacgtcccggacgtcggcctcggcgaccgccgctccgactacccgttcatgagcctctgcaaggtactttacaaatataatttaaccattcttttttggaagtaattacaattaatcctctccattaatttttactaccattctatcagcatccgtactgcaccggccgcatgtacgtacttaagtaattaaatctataataactggataattacagtgacttatcagtatcacactgatcacaccgggtaaccgtgcttttggaacagttttaaacaagagaactttttaaccaaattttacaaaacttattaaacgaatttcatgcattaccaagttgataactacttaaatctttatttgcatgcatactgtcattatcaatggcgacatgttgacaaactctcaacaggagcatgcatagccctcttataaaattcgcaaaaacaaaaaaaactactctgcatgatcttccatgctctatgatcatctccatcatgtaacacaattagttacatcaattctttaaaaaaaataaaatttaacaggtgaaatttttaggaaaaacaacacgattagtagaagtacatgctactgtgtgacatgccaaattaagatgcaaaatcagttgctggccggggtccgtacgagtgataagagggcaccactgcatgatgaatctggatggactggtgtggtaccgaatcgcattgcatctcgcatgtgttgtggcagcagctagatagttagaattggtactagcctttttttttcacatttcattttttttctcttttgtgcatgtgcaacaattaattggagatataggagtactgttggcactgtagtggctccagtatagagaggagatgaggaggaaattggttaaaaacaaagttgtgggtgtatagggttttaaaatccggggataattcacggagcgtgaaaaactggctttgagaaaagaagttgcgagtaggtttttagaaatctggggataattcacgaaacgtggaaaatggtgcaagagtcactcaattgttttggaattttctttgtgtttcttgatggttttcaaacatggccatctggaaatcactccatattattcagttctatgaaaatagtagtcagctagttcttgcgtgagagttttttagcccaaaatagctatctagcctcgtgacgaaaaataaaaataactttacaccacatatacacattaattagttagaaattgttgctcaacctacttgaattgagaagaaaaagatccggccgcagacaagaaatggaaggctttttcttttcgtgttgtccttgctgtacttatcaaatcatcacacataactaaacggctaattaattagcgatcgatcgatgggttcggttggctcacatcttcagctcagcaagtaaatttaagtgcgtgctggttaaggacccgacacgccgtctacccatatttattaattcaatctcatctacatctccagctcgatttcttggtggttaggtcggttaaacactttaattacaacccccccaaatgtggttaacaaattgctccaaaaaagggttatctttttcgtacaagatttgtttgtaaatggatggggtcacacgagtagggtgtgtgtcttgcaaggtttgcttagcttagccctctgtttttagtattaaatcgcagcacacacacgcagttgcaatgctgtagctgcttttaggtgcaaccaggtaggtaaaccggttcatatatggccataggcagctgtcatgacaaaaaaaaattggcatttcttcgctctagacacaattcctgtgttccaaataagccctaacaatcgagaatttagccatttctaacaagtctccgagagttggaaactacagtgcatagaatgtgaattctgaacacgtgtttttataacaatattaatcattttcttttttcaaacacaactctgtgtatatatatatttaataagaacacaaaaaaaaagaggaaaatggaaccataatgaatccagattggatgtgtggggcttatggcacggcatgatgagatgctggctgtgatgtgagagcctctttaattctgttttttggtagtactgtgctgtaataataatccttgcgagttaatgcgggcattggttggctgatgccttgtcctgcgacgtcgtgcatggcgtggcgtggcgtggcgtggcgtgacatggcaggaagggtacatcgtgccgcgctcgccggcggtggaggcggtgcccatggacaagctgccgcggccggtgatcttccacgacggccgcctcgcgcggcggccgactccgctggcggcgctgctcgccgtgctctggttccccgtggggttcgcgctggcgtgcgtccgcatcgcggcgggcgcgctgctgccgatgccgtgggtgtactacgcgttctgggcgctgggcgtgcgcgtcgtggtgcgcggcgcgccgccgccgcgcgcggagcgcgccgcggggcgccgcggggtgctcttcgcctgctcccaccgtacgctgctcgacccgatcttcctctcggcggcgctcggccgccccgtggccgccgtcacctactcgctgtcgcggctgtcggagttcctgtcgccgatcaggacggtgcggctgacgcgggaccgcgccgccgacgccgccatgatcggcgagctcctcgacgagggcgacctggcgatctgccccgaggggacgacgtgccgggagccgttcctgctgcggttctcggcgctgttcgcggagctcaccgacgaggtggtgccggtggcgatggagagccggatgggcatgttccacggcacgacggcgagggggtggaaggggatggaccccttctacttcttcatgaaccccagcccggcgtacgtcgtcacgttcctcggcaagctgccgccggagcacacctgcggcgccggcggcaggtccagccacgaggtggccaactacatccagaggctcatcgccgccacgctctcctacgagtgcaccagcctcaccaggaaggacaagtacagggcgctcgccggcaacgacggcgtcgtcgacaacgccaccggcaagctgccatcgccggcgacggcgacggcgaacaacagcaaggacaaagcttgctaggagaagggaaaaaaaagggggaagtggatgttctagtagtgtaaaactataatgttattaatttttacctgtgtcgatttgcatggggcggtaaatttcctctttcttttggttatttgtactgtgtatgcacttgcaatgtaccaacggggagttgaatgcaatttgcataagtaaaagcaatgggccaggacaagcaaactattcttgtgagtcagaaactcagaagcatgcatctttctgcaggcaacagctaagaacataaaagcaaatttatttggtttggtagattgggtatcacacattacacataggccagggcataggtgttccattcgattcggcaactgaacaacaacccaacaagtaaaacgacaccagacattattgatatatacatactacgagtctacttatcaaatctggtccagatcaattgagttgtctctcgtttttgtaaattgcaagcaaccagtttcaccagaagaataactttcctttccaagaagaaaagcaatcgattgccacagaaagtgaagcaaagaagagtgtacaatccgtggtcgtagattccattgcttcagctaaaatgagtaactagcctcgagcttgaacaatgaacagaaacaagagtctggctataatttttctaggtgcatataggcgaaatggatcttagtacatcttaactccttccaggttacacatgctatgctcagtcctatatacacccggtaccgcggcaacaattatcgagggcgtgctgctatgtatcacaagggtggatcagtaacttactgtgcacacacattgcagctcttccggcagaagccaggtgcttcattggtacccaccatgtagttcggattcttggcacactcccctactgcagcccactgggggcagaggacgttctcatcctcgcacccgtcagtggaagctccctgcttgacagagatgtcgaaggacctcacatggatccatttagttgcggaccacttctgaccttcaatgaccgggcagctcccgtgcaggctgtcagagtctgttgttgcatcggggtggagactgaagaacagaagggcatcaccctttaccggttttactgaagaggagaaccaacagttaaacagctgattaaataatgatcataatggaaggtataactcatatatgcacggctaagacaacatgctgagtgctaagcccacagaatttatcagctgacaaggaacatacatagttctgcattatttaatatctggttttagaagcaaagtaacttaaaattctattacaggcaattcactatacctgcatatccatttttagcacagtcagaccatgtatcatccttgggttgtaataacttcccctaaaaaaaatagtcgagttactgcaagggaaatccaagtggctaacactgtagaaagttaaagaggacaggtaaactacctctgcttctggaaagatggtctctccccccttcccaacgtctgaaaggtacatgagcacagtggcgatccgatgtcctccaagagcttgattatttttgtcatggaagtaatcatagtgtgg

SEQ ID NO: 65040 - DNA, 3214 bp, Oryza sativa
ccccctaaagctgtaatgttttccttcgtggacaatttctgtacctgcgtcttactctcgagctgtgtgtaaaatctcggaatttctggctgtcaacgtggtgcgtactgtgatatataatcacatgtttggaatttacaaatcagctgctgccttttttttgtttgatccggtgttcttagatagcaagagaagcacatgatgattggtatgcattatatatattgttgggttgccatgttaattaagtgatgggctcttgattaatcatgtgacaaaggatggtgcgcacttggtatattaaggcccaaatcgaattcttgttggaccttaatttagctggtgaaaggattaaaatgtagtaaaatcgagtccaattcatcccaatccattcagatacattctctcaccaacaatttgcctcatttaaatctctcctttccccaacttgaagagtcactggtatgtgggttcatagcaaagagaaccgatatgacagtgaaagtaagtcggcttaagtcaaagtatctgaatcgcatcttgagagcttggtgcctagggtggtagctagcgagctacaatgagtagggtagggcaactaaaaggttcaaaatgattttgtaaagtattgcaatcacttattagattttgagtaaaatgcaccggtggtattacaacttgcaaggtgagggtagtttagtcactcattttgcaaattgcttaaataagtcacttatcttccttagatggtgcaaatcctaccaaatacattgtcatatggattgtttgtttttaaattgaaagttgtattgacccaatcatgcatttttttagccatgtgggcagggcaagcattaaaattataaattaacactcgtattttttatgtatatgctattacttctactttcaataaacaagatcatatttttagtcgcattgcacattggcttatttatggatcgtgtgatcatgtttgtaaacaaattgacatagcatataacttcattgcagacaccccacatgacacatgttctatgtgatttgcacccctaaaacaagataagtgacttgtttgagcattttacaagatgggtgactaaattacacctatctcacaagttgtggtactaatggtgcattttactcagcatgtaggaactttaacaaaaggtctaccgtgcatatataaatggatgactttttaactgtgacgatatgcatccatcagaatatcagattgacagcaccactgcatgcaccaagtggagagcataaatcctcaaatatatgtcacaaataccagaaatcatgacctttaatttgattccatcggtatcattcccctattataattagatcccagcatacaatcaaacacagacaacagtttattccattggatgctcctctacttcgttttctcaataggaaaaaagctaattatttgggcttcagtagtaatgcagcgacggagatttgtctgatgaacaatcaaaacagacaggaaccatgtgtccatgtattcttctctgaccatcgatcacgatcgatcgccaagtggttcgtcgtcggaactccagcttcggtcgacggcatcgttgtcggctgcgatggcgattcacataatgtgggcaaaagatgatgattatgaaagggcaaatatatggccatcgaccacatcgcatatagctccatagtgccgacagagttcatgtctaaaggtatctcaggctccgttattttcagttttattcatctgaattattgccacggattattttcttgatgcttctgaaaaaaacggtttgtccaaataaagtttgatttgatttcctgttgttatatttgctaagttcatttctcaaaatattgaatttatccatataatcgagagtagataatccgcgataataatctgatgaataacaagtttgaattttgatatgttgttgttgctgcaatgcatctgatcaagccactgtcctttttcccaaatcatggaggcattcattatgcatattcctctggaaacaagctagtagtatagcttagtagtcatggtgatcacccatggatccatcaccaggttcactgaatctgtctggaaatgcggggcaagttcaatggatctctgcacggttcagacgttcagtttggtacattccgctgtccacccaccgcagtgtggatgcatgcatggtcggccaacgacagagaagaagaccttacattacacacacttaataaccttttgaaggaaaagtgctaattaaggaggagataacacacgctaaccttagctacttcctccgtttcacaatctaagtcattatagcatttctcatattcatattaatgttaatgaatctagatagatatatatgtctagattcgttaacatcaatatgaacgtgggaaatgttagaatgacttacattgtgaaacggagggagtacttggcatttctaaatttcttattgcaacaaaattaaccttaaaccatcagtgccaaatcatgttcctattgtgtatatgtacgggaagttggtcgtggtgagacacctaggcccaccctcttttggattgctcctagcttcacctatttcaggatcttcagctcttctaaatagtcggctcgacattacaagtgaactaacatatattacccattgaaattatatagtgaatggttatattaattcagttgttcaaaggtgcttataggcatagagggtgtgattaattgtaccgcatttctaaatgaattgaatccaagtattccaaatgggatacaaatacacaaatgcaggaattaatcccgagttaggtatatacctcgtataatcgtattattcacggtacagtgactctaccttaagtgtgggctgcacagtttttatgccaagaacaggtctgaatctgataagttcgattgtgcagtgaggataagagcacgtgttatagcttatcttcaacgtgattgaacacttaactttactttgttatgtttcaattcattttaatgatattaagacaaatggccaactataaccaaatcttgtaggcaacagaacaatattaacaaggtactatagtagtgcatatcttaccgtgatattatccaaaatcttttttactgcacgctctccaaatagctccctatatcccaatccttctataatttattatgccaacaacgttcggtcaaatt

SEQ ID NO: 65041 - DNA, 3436 bp, Oryza sativa
ctttaatgccaaaaaaaaccttaccaaattttagcattaccaaaatttcagtatagttgccaaaattttggcaggattttttatatagctaccaaaatttgacagcaaactaaatgtagccacttttttagcaactttactaaaatttggtaaggttgaaaatggcatcaaagtaaacaggccctacatcttttgtgcccctatttggttggatgcaaaatttgtagattgagacaacacaaaaattcctttattgctactacaactaaagttttaaatatgcaacctcctaaatagaaattgtgcggtctaaaatcatataaacatttcctaatacatttaatttctccttttacttgaatgcagagcgtatgagttcagtttgtatttataagcaccatgtatctgcacaatatatgagatgcatacgtataagatttataatgaatatgtgtacacatggatgtatgccagtctgtatatgtatgtacgtaagtacgtacgtacgtacgtatgtatgtatgcaacctataaccaaatagtttgtgaataatttactatagtttcagttctgatttctactgtgcatgtatacctagcttcgtgacaactaatctacgtatagtttgatcgaaactaaattatcccactcctcaacagatttagtctaactaacaataaatcaatgatgcatatggatatgacttgataaataaatgacaagaaaacgatcgaaatatcatttaagatccataatagaacaacaatcaacatatttataggtcctagccagaatcgtggctcaatcaataccgctctcagccagtgtgatcaagtcatagcgtgattaatactatagctaaatacccaagatgttacaattagagatcttaagggtggaggatttaaaaaagtaataatttaatagagaagatgtcctagttaattgtatgcaaacatgcatgccttatattatggaacacctaaaaaaatagttgtgttttatattatagaatggagggagtatataacaatgatcttgttcactttgatgccattttcaaccttaccaaattttggtaaagttaccaaaaaaagtggctacatttagtttgctaccaaattttggtaactatataagaaattttatcaaaattttggcaaattttgacaactatgccaaaatttggtaaggttttttttggcatcaaagtgaacaagtctaatgttttactaatttttaagtatagagagagatcgcttacatatcaggtacaactgcaaactgcataaagcataaagcataaagtcagttgatcaggtctgtttcctacggccattttctaatgtcatataaactgattcatgcatgcacaaaagactgatcgagagaagtacggagtaggttggaaatttcggacctcggaaatttcggtcatttcagtcaccttcgatacgatattacttcgaccaaaattttttcatgaatttaggtaatatttgttcaaatttaactaaattttgctcaaaattttggaaatttcggaccaaaatttccgaaattttcaaaatttcgggatttcggccctaatacaaagtcctcaaacgacagagtgaaccactacggaccaaaaggaagtcgtacagtaaataaatcaaacggcgaagcaaagcccctcactcagaatataattactcgtcatcagaacagaaaagtaaaaaataaaaaataaacccagttaattaactacagtgaggcctcactccgattttaattattaatttactgcctgcattttcgactcgccgccgatcgagacgtccacttgatcagctactagtagcatgtagggacgccgcgagaacagccactagcagcgccgccatggccgcgccggcggcgaggaggtcgtcgtcgccgcgaggtgggctcgcggcggcgcacatttggacgtaggacgccgccgccgccctcgtgagcgcgccgcccccgccggcgcggaggaaccacggcgactgcagggcggcgagcatccgcggcacgacggtgatcgccgccgcggcgacgaccgccgcggcgcgtgacagcgccgccgccgccgtcgtggccgcggcggggaacaggagtaagtagacgacggcggcggcggcgatcacgagggcggcggaggtggtggtgctgatcacgtcgcgattcttggctagcgacgacgaagctgccattaatttgggagaagagaagcacacacacggggagagattagatcacaggaggtggaggagaattaggccggagaggaggcgattgaggaatggaagatcaaaatgtgcgatgatcgatcgatacgtttgctgcccctcggtgaggcacttaagtagcgatgacgatcaagctcaactcaacgtcagacgcatacctttcaaagttgcaactcataccaactccgtttatttaatatgtgatgtcattgagttttttataaatattttatcattcgattttatttaaaacttttatatagatataaagaatttaagttgggcttaaaaaacatttgacaataaattaagtcagaataaagcaaacgatacttacataaatttttaaaatagaataaatggttaaacgtttaaaataatcaattgtgtcatacgttaaaaacgaaagtggtactccctccgtcccgtaatataagggattttgagtttttgcttgcaacgtttgaccactcattttattcaaaattttttaaaattattatttattttatttgtgacttactttattatttatagtactttaaacacaactttttgttttttatatttgaaaaaaaatttgaataagacgagtggtcaaacgttacaaataaaaactcaaaatcgttatattatattgtaggcaggagggagtaacagctaacgaagacgctcggaaaatatgcttatcattgtattcatcaagtgtcatttatatattatatatatattctagcttcgatcgaccctttgctaattgctatcgacgactagattactcttctggtccatgcttatctttcaaagtaaacaccattaccgtcagatctaacatttttaagctgatagatgcaatgctactgctccgtgtgttaacgtggggggtccaagttcagctatattataaaattttaattcagtcacgttgttgacctgggtcaagttaacgtttagtactttagtagtgtcgttggttgcaattctatcgtgcgtagagtggtggcgggtatatacgtgccggatggatcgccgaaactgcccagcaacggccaaagcttctatccaatcctttcgattttttttctctttgagattagcatgtgttatatatgtcactcttaggagtaccatatcatggtacgtaggttaggtaacaaagaggtgatttgactactct

SEQ ID NO: 65042 - DNA, 1585 bp, Oryza sativa
ttagtaaaacttaaaatagtttggttttgaccaaagttaaaacgtgttatgaactgagacataggagtcccaattaagggcccatgctgccacgtgtcaaggacgaccagtagtcaacgtcgactccaatatctttcttgctcgctttctatccgtcgtgaaagtcacgaaacatacttttttgccatgcgtatatgcatgcacgactgcatggattaataatacggcaccttaatttccttccattatctcatgtacgaactaaaccgcttaattagttaattaatttgtttggcaaagtggctgattggcatgcatatatatatttttggcctttggagatatgggacaggtagtactagttctaatctcagtaagacaaaatgaaccgaacaacttttcatccttggtgcgtctgttgtttaatcgaataattaatcaagttcggagcatgggtggtggtctaacctacagattgatagccactaagatatatatttctgtcaaacttttgtgtttaggagatgttctagttgtttctttcttcttttttttggctttgtgcattttatgcggaggccggggatgactcagtttgattgtatcatctcgatgtaattaactgagtctaaataaagcttctattatctaaaaattaatcaagttcatctcgttggtagtaatggtgggcatccaacttatgcagagctctaaaagctagctatagctatcatgcatgcatatgaaaccaagtgttttaattctcatgtagatattgggattcaatttattcgaggatctctttagcctcaattgaagtaaaggtattagtccctttcatataagtaacacaacaaaagcggattagattgacagatggtaatcaataatataattagaatgcaggcgctggtggctttgttaggtcggccgttgttctttggtttaattctggtcgtatgcattgttataattaagtgattaactgatctagctctaatattttaattaattccaacacatacaacaaggtgtaaaattgtgcacgaaatttgaacatctccttcttatttcttctcttagtgatactgcccaacataaagttgcaatagccttggttgttcagaattcagccaactgaaaaagattagcaacgctagtagacagatgatgcccaaaagttataaaaaatagtattccatatgaataaaacaatttagaaaaaaagagacgttgtaatgtttcattagaattacggaaggaacatttagtgacactttcttttgtatagaattctctttgattaaaagtaccactttcttcgaatacaagagaaagattttgattttaaaaaaaattctaagccttcaaatgaaagctttccttggtaccctctatatatgagccttattgtacatgacattaagatcctctttttattacctttgcacctccaaatatcttttttcccccgaaaggtcaactagcactacctttgaaactaagtcataccaagccgctagttatcactataaataaagagccacctaaaagagacatttaaaaacagcacttatctaaattc

SEQ ID NO: 65043 - DNA, 671 bp, Oryza sativa
taatattagagcctagaggtcaaaaactattttgtatagagaaaattatcccacatagccatctgttgtttattcaagaaatattatatgtatcttcaggggaaccatatgtgatacacaaattcaattttatgtccattgttagagaatccatttgcttgaatcaaaattagagaatcatatatctgatggaaaattgtctttttaccaatatgtttgccttgcagattggtagttcctctcgtcctccaggcaccagctatagacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttcttttatctatttatttaaacattctttgttggtgtcggtgcattgcctctgaattttagatcttttttagtgcaaaatgcatatgaatgtgtggcattgatattcccttggagatgaaacaaggtattcagtgtttgcaaattaacatttacgagtaggatttacctagctagcatggcctctttcatagccacttttgcatgtatgaatctttgtaaattgtggtcctataggcaaatagaaaggtaaaattacgtgatc

SEQ ID NO: 65044 - DNA, 31243 bp, Oryza sativa
  unsure (1)..(31243): unsure at all n locations
caagccgatgcatatcaaagaaatgaatacaatgagttccacttaccatcttgggaccaacaaatatcttttaatctctctgaaccagagaccaccattaaattagacgagcttcagaatcttctagttctttcggcgaggggaatggattgaccttaaaggaagtggattgactttgattctctcaacaatctcaaattccagaaacatgattacaatgttcgtaacacacgagagaatcgattcgtccagccgaacgacttccatcttcaccagctataaaaaagccgagaaatccaggtgctcagcacagtggtccagatcacttgcgccatcacaagtcgcaagccaaaaccatctcgctcgagctcaccatggaattctcctcgagttcaacctctctcttcctcctcctctctatcctgcctctcctctactttctttgccagcgcaacgaccccaagaagcagcctcacgcccatgggctcaagtcctaccccgtcgtcggcatagtgccgcacttcaccaagaacaacgaccgcttccttgagtttacaaccgaaatcatgaagcggagccccacgcaaaccatgtcgttcaaggctctaggtctcaccggcggcggcgtcatcaccgccaacccggccaatgtcgagtatacgctgaagactaacttcggtaactaccccaagggcgagctcgccgtgtccatggtcgtggacttcctcggccatggcatcttcaactccgacggcgagcagtggcagtggcagcggaaggccgccagctacgagttcaacaagcgctcgctgaggaacttcgtggtggacaccgtcaggtccgaggtcgtcgagaggctgctgccgcttctggagcgggcggagcgcgacggccggacgctggatgtgcaggacgtgctggagcgcttcgcgttcgacaacatctgccaagtcgccttcgacgaggacccggcttgcctcgccgaggacagcatggcctcgccccagagcgcggagttcatgcgcgcgttcaacgatgcgcagattgccgtgagggaccggttcatgtcgccggtcaagtcgctgtggcgcttcaagaggctgttcaacatggagcccgagaggcgaatgcgggaggcgctcgccacgatccacggcttcgccgagcggatcgtccgggagcgcagggagagagggaaggccggactggcgcgcagtgacgacttcctctcgcgcttcgccgcgagcggcgagcacagcgacgagagcctccgcgacgtggttacaaacttcctcctcgccgggcgcgacacgacgtcgtcggcgttgacctggttcttctgggtactgtccggtcggcccgacgtggaggacaagatcgtacgcgagatccacgcggtgcggcgcgcgtccggtagcacaagcgacgcgacgttcagctttgatgagctgcgtgacatgcaatacctccatgccgccatcacggagtctatgcggctgtacccacccgtggccatggacacgcacagctgcaaggaggacgacttcctgccggatggcacgttcgtggggaaagggtggctagtgacgtactgagcgtacgcgatggcacgggtggaggacatctggggcgcggattgtgaggagttcaggccagagcggtggctagacgaggtcggcgcgttccggccggagagcccgttcaagtacccggtgttccacgcggggccgaggatgtgcctcggcaaggagatggccgacatacagatgaagtccattgtagcatctgtgctcgagaggttcagtctccagtatgccggcggcgagggacacccggggctcgtgctctcggtgacgttgcgcatgaagggcggtttgccgatgcaagtggccacgagaggttgatgaccggagcgtgctgctacacttgtggacttcgtttttacagaactagtggcacgcgagattgcatggctagcataacaacatatatatttttatattttattgttaaaatatgttaaatgtatataattctaagttatgtaataatttcactttcagttatttctaaattcttccaatattccttcatttctattttctaatttccgttatttctaaattatatttctatatgtactactatatactctacttttattttttatttcaattcctattttcaggtagtactgaatttctatatggactctagatacttcttccaaatattccttatttttgtttctaaaattctattatttataattgtatttttatatggactctaaactcatctctcaatattctttttttttaattctgagtttcggttatttctaagttgtatttctttatggactctagcctcttattctaatattcatcattttttaattttgaatttttgttatttctaaattgtatttctatatgtactctaaactctacttttgtagcgcccgttccgtcgtggcgcctagcgggaaaattatctcctaaaaaccctaattgcgaaatttgtttcttcgcttgtcgtctagtgtccgtgccatctcaagatctcaaatccccgatctatcgtcgagtttaattccgaatccaatccttccaaatcaaattcctccgcaaaagtctattttgccaccccagggttcgatgggccgaatctcgctcggcccatctccctctccccctccctcccggcgcgctctctctctctcccccttcccctccgctctgcccgcgcgccgcgcgcgcgtgtgcgagagccacgcccagcgcccctccctccgctctgcccgcgcgtcgcgcgcgcatgcgcgagagccgcgccgtctgcgccgtccgcgccgtccggccccgctgccctgccgccctgcagccgcgcagccgcccggccccgcaagccagcgtgcgtgcccaagccgcgccgctcaaatccgccgcgcctcccgttgcaagccgcgcgcgcgtgccgtggtggccgaccgcctggtcgccgccgtcgtcagcgcctgccgcgcctgtcgcccgtgtcatcgcgccgctccaaaccgcccagccgtcatcgctgtcgtcatcgcctcggccccgcctctccgcgcgcaagccgccaagggacggaggcagagcctccctcctccctctgccgcgacgcctccactccctcctccttttcccaaagaagaaaggggcgagcccccccttttctctcccccctttatcctcctttttccctctcgccagcgtcaccgccctgtcgccgatttggacgcaagcgccgagcgccagctcgcgccttgaccgccctaagtcggttcccaaaccgacattgccgcccatttaaaccctagcctccccctttcccttcctctctcattcgcctccgcgccattgccgccgcccccgtgctctgttcgccgtcgccgttcgtcgttgcgcgtgtcggaggagccggcacgagccaggacgcggaaggggactccgggcgcgccctctccttcctcttccccggcccgaggccggagagattactcccgcgccgtcggcctctcgtcacagcgccccgacccgcacggtagtgcctctctccgttcttcctcctcgctccatctcctccccttagttttcggtggtagcacgagtagcctccccgaagctagcctgcgccgccccgacctttgtcgtcgctcgccgtgtgctcgccgccgtcaccgctcgagctccgtagcacccgctcgtcgccagcctcgctcggcgtagctccgcccaatccgacgctagcatcggattcccgtagccgcttagatgctctcaccgccgggaatcggcccctcgtgacctcgtcgtcgtttcccccttttctctccgccggttgccgccgccgcaatccgccgccgtcgagcatcccccggcgaatccgagccattggctcgtctcccctcgtcctgcgcaacatcccggtgtgctcgccttcgcctgtatcgccatggtttgctccgccgctcgccgctgtcgaccgccgtccgttccggccggcgtcgtcgtctacctcccgccggcccgcgtggcagccacgtaggcgccacgtcggcgccacctcggccgcgaccaggtcaagtagaccccggtccgccgcttccctccgcccctcgcgcgcgcggtccaccgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgagggatggacccggcccaccggctctctctctcccctccccgctcgcgcgcgcgccttgggccgccttcataggccagccagcccattaaggtcggccgagccgccccattctctcgggccgtgccctagccgcccgagggaagtctaatttccctccctccttcttttcttttcttttctttttcaaaaaggatttaaataaatccttttcctttagaccaaaaatccaataatcttagaaattcaatatctccccaaccgtaagtccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgtcgtcccgtctgcaaggcagattggcggacccacctaatttgttgcattgatcctcccttgttaattgttatatcatgtccccctgtaaccatctagttgcgtctcgacattcgcgcaccctgtgcgagcatcgacggacgccttcaaacttaaaatctgaaaaacaacttgggtaaaacttgggtttacaaaagacttggaaaactcgacacctgggtcggtgcttgcgaactaaatggattttccaaaaccgcggaccggggaacgtaccaggtgtacggtttcccgctctcgcacttaaggaccgattccttggaatttcatccaaacgtaagacaagtacgaccacatgggtggaatgagacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaaagcttggaggtctcccgacgtggctgatccccacgggctgggtgatccgggttagtaatgtcgtgtgggtaaagtgtacctcctcttcagaggttaacaaactgttcgaacagccgtgcccacggtcatgggcggatgtgaggtgattcctagcacagttttgtttgactactgcttgtgaaattgctgttgtggaaaggggttcgatgtttgaaaaatctgcagctgatgggatcagctaggcccgggtggccgtttgaaagttgttggcccgggtggccgtttgaaaagctgttggccgggtgccaaccttgattcaattctaaagactgatacattgcacaaactccgaccggacgagacgcactgtctcaaccgtgttgtttgagaagcactcacttagttgtttttagaaaagagttcaaataaaatcaattgcaaaaacaacagcctttctttgaagcctgcattaaacacttatttcccatggcttgctgagtactcccgtactcacccttgctctatataaataaccccccccagttgctgaagaagatgaagcggatcctgctgatgagaagttcttccaggagcaagccggctacgatgagttttagggtttcggcctagttcccaagtcgcgcctgtgttgattggtccaagtcctggcttccatttcccttttgtaatgcagttgtgagctcgggatctgtccgcagcccaacatgactgtatctctactctataataaagagacccctgttgctgtgatattctgtctccctgtgataccagcactgtttcctgggactggtatcgattaacaggttaatttggagcgtcacaggctagttccggtcggtactagttcggggcgtgacaacttttaatattcctttttctaatccaaaatttcaatcatttctagattatattctgtatggactcttatacttttatttcaatattcctttttttaatttcatggtatttataaattccggattactgttatttttaaattgtattcctatttggaatctattttttatttttttcctctttttctccaattaatatgagaatttctcgaccgtgagagtgaatgtggaggctcctttttctattactttaataaattaatagatagataatattctatatggactcttatacttttatttcaatattctttattttttaatttttaatttttggtatttataaattgtatttttatatggactctatggagtacttttattattttatttttttgttaattccgaatttttatttataaattgtatacgtatatggactctagccttttcttttaatattccttattttctaattccgaattcagttatttttaaattgtattcctatttgcactatattttttctttttctatttttctccgattaatatgagaattttttaaccataagagcgaatgtggaggctcctttttctattgctttaataagttaactagttgggcagcccacgcaattgcgatgctagcaacaatttaaaattatctattttttacacatgattttatttaaaattatcattctcgtgattctaataattttatagttttaaaagccacatcagtcactaccccttactcctttatcacatttttatttgcttactcgatataccactacttctattcatcctctttaaaactttaaaaaattaggccttatagtttttagagttcattgtcttgttgggtttcgttttcataatttttaggagtattgtcaaacatcgtcaatttactgctctacggctcatccgctgccacctctctttattatcattgggattttaaaaatcgaacataattattgcttgtgttcttttttactttttataagtctcgtcaaatcgttaggggcttcgccccctatactgctctgcaccccgcccactgcctcccctctttattgttattcagattttaaaatcaaacatgattatcattggggtttattttactctgcataagtcccgtcaaccgtcgtgaccatgttgcataacagcatgcctatcttcactgggattctatttggggttttgtttatagttttttgatatcacatcaaccgctaacactctactcctttgtaggcctattgcttatctcctctttatggtaatttgtgattgttgtgttctagatggatttttttaaaattgcataatttttcatcccgataatttttttcataaattatattccaacttaaactcttataattatttttctatttttggaatttattttatttgttatttcaaactttaattaatctcgtcatgtattctagattgtctcttacttcaacggtctttattttttattacaaattttagttatttattataaattgtatacgtatatggaatctagccttttctttcgatatttcttatttttctaattccgaatttcagttattttaaattgtattcctatttggactctattttttatttttctgtttttctccgattaatataataatttttaaaccatgagagcgaacgtggaggctcttttttctgttgctttaataagttaatagattgctcccgcttaatctgagaaataaaaaaaatcggtgttcttgtcttctccgagtggcgaatggtcggccgacacctttcgaatcggagcttatgtcggttgcgtgtttgtgtttggcacgccaagtggagcttgagaaaacaatcgagatcgatctatgtgcagtattgcacaggatttgcatccttaagaaagttggtgtgccatcgcattcttggaaaaaccggttactgcgtttgtttgcaacagatagagagaaatcacagttttctccatgcgcaaatcacagttttctccatgcgcacgctttccaaactacgaatcattaaatatcatactttaaaaaaatataggaaagttactttaaaaaattaaattaattaatttttaaagtttaaaataattagtccttaattaattatgctctaatgtcttaccttattttgcgtattttctcaatcttttctttttacctcctctcaaacacggtgaccaatgagcactgagctaccactagaaacctaaccaattgagctacatttacttcgctagtatgtaatttataacgtagttctcttgtagaatatatgtttgatcattcatattatttaaaactttttacaaatatatggaaatatatagtaccgttatgacaaagtacttttagtgataatagaaatcacaataaaataaataatcataatattattttttatgaaacaataatcagatgtaaattaataacggcgtatattaaaatcggagggagtactctctatttgaaagcacgagcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacggttttttttgtttcgattttttattttcccgtgcacacgtgaaaatcgcgattttcacagacacttcgttccagacgggtggaagattcgcatgctcgaccgcacagaaaaatcattattgcactagtgggagtatatgttagcagatttgtttcgagcctaatcaacttttattatagttcgtgtgtgcgcctggatcaattatttgtgaactagagagagctgtaccaaagctgaacctaagaacctgattatttgagcgggcgtccactgtctagctttactagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctcaccatggaattctcctcgagttcaacgtctctcttcctcctcctctctatcctgcctctcctctactttctttgccagcgccacgaccccaagaagcagcctcacgcccatgggctcaagtcctaccccgtcgtcggcacactgccgcacttcgccaagaacaaggatcgcttccttgagtttataaccgaaatcatgaagcggagccccacgcacaccttgtcgttcaaggcgctcggcctcaccggcggcgtcatcaccgccaacccggccaatgtcgagtatacgctgaagactaactttggtaactaccccaagggcgagctcgccgtgtccatgctcgtcgacttcctcggccatggcatcttcaactccgacggcgagcagtggcagtggcagcggaaggccgccagctacgagttcaacaagcgctcgctgaggaacttcgtggtggacaccgtcaggtccgaggtcgtcgagaggctgctgccgctgctggagcgggcggagcgcgacggccggacgctggacgtgcaggacgtgctggagcgcttcgcgttcgacaacatctgccatgtcgccttcgacgaggacccggcgtgcctcgccgaggacagcatggcctcgccccagagcgcgaagttcatgcgcgcgttcagtgacgcgcagaatgccgtgatggaccggttcatgtcgccggtcaagtcgcggtggcgcttcaagaggctgttcaacatggagcccgagaggcagatgcgggaggcgctcgccacgatccacggcttcgccgagcggatcgtccgggagcgcagggagagaggggaggccgggctggcgcgcagtgacgacttcctgtcgcgcttcgccgcgagcggcgatcacagcgacgagagcctccgtgacgtggtgaccaacttcctcatcgccgggcgcgacacgacgtcgacggcgttgacctggttcttctggctactgtccggccggcccgacgtggaggacaagatcgtacgcgagatccacgcagtgcggcgcgcttccggtggcacaggcgacccgacgttcaacttggacgagctgcgtgacatgcaatacctccatgccgccatcaccgagtccatgcggctgtacccacccgtggccatggactcgcacagctgcaaggaggacgacttcctgccggacggcacgttcgtggggaaagggtggtttgtgtcctacagcgcgtacgcgatggcacgggtggaggacatctggggcgcggactgtgaggagttcaggccagagcggtggctagacgaggccggcgcgttccggccggagagcccgttcaagtacccggttttccacgcggggccgaggatgtgcctcggcaaggagatggcctacatacagatgaagtccattgtagcatctgtgcttgagaggttcagtctccggtatgccggtggcgagggacacccggggttcgtgctctggttgacgttgcgcatgaagggcggtttaccgatgcaagtgaccactagaggttgatggccgtagcaacttgtggactacgctgttagagagttgctcccgcttaacccgagaaataaaagaaattggtgtgcttgttttctccgagtggcgaatggtcggccggcacctttcgagcttacgttagttgcgtgcttgtgtttggcacgcagtggagcttttgaaaataatcgagatcctctgtgcagtaatgcacatgatctgcatcatatccagatatcctcgagaaaggtggtgtgctacagtacaaatagtactactattggtgtgtggacaggattgatatcctctcgccggtcgactacatcgttcacggacatatgggcccgatgatctttaggcccgcatgtctgtgacaaagacgcaccaagacgcggtgcagtcgactgcgaagaatctttatctatgtggatgatgtagatggatgccaactcaaaaaaaattggttattgcgttcgtttgcaaccgattggttaatagttcgtagtttggaaagagttcgtttgtacgtttttcgatctacaaaatattactcgacgtgtttttttataaaaaaaatatagaaaagttgctttcaaaaattaaattaactattttaaaattgtatgctcgccaaagctcaaagagatgtcggggtgtgggtgtgggtgtcgctggggcacgactttcccaacatggtttcgagccatcgtctctcgtgtcatgctcgttcgaccttgcaagccctaacgaggctcgcgcgtcttcctagttggttgaggggcttgcatgggacacatcgacacactatgaatgtccttacatgatctttctgtttagttagggcaacgtcaatgttaaaggttacgtgaaacataagagtgggacccaccacagtaagcagcagttgtttccatgcctacaatgcttgtgtcgcagagagaaaataaggtggggcccacagggtcccatcgaggggaaaaaatatcactactcactccttccgtgaaacacttggcgcaatgaaaagtccccatcttctattcacttcatattttattagcttgttgccgcaccgtaaggttaaggcttctttttctctatggttcttatggtgtgcttgcacaatgcttaaggtgttgtactgtataacattaattgcttaaggctaactttttaccaacattgtggatgcccttaggaggcaaaagacatggaccttccaacaacgcacaaccacattgagtgccattgtagctaaaataaagagtaaattgcacttacggtgcaacaacttagcaggtgggtgtaatttagtacaataacttaaaaaatgaacgttctagtgcaacaacttggtaggaatgtgcaatttagtataagaactttataagtgatcgtataaatgcaacaacttgtaaggtaggtaggattttgatacaataaattaagaagttacgtgacaacttaattatttagagcatttttatataaattcaaatttttaagtacttattttaacaatatactagcatggaattatataaacatatttatatttttatcctaataactaataactaaaaatcaattaaactggattaagaaattattatatttcggttgataattgagaaggtgaagaaaacaaaaattttaaagataattggatgtaaattgtatgtgcaacataattcttaaagattaaattcatatataaggtaatatccgtatgatcagtgtgtattggcatacttacatcgtgaaaaatctcatctagcatatgcttagctaaattgattcactaaaatactaaattattaagttttttactagaacgcacccacttgtcaagttgttgcactcggacgttcaattataaagttcttgcactatattgcacccacctatcaagttgttatatcgtaggtgtaatttactctaaaataaaagaggaaacacgaacttgtgtgtggtgtcagtgtgtactgtctacctttaatattgaagttgcggcacaacaaagtcattgtaacgatctgcttgcgctgaatcacttctcaccttgataggatgatccactcctgaatcttgagctgcaagccgattcatcttaagtaaattagaaacatttagttccacttgccctcttggaaccaataatgtcaccaatttaaactctaccattaaaattagacaagcctaagaaacttccagttcttctgatcaagggaatgtttgacttttgttctctgacctatgtgaagtcgtaagcacatttatctatctataataactctattaattgagcaccacgagggaactaaccgaaaatatgtaggagtagttgatgactaaccctgctgcaactaagcttagggtgtgtttagatcccaaaaatttttggtctaaaatgtgacatcaaatgtttggacacatgcatggagtattaaatatggacgaaaaaaaccaattgcacagtttacatgtaaattgctagaaaaatcttttgagtataattgcgccatgatttaacgatgtgatgctacagtaaacatttgctaataacggattaattaggcttaataaattcatctcgtaatttacagacggaatctgtaaattgttttgttattagtatacgtttaatacttcaaatgtgtctccgtatatttaaaaaagtttagccaaagaactaaacacggccttaagcaagttgtgccatgcaataaaaatatgattagaaatagtttatcataaagtatagcatggctaagttttttttagcaacagaggttatcgcagaaacaaatttacagattagcccgagatattacacaaccaaggagactcttagtgtcaaataattaagaaattataaaagaagtctgggcatgctagaactcaccccttccactatgctagcaagcactttcctagcattgttagttataaatttggaagtatacatgacatgtgataagtgcagtgcgatacaatggcggcaacaaaataaacatatatctaaccatgacataactaaagtgtgacttagcaaaataagacaaccaaacaaaagccgtaaaataccaaaatacccaagaacccaacacaattgatatgttgctgagccggacgactacaatctccagctataaagcagccaagcaatccatgtcttcttatcccagaaacattgatactgatacagatcacttgtctgccagtcacaagcctcatgccaaaagctcctctcacacactcactctctcgcgccatgaaattctcctcgacctcaacccctttattcatcctcctcctccctttcctgcctctcctatactttctctacctgtaccaggataccaagaagcagcctgcaggttccaatggactcaagtcctaccctgtagtcggcacgctgccgcacttcgccaagaacaggcacaggtttctcgagtggtcgaccgacgtaatgaagcgcagccccacgcacaccatgacgttcaaggcgcttggcctcacaggcggcgtcatcacagccaacgtggccaacgtcgagcacatactaaagactaactttagtaactacccgaaaggcgagctctccgtgtccttgctcgaggacttgcttggccacggcatcttcaactccgacggcgagcagtggctgtggcagcggaaggccgcaagctacgagttcaaccagcgctcgctgaggagcttcgtggtggacaccgtccggttcgaggtcgtcgagaggctgctgccgctgctggagtgggcgcggcgcgacggccggacgctggacgtgcaggatgtgctcgagcgcttcgcgttcgacaacatctgccatgtggtgttccacgaggacccggcgtgcctcgccgaggacagcatggtctcgtcccagagcgcggagttcatacgcgcgtgcagcgacgcccagaacgccatcattgcccggttcatgtcgccggtgaagtcgctatggcgcgtcaagaggctgttcaacttggacccggagaggcggatgcgagatgcgctcaccacgattcacggttacgccgaccggatcgtacgggagcgcagggcgagaggggaggccgggctggcgcgcagcgatgacttcctgtcgcgcttcgccgcgggcggtgagcacagcgacgagagcctccgcgacgtggtgaccaacttcctcatcgccgggcgcgactcgacgtcgtcggcgctgacctggttcttctggctggtgtccagccggcccgacgtggaggacaagatcgtgcacgagatccgcgcggtgcggagcgcgtcgagcagcggcggcacaagcagcgcgacattcagcttcgacgagctgcgcgacatgcactacctccacgcggccatcaccgagtccatgcggctgtacccacccgtgcacctggacacgcacagctgcaaggaggacgacttcctgccggacggcacgttcgtggggaaagggtggctggtgacctattgcgcgtacgccatgggacgtgtggaggacatctggggcgcggactgcgaggagttcaggccggagcggtggctggacgaggcgggcgcgttccggccggacagcccgttcaagtaccccatcttccacgccggaccaaggatgtgtctcggcaaggagatggcatacatacagatgaagtccatcgtggcgtgcgtgctcgagcagttcagcctccggtacgccggtggcgacggacacccagggttcgtgctctggtcgactctgcgaatggaaggaggcctgccgatgcaagtgaccaccagggagtaatcatcgtccacttcattgctagagttgctcttgctttgatcccagaaataaagcatgaatggttttcttgttttccctatagatggccaaatgagtcgctcgacacggcctggcctagcacaaccaaagcatggtctgagatcagtcagtcaggccgtgctcgcccactggttgcacctacgacccaatatgacacaggctgtgccatgctggtctgaaggcacaaccagtctaacgtgctcgtccttgcaataagtctattttgcctccctcatttctttgggtcgtgtcttgtatatctagaatacatctattttgcatctctcatctctttgggccgcccattgacgagctacggcctatgggagcgggggatcattgggccgtgccgtgctagatcggcacgtcgtggcgaggaagaggctcaggcacgacaattcatgtgagctccaacaggtacagacattcgccattcgggggaatatagttggccaaaagatccgcagctcgacaacccgacccacaacatggagaggcgtagcccacaacggaaccataatggcatggttttatattttggaaaggaaaaacaatcgaggaagagaggcgattgatctgaaattgtggagattttgaaatattctacccaagttaatttaaaatttagataaaatttgtataaaatttactaaattcataaaattaaaattttcggatgaaataatttcatacccgggaccgaagtttctaaaaccaaaatatcgaaccctgcttaattaacgtggtgttcatgttctgtggtcagtatgggcactaaagtacttcaaatctgtactgtcactaatataagtcggaggaattttataaaaaataaaatcaattcacatgtaattatgtaaacacttcaaagaatataattatatgagattattattacgagatttcatttgaatatagaaatgtaagattttgttgtgagatcttaataaaaggaatataacattataaccatatcgtatatttgataaaaaaaaacagttgaaaagataagaaaatctttatttgaagattttccttgttattaaataccgataagaagcattacttgtcattgatcaaatcatttgacggagagaccgaggaatgggcgcatgatcgtgggaagcgtttccccaagatctaatcgtggtaagcttcctaaagactactacttgcattaatttaaatataattgtgcgtgcaactcgtgtgattttgaaaattcacaagttcatattaggatttgttgagaaggagaaattagtggaattaaatggtgaaatattatgttcgttgagaagagaaagttggtatagaaataaaatgatggacaattctgatttgttaaaaaagagatatagatagagaaatagctacattttactttctccattgcaaaatatagctatactttctagtttgaactaaaaagtagatgcattttgggatggaggaagtaaaaaaaattgaaagctagaaataactatatttgtgatagagtgataccatagtagttgtccgcattacatagtactattttattttttttatatatgactccgttgatttttacatgtcatttgttcatctttcttatttaaaatttatataaatattatttttatatgatttatctttaaaaaatctctaggtttgatttagggggctgcaatataacggaatcctattttcgaacgggatgatcctgtcgacgtttgatgtcgtcattctggtatttgcatagtatggggatcgtcggtgctaggatatacgcgagactgaggtaaaagagacgaagacggggatttttatacaggttcaggctcctgagtggtcaggtaatggccctacatcctgttggccggagccggagttgcttttattcaccataatcacaccagtacaatatgtggggtagcctatctaaccgttgtcgacatggcggtctgaaggtctgactcgtagtcgacaacagggtagccttcctcctcgagctcgcgcccgacgaaatcagagacagtgctagatccctacggccggcctctgaaggtaccggatagggtcgatccaggcgtatctttgatgtcgatatctggcggcttgtcttggcgtatgtaggtttgtatgttgtcccgtgtatttgtgatgggtgtgttgattgtggtggtccgtgtgtccgtgttgatcgtgttgatcgtcctggggggccttgtatttatacccataggtgtcgccttgtccaagtagaactagggaaaccaatgtggatacaatccgagcagtccttgttgattccatgtagaactctggttgtccttccttatatggaactccctccatatctgaagtcagtttccgtataagacatggtatgtggtgggtcctgccgagatgcagtcaactactattaggtatgtggtatccataaccctgacagatcccgagtaggtatcaggtgtgatacctattaggtatcagacgattctacacaacaggatgatcccgagtaggtatcaggtgtgatacctatcaggtatcagacaattctacactcgttttatgtgatacttgcaagtatcatgtgatacttatcaggtatcatgcgatttctaccacgtatcgcgtgatactcgcgaggtatcatgtgaaacctgtcaggtatcagacgatttcaaccatgtatcgcgtgatactcacgaggtatcatgtgatacctgtcatgtatcatacaatttctaccacgtgtcgcgtgatactcgcgaggtatcatgtgatacttgtcagatatcagacgatttctaccatgtatcgcgtgatacttgcgaggtattggatgatacctaccaggtatcaggtgattcctactagatatagctgggcattccgttgggggaggagcaccccgacatgcgcgattggtcccctgcagctgtcccttgtagacgaggacagcgacggcggcggtagcgggggacgggcacggcagcggcgggggacagcaacggcgaccgtaggggatgggcggcatcgacgggggacaggcgcggcggcggcgggggatgggcacgacggcggtggaggcgacgggggacgggcgtggcagcggcgggggacggcgacggcggcgagtgagcaggcctggtgcgtgtatggataagaatcgcgttgtggaggaggagctatcccgttgggagacggtatcctgtcccctagcattcccgttaatttatactttagcatatttacactattgttttataaataaataatcaaatgttattctaaaagttaacaacattatctattttttttaaaaaaaacggaggtattagtagttagcacctccgttataaataacgacacatcatgcatcacttgcaatctccagccacaaaaaaaaaaaaaaatcgacctcttctcgcaagcacttgcgccaatcacagctcacaagtcgcaagacaaaagccccaaatcatctcactgttgccatggaactctccccaatctcagcttctctcttgctcatcctgatcctgctcgcttttctacccctcctctacttcctctacatgcaccaggatcccaagaagaagcctcgcattcatggactcaagtcctaccctgtggtcggcacgctgccgcacatcatcaagaacaagcaccggttccttaagtggtcgaccagcatcatgaagtgcagccccacgaacaccatgtcgtacaaggcgctcggcctcaccggtggcgtcatcaccgccaacccggccaacgtcgagcacattctcaagactaactttgacaactaccccaagggcaagctcaccgtgtccatgctcgaggactttcttggccacggcatcttcaattccgacggcgagcagtggctatggcagcggaaggccgccagctacgagttcaacaagcgctcgctgaggaacttcgtggtcgacaccgtccggttcgagatcgtcaagaggctgcttccgttgctggagcaggcggggctcgatggacggactctggacttgcaagatgtgctcgagcgattcgcgttcgacaacatctgcctcgtggccttcggtgaggacccggcgtgcctcaccaaggagaggatggccgcgccccagagcgcggagttcatgcgcgcgttcaacgacgcgcagaacgccatcttggcccggttcaactcgccggccaaatcgctgtggcgcgtcaagaagctcttcaacatggagcccgagaggcggatgcgagaggcgctcgccacgatccacggcttcgctgagcggatcgtccgggagcgcagggagagaggggaggccgggctggctcgcggtgacgacttcctgtcgcggttcgctgcgagcggcgagcacagcgacgagagtctccgcgacgtggtcaccaacttcgtcctcgccggccgcgacacgacgtcgtcggcgctgacctggttcttctggattgtctccggccggccggacgtcgaggacagggtcgtgcgcgagatccgcgcggtgcgcgcgtcgagcgggagcacggacgcgacgttcagcttcgacgagctgcgcgagaagcactacctccatgccgccatcaccgagtccatgaggctatacccacccgtggccatcgacacgcacagctgcaaggaggacgacttcctgccggacggcacgttcgtggggaaagggtggctagtgatgtacagcgcgtatgccatggggcgtatggagggcatctggggcgcggactgcgaggagtacaggccggaacggtggctggacgaggcgggcgcgttccggccggagagcacgttcaagtacccggtgttcaacgccgggcctcggatctgcatcggcaaggagatggcctacatacaaatgaagtcaatcgtcgcttgtgtgctcgagaagttcagtctccggtacgccagcgacgccaacgagcgccctcggtccgtgctctcgctgacgctgcgtatgaagtggggcttgccgatgaaagtgaccatcaggaagtaaccaacaagagtgctctcgcgcctcggtggcctcgccttcccggacactcgatcaatgcgggcaagaatttgggacgtgtgtccatctcggtaggccgaatcggtgagcgggcttatgaaagaatccttttaagtcccttatgtttgttgctaacttgttttggcgttgatagattctggcactgctaatcttggattgtagcccaagatgagatgcctcccatacatcacagctctcacatggtactattgggaaaaagtttacttcagatccctcatctcattgtcgagtttcagaatcgtctctaaaccagaatatcagatataacgcatcactatttttgcaaaatcgggtcccaaagtagtgttgaggacggttttggataaaacaaaaattaaaataaataaataaaaaccacgaaaatgtaagtgaaacattatattcctccttgtatatcttcccatcctccggtttctctccctaccgccccatcctcaccggccggtcaccgccgctgcggccttcctgcagctgctaccactgaagatcatcgataatgcggcagatgtcgaggtcaagctcccattcacaggccttgatgtcgaggtcaagcgtcaaaagagtctcttgaggctcttgacaagcagagaaggaagtttttgtgggcggggggagaagccttgacgggtggaaaatgcaaaatcaactggacccgaacctgcctacccactggttccggaggtctaggaatcctaaaccttgagaagtttgtaagagctttgcgcctccgatggctttggcaggaatggaagtcaccggagaaagcatgggtgggttctggtacaccgtgcgatgacaccgataagctccttttcgcggcagcgacatccataactatcggaaatggggcgacggtgagtttttgggagtcagcctggtggcaggggagaaggatgaaagatgtggcaccgctagtctacgcggtctccaagaaaaagaatagtacccctccaacatgccttgcaatcagatcaatggctgctcgatctgggattaccaacggacgtgggctggacaatagagctgattgaccaacttgtcacggtttggagcgccatccagacaatagagttgacagaacatgaggacgaccaaatatcttggaagctcactagccnnnnnnnnnnnnnnnnnnnnnnnnnnnnnaatgcacaactacttggaacaacggccaacaacttcaacaacctaatttggaagccctgggctcctcgcaaatgcaaaaccttcgcctggctggtcattcagaatagagtctggacctctgatagactatgtactcggggatgatcaaatagatccatatgtcccttatgtcgtcgggtccaggagacggctctacacctcctcgcaggctgctgctacacaaagagaatatgggcaaccctagcggaatggacggcgtgcaacaatattcaccccaaccattgacggcaggcttcgtcggtgttagaatggtgggatcaaaccacaagtgtaaaagaggcacccaaaaaggctctacgctccctaacgctcctagtcgcctggttgatctggaatgaaagaaatcgcagaatattccagcataaggagctcccaccgagtggtcttctgacaaaaatcaaggacgaggccgagtggtcttctgagaaattggcttgttccttagttgactagggccaaaggtcctgagttttttcttttccttttcactgtacagttttctccttctatattcaatgaaattggcggctcgccgattcgttaaaaaaaaaaatcacgggccagtttcttgctcctcgtccagcaccgccctatcgggcaagggtggcagcctgcaggtactacaatagttggagctcggcacagggctatgcattggctgaggtggagtccatgcgggcgtcaaggccgccaccatcgccgctagcacatttttgttgtcaagcttcgccgctccccaaatggaggaaagcgtcgatgcggtccctgtctcaccagtcggagttgagaaaaccaaaaaaataaaaatagtttgatttattttgagatacgacatatctaagttgtgttatgttttttaggttggtttatctccggttaaaagacaaaaggaaataaaattcatcggaaatgatgatttatgacgtcttatcttaagcaataatttatgacatactccctttgtttaaaaaagaatcaacttctgataatgaatatagataactgtcagttcagaattattctagaagttctttttagcggaggatgtaccccactgccgcaatccaaattacttacgccacttgcaaaatgacaaattacatttactctttataaatgacacaatattacgggaatgggcccgcgcgctggctgcttaactcgctcagccgccggcccccccccatccgcgtgcgattagcacaagctaattacgattgttactgttaaataccataattaaaaaatacatgtataatttaaaattttgagttatcagttttaaaaatttgggttaaaacttttgaattttgatatgaaagttttcaactagatatgaaatttttttaattttgagttggaagttttgaatttcaataccaaagttttaaaatttgagatgaaaatttttaattgagttgaatgtttctgaaatttgaattggatgttttcaaaaattgagttgaaactttcgaattttgacttgaaagtttttgaattttgagttgaaagtttttgaaatgtgagttgaaagttttcaaatttgagttaaaagttttcaaattttgagttgaaagtttttaaatttgacttgaaagtttttaaatctgagttgaaagtttttcaaatttgagatggtaagttgaaagttttcaaaatttgacttaaaaaattcaaattttgagttgaaagttatcaaatttagggtgaaagttttcaaaatttgacttcatgtatagatttcttatcaatctgttataaaaaaacaaatcttatcttaattattatcattatctaaaactaaccgtattagttagcatgtatccaaaaaaaatcccggaaaaaataaacacagaaagctcaccgagtgacaagggcccgccacgtctctaagtcgctagtacgcgcgaattagcaaaaccgcaatattactccatcactcgaactctgatccgaaaccaaaaaatccacctcttttcgcaagcacttgcgccactcgcaagtcgcaagccaaaaatcacctcactgtttccatggaactctcctcaatctcagcttctctcctcctcatcctccctcttctaccgcttctctacttcctctacctgcaccaggaccccaagaagcagcctcgtgcccatggactcaagtcctaccctgtcgttggcactctgccgcacttcatcaagcacaagaatcacatcctcgagtggtcggccggcgtcctaaagcgcagccccatgcacaccatgtcgttcaaggcgcttggcctcaccggcggcgtctttacggccaacccggccaacgtcgaacacatgctcaagactaactttggtaactatgtcaagggtgaggccatcatcaccatgctcgaggacttccttggccgcggcatcttcaactccgacggcgagaagtggctgtggcaacggaaggccaccagctacgagttcagcaagcgcacgctgaggaacttcgtggtggacaccgttcagttcgaggtcatcgagaggcttctgccgctgctggagcgagcgggacgcgacggccggacgctggacgtgcagagcgtgctcgagcgcttcgcgttcgacaacatctgccgtgtggtgttcgacgaggacccggcgtgcctggccaaggacagcgtggcctcgccccacatcgcggagttcatgggcgcgtgcaacgacgcgcagaacgccatcttggcccggttcaattcgccgatcaagtcactgtggcgagtcaagaggctattcaacatagagtcggaaaggcggttgcgggaggcgctcgccacgatccatgcgtacaccgaccggatcatccgggagcgcagggagagaggggaggcacgcggtgacgacttcctgtcgcgctttgccgcgggcgacaagcacagcgacgaaagcctccacgacgtgatcaccaacctcgtcctcgccgggcgcgagacaacggcgtcggcgctaacctggtttttctggttggtatccggccgtcccgatgttgaggacaatatagtgcgcgagatccgcgcggtacggcgtgcgtcctcgagcaacggggtcacaagcggcgcggcgttcagcccccatgagctgcgcgacatgcactacctgcacgcggccatcaccgagtccatgcggctttacccgccggtgtccctcgacacgtacgtctgcaaggaggaagacttccttccggacggcacgttcgtcgggaaaggatggcaggtgacgtactgcgcgtacgccatggcgagggtggaggacatctggggcacggactgcgaggagttcaggccggagcggtggctggacgaggcgggcgtgttccggccggagagctcgttcaagtacccggtgttccacggcgggccgaggatgtgcctcggcaaggagatagcctacatacagatgaagtccatcgtgtcgtgcgtgttcgacaggttcacactccggtacaccggcggcgaggggcatccggggctcgtcacctcgctggcgctgcgcatggagggtggcttgccgatgcaagtactcctaaccaatagggggcaagcagtgtcgtgctaggccagctgttctcgacgacttcattagtcctgcttttgttgcgtcgctctcggctctcgcctgttcttctactgttagtccttttatcttctccgaactacgaattgttcacatttctgggagctagcatgagttgcatactgctgtgcttggctctgccatactaatactagtggattttaaacctcgagggaatattttcttattatttctatgtcacttaagtagttataaaaaaaataaaaagtaacaagatagattaacctgtgatatattactttacaaacatataagctaaaattaaaattttacaagttataataaaaacaaattaaactatatggtgaactaattgtcggtattagttccgagattgagatgttcaccgagtgggccggaaaggcactcagacggccacaccctctatttctccaattacgtgttcaactgtcacatctcatgcccctgtatggctgtattcatcgccggatcgccccgtcacgctcaatagtcaatgttattgtttacgagtgaccagtcacacatacagatttcgcgttaacagaatcaccagctaatgacgttattcgctcggtctcaaaattaattaagcactttgtttgatattgcttgaatttttattacgaactttttataattgtttgtttaagggttttttttttctgaaatgttttttttccaaatccattattgtttaataaacatgttctatttgcacaataaagctcatgccctctaattagttagctttttgttgcatacttattgcagtctaatcatataagaactaaaaaatgatgcaatgcttatgctaatgggtaatacctttatatatcaacatttttacaaatatgaatcaacttttgtgtaaacatcgatctaatactaaaataggttcctgttgtttatttattcatggattgaggggattcaaaactatgttaaatacatatacttgtagagtccaattctagtgtgcagtgtaggagacaacccataagtgtacgaggctagcgagaacacaattattggatggctaaatataactacaaatatatgcggttatgttgagaggaacaaatatatgtggaaacttaagatgccgcttaagattaagatctttatgtggtacttgtttaaggggttgtgttgaccaaggataatttggcgagacggaattagaatggtagcttaaggtgttgcttttgtatgaaaaatgaaactattcaatatctcttcatagattgtcattatgcaaaattcatatggagagcagttcagttttcttttggttttaatcttccaactagtatatttcatatatttgatgggtggcttttgggggttgacaagaaaaagagtaaactgatactggttggagcttcttccatttgttgggctctatggttgagtagaaatgatttggtttttaataaatcaccatctatttcatatatgcaggtaattttcagagcaacgcactggctccggttttgggcacaactacaaaggtgtgaggatgatggggagttcctaaaggttgcatgctgcaagttggagtcgatggttatgcaattatttgccaattatggatggaggttcacaaatagacttcaataaatgtgttctccttattttggcttggtttcctctgtttttgtttggtgtgtcctatttagctgaactacgctcttttctggattgctacaatgtaataattggctgtagctctttttaagcaaaggctgggatgttaaattccattatctaaaaaaatataactacaaacatatcattatctggaatgagctttttatgattgttcccataatttcatttttttataaaatttttagttaaatattaggaattatgtaatcgaaagtaaccaacccacaaatattttgtttagctagcctgcattgggcatgaattagttacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatatgccctatggtgacaaaaagtaaggactagctggagtcaataggactcctcttatcctctattgatgcactatttttatctcattaaaactggtctactcagtgtctccctgctttgctttctctctcattctagttcgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggagattaccatatgattcattgtagtagtgtttacagtttcgatcgtgtttagttaatctttcttttcatgtctcggtgtatcgtaacacataaatggattccaaacttaattcttcaagtgaatatgtgcatggtgacatgtttatagaaagttaatgtccatatatatggatgataagatctttttaaaggtttgtgcacagagaaaacatacttttttttcatacccgtaaggtatggaatataagcacatagccaccggcaagtatatatatatatatatatgtaccatatactaaaatgctattaaataccgtctaataaagtaatttaaatgttacatagaatatattctagagcacttatgtagaagatcgtttggcactcttcgattatttgagcacattttagaaaactcatgaattcgattgtttcctctaactggcaaaactgcatttttcgatcaatcacaaataaagatataaaattataattgttatggtagctagagtcaaaagccgaccttaaccaaatatgtcattctggatatgtattggcagtgaaaacataaagtaaacatcgattgtgccaatatagcccgaggggcattgtatgtatgtacatacgtgcaccatcccaacatccacccctctgccctcattcatgccttctccccatgtattgtctctcatgttttcatcatatattaatcaggaaccctaatttattataatctttttaaaataaataactatttttattgaggacccatattaactatatttgaacttctaaaataaatattgtattttttgttatattctgactttttttcatatcatttaaataattattaaaaatatgaaaaaaatcaatgatatataccttacctgttgaaaatatttttggtgaattttctttgcatctatgtataatttaggatttattactattaaaataccaaccaaataattttagaaaattccaaaatgatttgagaatgttaatcttacacaaattaaaatttaaattggatctacttaaaaaaacacaactaaattacatggtttgcatttttacatagttcaaactaccgttgtatatttgttaagtaatatttgataccataaagtatatagtttgatgtgattatttttgaaaaattgttgtggagttaattaatacatgtggatgtcatcttacgcaatgtattttgtgctaaaatatagtgaatataagacatccatgtaaaatcataataaaataaatgataattatgtatttttattagtaagatgaataatcaaacacatgctcaaaagtcaatagcggaaaaaagtaatataaaaatatttaggggtatcctaggttaaaaaataacagtagggtgaatggtaagaaaaaaaagggatgagtacgtactacctgcctacgtacgtacgtgtgaggtgttaagtaatatttgatacataaagtatatagtttgatgtgattatttttgaaaaattgttgcggagttaattaatacatgtggatgtcatctgccgcaatgtattttgtgctaaaatatagcgaatataagacatccatgtaaaatcataataaaataaatgataattacatatttttattagtaagatgaataatcaaacacatgctcaaaagtcaatagcggaaaaaagtaatataaaaatatttaggggtatcctaggtcaaaaaataacagtagggtgaatgggaagaaaaaaaaaaggcgatgagtacgtactacctgcctacatacgtacgtgtgagggagggtggaatatgtacgtgtactgagggagggagggaagagtagatgtacgggcagggactggagaggaagggataaactactggttttaatctaatctaatgctgtaaaataatggatccaccagtttaaatgaaaattgagggttagatgtttctcgtctattaaaacgccacgtggcggcttaggagtgtttataggggtgccacgtggcagtttaggagcgtttataggaagtttaatggacttttagtatataatagatagatagatagatagataatagatagatagatagatagatagaagatagtcaaaactttgtctaaaaaaaatcataaattaattctagtgcttataaactaaaacaatttatattctttacctgcaccaccaacaatacaacttttacatactccctccgttttttaatagatgacgccg

SEQ ID NO: 65045 - DNA, 5015 bp, Oryza sativa
agacacagacgaactacggtgtgaaaaaaagaggaaacaaaacaaccaaacaccgtatgaaatatctgaatgtatgaactctctacatcatccataaattttaacttatattctatgtttctgtgttactgatttgacttacccttttctagtgtacatcgagaaggaagatcttacccaacaaatcatagacaaaggcccaccaaagaacgccttaagaggtcaaaagaagacaaaaacgaatggccagacaccgttaaaaaattcagaaggtaatgcctaaccatttaacatttatatagatctattactaatttgtcgtacctatgtagagttgacttaaaaaagaagagcctttcattacctacattaataacaccgaggataacaaagtgatggtgcatattgaagaagtggaggttaaacggaaaaaaatgaaagtactaacacaaccagctttcttgaatgatgatgtaagttcgcctatttaacaagcctactattcttttataactatatttgttatgtaactcaactaaactcaaatttaggtcatggatgcatacattcaatgcctccgctataaagagaaaggaatcaggggagatggcaaggccttcctagagatggccattaaaacaggtctactaaatgtagagggagcgcatgtcgaagcaagcgaatctcgagataaacgatggattagagatatggcacgcgactatctaccatttgacatggtaatacttatttaagctatctatgtaatgggtaattcaatttatgactcaatcttactgttgaacatctgcagattttcctcccaattaatattaaagatacacactggtacctagccgttcttaacgccaagcgacgtgaggtgcaaatactagattcgctcgcaaagccaatcagtaaagatcgacccgatctaaggcgtgtggtaagcgatgcacttccacttgtataattcaaatcggttttgctatattttaaccgtaccaacgttgcacaaaacttcccagctactagctatcgagaggggattacacgggacagagaatcagcacccacagttaaaacacgattggcctgatttcaatattaccgaatgggagtacaacaaagtccaaaaattgccaaagcaaggagacgggtgggtgactcaaactcttccacatgatattcacattattcaattatagaaacgtgttatcctaacgactaaattcttgtagcgtctcgtgcggcctgtacacccttaagttcatggagcattggactggatcttatctcccaaaaattcaactacaggtaactacaacaacctctattcatattttgcaccactgcttcctaatacgaaaaaccatttaaaatgcactccctttacattatgcagaaggaagtaaaaacatttcgacaggacttagccggaattttgatcaactccgaactgaacaacattaaagatcgtccactgctaccaaccacgacataaatggatcatctgtcatacatttaccacaattaccttactatgctctcttacccttattaaataatttatatactacttgggtattttatggatcccaaacattgatgcctttttgagataatattcatagttcatatttcaatccatttgagaaggagcggtatatgaaaccttacgcttcggggtgactcagcgcagtcagctgtcgacgtcaccgacgtgcgtctgctacaatgtcgcacctgaacaacgataaccccttcgccggcatgcggatcccttcgcgcatgccacccttcgcgcatgccaccgtcttgcaaactgaccctgctcccaaccattcaatcaaataatcaatatacaatacaatggattcaagaacaaacaacctgtgaaatttgattcctacaaacactgtggaatttgattgctatcatgctatgatcaccacctgtatatatcatagattacatccttccagagcctggtaatcatagaagaacatagaatcaaaattccatactcacaacgactgatcaacccagaaatctcagtgctaatttgcacttggaaggtgatagtgttatggcaatccacaatatctgcacttgaaccataatatgaaaaaaaaattaagtgcaatgttgtcctgtctgaacaaaatggaccaactttgaaggaaaaatattcatgcaaatatggtgatctggacaaattttaattttaaaatgctattagttcacatatatcttgatctataatatgctccacaaatataccaaataaccaatgcagattacctgtcgtggatcatgtacaaaattcaaaatacaaccacagttttttgtacacagtgaacattaatgttgtgcccattcaactataatttttaagccaaccatagattcatgcacgtctggaaaagaaaagggactgcataatcattttgaaagactatttaacaattgagcgcttaatttattgtactaaatcaaaccgaggcactaaataaaacagaaccaagcattagctttcaagcacatatgcagaatgtgagataggtcagaatgcatggaagcaataccgaagccatatcaaataggaagcaacggctgcagccaacatgcagtcctcaaacagtccattcatctggtggatcaatcaaccattcaatcaaataatcaatatacaatacaatggattcaagaacaaacaatctttatctgcaaaatcataacagtagtggttggtatattaagattggaggattcagaatgtacctgaagctcggctgtctcctctcgattccttgcatagtatctgaacactgaagagggaaaaaattgaaacttaaccaaaaaaaactgcaattcaagacaatagaattggtgaactgtgattaatatgacccagttagtagtactcctactaactaatggagtatcgcttacactgggttaaatcagttgccaagggcatgttcagacttcagagaagggggcggctaggtcgatggcgacagcggtggagtggagaagggtgcgtcggtccatggggaggataacgtggcggtggtggcgcggggaggcgacgcggcgaagaggactcgtcgcccgccggcggaggcgggtggaggggcgactacgtcacgcgacgagctggacaagggggcgggggaggaggacggcgacggtgggggctcacaagccggcgctgagacgcgggcggaggagaaggaggggagggcgatgaggaagggcttcgacggagggaagccgccgatatcaggggaggcggggaggcggacgtcgacggaggggcgctggcggtggagaaggcggcgaggaagggcgagtgtggcgagggagcgtagaaggcgacggcgctggacaggcgacggaggcggcgagggagatggacggcggcggaggtggggatggggtggactggtgacgggaagtggtgacgagaggaatcggataaggatagggtgagtaagagaccgaaaaaatacgataatacccctacgagattttttttctcttgacgaaaacacccttccatatttctacttccactaatactggtgggagtagaattagatctcagccctacaattaaatacgaccaatggcccatattaatttctactccgagtagaaagcaccggagagggactggactacacgaggtttggctcgatgtgcttgactcctttgtgtatgctcacttatactacctttgtgtataacgttattgattttttttctaatatttgaccattcgtcttattaaaaaaatttatgtaactatcatttattttgttgtgacatgattcatcatcaaatgttttttacgcatgacataaatattttcatatttgtacaaaaattttgaataaaacgaatgattaaacgttggtcgaaaagtcaatggcatcatacaatacggagggaataccttctagaccgatcaatttgggtgacttatgttgcaaatccatggttcaggtttgggtgcgggtggaggaattgtgcggccaatgcatagctgtagggggtggatctggtttttacatgataccacttaattatgagaaatttgcatgatgccacttagctatgagaaatcgctccaatttctctcagttttatacataaaaaatatctacggcccatttgcaattcgatggcaaaaagaattaactgattttcagactatttttagtctggtggcacatagaccgtcccattgtttttatacctgatactcccttagagcaagttcaatagtatagcccactagtaactccaattcatatatagtcaatctaatagctaattcatacaatagttgcttactataatattaatatatggtctcacctgtcatacacacattacgtcttgaagtctgtgctgcagctggctacaaatctgtagcccgctgctcttctctctcatcgtttatcttattaaaatatgtttgtagttagctaatagagcctgctattctacctgctcttaaaaaaacttgaaatatatggatgaatttagactcaaatcaggaatggaagaagtgacaacgccctcgtttggcttcccaagtggcgcacgggcagagaccaaattttctttgttttgttaaagactcgcatatcaattccgtagcatgtgttggttggagtaggctttgccactaaaccctttctttaatgcgatcgatgggactagacattggtctcttaacaattgacagagattctctctctttttactacagtataacaattgacaaaagttcatgtcctgtctgttgacaaagatgccatatgttctgcctcgtgtgtcgactgtcgagcacggtttggatttgcacgacgactattttggcccgatcctgtagctgtacgcggctcgatgtcaatcaataatgtaagcgactcagtttttttttctctttccctcgtcttgaaaattagcgaatgtaggccgagtctagttccaaactt

SEQ ID NO: 65046 - DNA, 1116 bp, Oryza sativa
tcctgcacgccccccaaatacaagcacataaattatttataaagagaaaagttttagactgtaatgtatgatggtttataccttatatttcatctgaatgcgtcgaaggttgacctcgcattccatggcctcccgttttgtctcttccctctgcgaagaatgtattatttagttgcagaagtataatttggcatgttaatgctgatgaaccaccgtaaggccagttcattcatgaactaaccttaaccaaagcatccataagtgcctttgcctggtccaagttgcgccgtacctaatagaaattttcaaggtagcattgtgagaactagaataatgaaaaagcatatagtacttaaaatgtaagaattcaaaagccacagctaaccgattatcattcacaggataagacaaggaaatgatgtttcagaatttaagttatacacacaaaactagcacagcactcaagttgagagctatgtataaaatagaaacagaatgaagcaaaaagcccttaaagctaaaaataaagaaactgttgggactttttctctttttgagaggaaactgttggaatttgaaacaaagaaaagtggcaaatggcaattattccattcaataacatggatattaaattaagcagaacaaaccaatcatttcaaccaagataacagaagttctccccaaacaagacaactatagcaagaagagtttgcattaaagttaaaattatttacagaaagaccttcttgtgttcatttctctagagcaactacacagctaagttcctctttgtcaacaaacaatagcaaatcaagagtgcacaaaaaagaataaaggactagagttttactaattaacgtgcagatgaaacatgaaaaatattgaaaaacagatttctccatatcaaatcttggtaatcttgagacatgatttaacaaattaagagcttcaacagtgtaagcagacaaattggtttataatgcttctagtaaggtgtaaaaactgagtacattgcatagacctcctccacaataatatagtaggattagtgtttatcatacactggtacactgagaacctcatcaagcagaataatgaacaaaatatcttcaaaga

SEQ ID NO: 65047 - DNA, 2808 bp, Oryza sativa
cgtagagtttttattaatttgtgaaaggatggtagtgtcaatatttagttccagaaaatggtgtattgtatagttggagttagcaagagtaatcgtctagctcatggttttgggaaaggattttggtgttaactattttttcgatcagattatcaaattcaaaactacaagtattttcacccgaatgttgttcgtgaacccgtgaactttattagcttcaaatgtttttattttctgatacaactcacatgctattttattcaccaactttcgttgtttgtagatttgtattactaccatatgaaaactataaacatgtgatataattattattcgtgctatattaaaatttttattataaaggaattacacttaataattatttaacattatcttactgtgtgcttttaaattggtttataacttttacccgttgcaacgcacgggcatctaactagtcaatataaaagttgatgtagacaatatttatataagttccataagaaatctatcaaatccagtgttttaattcgttatagtaattacttaattaattgcatggtaatgtaccaagcttttttttccctttattttttctatggtataggtgaggatataataggcattttaattctactatgcatgcgactatgaaatgccatgtgtacgtacgtgatattctttttacagagaactactgaactttaacaacttattacattcgtcctaaaatatgagcattttagctatgtatctatagataattatttatttagattttgtagctaaaaatatttatattttaaaactgaggaagcacttaattaaccctataacgaaagtgttcgcccgataatgaatgtaaatacgtaatagtacacgtataaatacatactccgtatatagtacatactactcctacttagatacacgcatgccggagtgttactcgtctactcgatacgtctcacatcatatccgtcaagcctgggccacacgatctgcccccgcgccccatctggacggacagaatgtgagcacgtacacctccgcgtagcacctcgccgccgccgtgtcgtacgggtagctgacgtacgccgggcacgcgtcccggaacacccgcgagtacgcgctgccgcggcacgtctccgccgtgccgtgcgcgccgcggcagcagaacgcgtccgtcccgaacgccacgcacgcgctcttgcacgccaccaccgccgccgccgccgtcacctgcagctccggcgggcacaccgcgttgacgttcttggcgcagccggggatgacgcacttgcgatcggcggcggcggcgccgggggtggggggcttcgtccacacggccaccggcaggttgtagccgtcgacgaggctgacgtcgtaggagctccccttgctctggtcctcgtggaggtccacctcgacgagggtggccggaggggcgccggcggtgccgttgcacgcgaggcggccgccgcagtcgccggtgaggcaggacgcggcggcgttgccgtggtggttggtggcggtggaggtgaagttgcagccggtgcggccccagaagcggccgttccaggtgggcggcgcgctgacgcgcctggactggcccggcgggaggaggaagccgccgccggcgagcaccgggtggccggcgttgggcgccgccgccggccacaccgggaacgggcacttgttcaccacgcggaaggtgacgccgcgcacgagcgccaccggtcctgatcatcatccacagcagcacaacaaaattcatggaaattaccaatgctgaaaagtaaattttgccaaaagaaaaagaacgtaggtgggtgtgatttacggtatccatttcatattaaaagaacgtaggttttattctctctctttaacagagtttataaaaatagctagcaatttcagtttcaaataaatcagacatattttattgtagattttaatggaactaatttaatatacaaaagccatggatgtgatctacttcctccgttttacaataagttcaattttcctattctccacatatcaattaaaacctaaaagactaaaatatcttcactttatcaatcctgatacaattattttttgctttatctactcttaatgtatccatctcctaattttacaaactccaatataataatgactaaaaataaatttatttatgataaatcggagggttgaaaagtaaacttattctagaacgaaggagtacctaagagagtaatgagcaggagtagtggtaggggatgaacgccggagagcaaggataagcacgccatctgtgtctaaatctatatagcaaaccagagaaactaactaagctgtcatggagatggtgcagtcgcagagagtaaacaagggtttttataccctgcaagagtctgcaaatacaatgatgccatggctaaggagatagctaagatcaatgagcaatgtgccatgtgtgtgtgtgtgtgtgtgacttgcattgcaatggaagcaaaggaagacatgatttggggtagcaggccagcagccacacctggtgcaggcctgagggcaaaaaggttgagtggtgaggtaggtaaaaaaaaaggatttaaaatggatgtgccacaccacaacttgaaaactgaatttaaaatactgctagttcattgaatttcatcagcccattttggtcatttgggcatgcatcttcccttgaaaacattataggagtactttctattttagactttgagcacagatacacaattatgtctaagcagaatttatcggcccagttgactgggctgcaggaat

SEQ ID NO: 65048 - DNA, 2608 bp, Oryza sativa
aaaaatgtagtaataattcgtgaactgaaaagaaaccgtgcagcagtggcagccggatgaatattgtgcagtctggacaaccctagctgaaaccactttagctcggaatttattctaaagtgaattgatttttatcctcttacatactactactcttttacatactacctccgtaaaaaaaaaaaagacgaactctggatttccgtgtccaactttgactgtttgtcttatatgaaatttttttataattcgtattttcattgttgttagatgataaaacatgattaatattttatgcgtaacttatctttttgtttttttttcataattttttcaaataagacgaacggtcaaacgttgggcacggaaaccagggtttatcttttttttgggacaaagggactaggctgtgtttagttcacgtcaaatttagaagtttgattgaaattggaacgatgttacggaaaagttggaagtttgtttgtgtaggaaagttttgatgtgatggaaaagttgggagtttgaagaaaaagtttggaactaaacaagtccatactcttgatttacaaatcgagaaatttgatctttttaatatttctaaccaacactcttcactattacattttatatagggatgtggccatgtgggcaatgtttttattttagaattgagggaatggtaaccaagcaaatcctcagtgtttttcaacagagaatggcaatctatctgcaatgtagtgaaaagttcgtatgtatcagtacaagctctgatcttgtttcgtccaatcggaaactagcgtgtttgccctgttttatccgtctattttactagattatttttacaaattatttgcttcccgctcctcaaattacattttaaaataaaccttttctactatatttgcttgaatcacttgttttaatgctatttgttaaatttggtttttaattatttaattagtcctacaataaagtgaataatccggtcaataaactacctgaaacgtgtcctatagtaccggggtgatcaagctagccctacatagatgcaacacaaacacaaaaataaaaggaaacccaatgcgcacatgcagacaaaaaacgagcaaaatgatgttgcattgttgatttcttgtgctgtcctcattgtgaaccagctgtctctccatgtatatatactgggagtaacaacaagtgtagtgataaagtttagtctatgcataaagtaatttgcacattgcttaggatctagcttaacaagcatatttttttagcgagatgcatcgatcagggcttgacgagtaattttatatgtcggcaccgaaaagttaccatggctttccggtttttcagacctctcgcttggatgctctcactactttattcagacatcatgttgagaatatacatgggcatgagtaactcggacagtatcatcatgtcataaggctctcgcctagcgaaaaaacagagctcattgtttgctcaaaacttgttagccacggtcaatttttaaagctaggtgagtatagctcaattagttatttttttcttaaaccaatccacataaatttaaatcctaaactcgatgtggtgctcgtatttacagttaattatttttttttataaatgatgttcatgtctatagagttgtttgtgtttacttcatcaacttcaagatatgccggctgagttttccgaaggtgttcataagaatatggtgtgcgtgtgtgcgtccacaaggatgaatgtgcgtgtctcgtgagcgcttgcatttgtaccgtgttttttaaaaaataaaatttaaaaattgatttttattttttttatcaaagtttatttttcatcattgaactttgagtcattaagaacacatgtagagaagttttatccataaatattttttcgctaaacaaactatggacgaaacgatggggatgatgttttaaagggcaagaggctatcagagttacaagcagagaaacacgttgaggtgattgtgaattggtggaagagacaccgagaaactaacattaccttggcagggtagcgtcgcttttgactcgtgtagtaatagtgtagcttgagcatgagagtgagagccatagacatgactgagtcaagtggtcatcagtggtcgtgatggcaagctgcagtgcctcgtgtgcaccatacctcctggctcagtcccaggcctaaagcttttggaaaacccccttttttttctttaaaaaaagatactacaaattaagaaaaaccttttcaatagctaaaataagattatttttacactattttatttttcctaaaataattttatttctaacaatcattgcattggggttcatgacaatagccatcccaaaataaatttatttttttatccatggaacacatgccaatacaaaagtaaaaagattagagtatctctactttagcaaatctcaatgcaactatttatcactttatctacttctaatataattattacatacttttacaaactccaatgtaatgattactctataaacgaacttatttgggacaaatgaagagatttaaaaatatgggagtacttaatatgggacggaggaagtaggaagaaggt

SEQ ID NO: 65049 - DNA, 18424 bp, Oryza sativa
tcaacaatcagttttggtattttaacaggaaaatggcaaattactaaaaaagacacaccgaagaaattgtactaacctgcaaacgccgcagaataggcttttgccatcgttccctctgataaaagaatgaaaaatgaatcagcaagcaaaaggaattatgtaaacacaattaaaactaaatatctaatacgctaaataaatatacactacgaaaaaaaaggctgagaccatgtgaggaaacaacaatgtgacttgttacaaaaactgaaaatgtaagcatatcgccaccacaagaaatttgttgttgcattctcattttagagaataccttgtctttccaataactatatacagcttggaaaactccataccgaacagataagtactgcaatgcctgcacagagaagcaattctaagcaaacattgagaaagaaattaacaaaattacaagtctgcagtaaccaaatagaaatagtgggaaaatggatttcttcccagaaatcttgaaaatactagatccagaatcaagtgaactacaaattcaacaccagaaaagatttccattatatttgtttccgctgaaaaatcttatctacatcattgtcttgcaatccttacaatctagtaaagttatatgatctctacactagcaaggcacactaaaccaaaaacctattttgatcaatatattaatggaataacaacttattcacatatatcagcacaagaaatgcatgaaatgtgaatcaatattagcctatataataaataatcaatagttattaactatagaagaagatatttctacaaccttagacattaatctttcatgtatcctttcctaggttgacctgactttggcatggaaataatggttacacatctaccccaacatcaccattaagatgataatgacattcataatcacaatatgttgaattagtgtgttatgttttaatttacctgtattctagaaggtaaaagtttttatgccctgtaggacttctactatcatataatacataaaccacgaacattaatttaaaacatcttgacaacattataaggaagtgcatgaagttgcaaagaatgtataatcatgcagaacaaatgacgtgagtgtggtgaatccaaatcgactttctgtggattcttcattgaccacggcattataaaagtagcaacagtctttgggtgaggcatccaaaagaaaagcacaaccacagaaagtgacactatactacaacatatcaatagaccaatatggcttcataacatagcaagtaaagaactgcataaagaagttgtgtaaccatgttagtaatatctgaaaatgcagctgtcacgtaagcatatgccaatgacatgtgacgggagttaggagaattaaaatttgaaaaccacacaatgtttactgggatgtcaagtctgaggtggaacaacatatatcacttcaagataagtgtgcaaaccatgtgctagagccagttcaagggatccctagaccataggtaacatgtcccaatacaattgacacatcatgatggttaagttattggaaagagttcatgttgtaaaatggattaaaaacaatgagtcgttatctcacagttgatcatgatgtcaatagataaggtatgattttactacattaacaaactatacatttcgcttgatgtttatacaagtatgcctgtattgcaaaatgcatgcacatagatccaaatgccaatattataatctcccttcctcttaaacatcatcctatcagtaacatgtaagattcccatttagcatgtggctttacctccattgcagcatcaagctgcaagaggactggtacaggtcctatgaaagttggtgtaatggctcctgctctttctcgagctttgtggtccaaaatttccaacttgaataggaggacttccaacctgtaatgtaggaccatttcaaactgtagcaaaaatacatgcttcacagggggaataacatagtggtgtctcaacagatttcttcatattcaagacagaaaacgttaaaagttaaaattattcccccctgttttgtattgtcagcagttatatgacgtacataaccagtaagtttagctcttgcaaccaaagtttcctcagaaatactacatgcaattctaagttcacatgttatagcctatgtcttggaaggagaaacgtttctaattaaaagtacaactagaaactcctgatgttaagttttagatttcaaatggtgcatacttcagttataatgaacatttcaactataactagtaaaccaagtcatctagatctccagaactttcttacttttcagggttaagattcttccgctcattgttgaagtcttcaagccagtcttcatcttcattgtccagatcatattcgacaaattcaccaatctcagccctggctgcggagtgtaacaaatcttagaacagaggccataaacaagatattgtaaaaacaataccagagcagtaggaaagaaacctcctcttccacgtatataacaggttggttgtgcgaaggttcgagtgtagtccctttcataggtgtccacagcatcaaactgaggcgttggtatctcttgaatgttcttcttagtgggtgttggatttccctgcaaagagaagtaagatcacccttttgaatagcatgatgccaactaaaaaaatatatggccctctgaaatagtggttgctctgtccactactctactaaaagaaacgagtacagcaacaacacaatgtgtggcataaatagtttttttcagaatcttagcagtttcaacaattttgattttcttttcaaaaagtaaggcaaaagtaaccctactgtttcatttatatagaaagataaatttaaatattgatagaatgaagtgtattgttgttgtagggttgcaagctatctgagacacaattaaagccaaacagcgcacatatctaataggatcattattgcaggttcaagaaaaggttatattggctagttgcacagttaaatgttgctagccaaatacaggtcgaagtacaaaacctaagaaatgcaaagtgagtactaatacaggaaaatgaaaagagctaatttcactgctccaaatagccgttttcttattcgtaacacatatgactgcaaacctgagattgtgaaatgaatcaaatgactattcattcatgtacataattgagctgaattcaattcaacttgctaataggatgtagaacagaacccagcaacttaagaaagctagcaaaatgcacccaggcaacatttcaaagaatcgtggcacaatccagtaatccagcactatgaatcaaattacctcgccctccgtggcagtagtagcagcagtgagctccggcgcggactgccgcagcagcacccctgcccttgcgaccgcgaccgccgcggccgtggggtcatcgtcctcgaactcccgcgccgacttgaggatggggagcttcttgtggatgtcgagcggccgcggcctaaacgagagcctactcatggccatcaccaccaccaccaccaccaccgccaccccgccgcctcatctcatctccacctcccccacctcctctccctctctctccacccccacacgcgccgaccgctaccgccccgcagggtcggggcccaaggaggggggagcgcgcgcgggcaaaccctaggtccgcgagggccccgtcaggcgggggcttgggttccggcggccgcaggagccgcgggggggcggcgtgaagggggaggagagaggaggctctccgcggcgagctagggttagggttttggaggtggggaatcgagtttctagggtttgaaaggaggttgaaagggagggaacgacggagaaaggggggttcgcgggcgacgaagggtggccaggccggcggctcgagctcgatgagtcgaggccgtacgtgtacgtatccgtatgggcgtaatggtgtccgtacgcatgcgtacctaagcaagtgtataaaggttttttttttcactagtagtatgcccgtgctaacgctacggtaatatttggtaatttatcctcaaccaaaagacgataacagtatttatgtacatagtagtattgttctctaaatcaggatttcagttgccaggaataacactaattatattctattatgattctattcttttttttttcaaatacaccattgtcgaagcatttttttcccggtacgtataagattgtgatatctctatcgactatttgcgcacataaatgtaaaacatgttctgacagtgcaaaatatggatggcaaccataatttaggtagggtgaacaaaacaccagatgtgatattctttctagcaagtaaaataataggcaatactaccatatgctatgattcatgcgttaaatttcatacaaataaaacaaacaaaacaaagagagagccgacaaaaatggttgttcttgagtagtttctgcaaataaataagcattcgctagacaaatgaagagatagagagagagcagagagactctgcgagtaggaagcaatactatgttgtagcaccagcctcttctccttttgcaagtccaccttaagatagcctcgtttaagaccgtatataataagctgcttataatttcttatagttgctgaagtcgaagaatatgtgtgctaaacaaaataaagaaagtatgtgctacctgatatcgataaatagataacctacgtgtgcatatgctaaatattccaattaagtggcatagtagctgagaaacaattaataagtaagggaaaaagtccaaataccctcctaaaatttatggaaatccgtctagcaacctgaactttaaaatcgacatccaacccgcctgaactttgccataccatccatattaccccctaaggtagtttttgatgatggttttgtatattttggaagtttaaatgaacaattttgaataactaatataacatatttgaatatgatcagttataaatcatcaatttattcttatacaatgatatcatgctattattatgttgatacttgtttttaagtgatagctaataaggagcaaaaagaaatatttaagtcaaaattttaatatatatgttcgaagtgtatgacatgtgatcaaactcatccaacttatatacaaattagataaaaactactatgcaaatcatccttggaggttatataaacggtattgtaaagtttagggggttgaatgtccggtttcaaagttcagagtgctagacggacttccatccaaaatttagggcgttatttggactttttccattaataaataaaaatgtagtacagctctaatgatattgagagaaaattcacctataggagcattcatgcatgcgccatgatcaatattacgagaaaattcacatatagttagttgcccgtgcgttgtaacggaatcattttacagtccgatattcagtttattgcaataacaaaactgacaaaagaatagtatgtctgcgaagaatagtatgttagacatgatacctggagtacttttcccaatagatatatcactgtactaacttggcaataaatgttttaaaaaatcatcacaaaagcttgcaataaaataggctactgaaatgattgttcagattagacatgtgatgttttttgacattacaattactatttcttccgacgaactaaaatatagaggtactggtcacatcctttgtcatcgttacaagctcaaagtaaccgacagtgcacaacataaggaccatgacagtaatttggttagtacaggataaaagttttcctttaaaaaaaacaatgacaagtgttcctaagaaaaatttgctgcaatgctcctccacttactttgagcttaatggtaagtgcaaaattgttacactgatatgatacatgcataggtgcaccaaatttgcataaaaatatgaaatttgccaaacaaggctataaatatgaaatatgccaaatagagactacttgagtatgttgaaacttgcaatacatgtatagatagtggttagatttgtttatatatgggtgagccaacatgatgttaataatgcagaaactcttgttgtgttcgtcttgcagtagtgtaacacaaaatataattttgttccattagtgataatgccttcaccaccataaaaatgcaaaacaaagtactcctttcggcatttcatcaaacatatgtcatgcatgaccaaaattgcaaaattgcccgtatatggtagtaatgatcttgacgttacccatcttgtacagagaagacctgcacaatcaaagtagtaaaccaggagccaaaccgccaaacccatcattaacacccaagaggtcaatatatataatcagatagatctgcctccttttgcaaagaatgattttcacccgttgttgaggaagctgacgaaggcggcgacgggaagaggcaggaaagaagtagcagctgaggcggtggtcgtcaccgaactgtctatcgagttcttagcctctcgccgttttctggtgctctgtagcactgttcggggtggacgcggcggacgtcggcagagggtgtagagtcttgactgagaggcgtggtcacggcctcacgggtggagaggatcccgacaacggcaacggggccgtggaggacgggcttgggcgccggtggagacatttccgatgaccgcacaagggcgcggagcattggaggatgatggcggcttcgggctagggctaggcggtgcggcaggaagggggcaacggtgaatcggcaacggcgctagggcgagcaggcgcggagggcagaggcggcgatgagaaggatgggatcatgggattgatgagggaggggtgccggaggagatcagcgcgatgggcggaggcacgcgagcagtgggggtggcggcgaagaaagcgggaagcggggtaggaagggggtcgcgatggagggcggcgaaagggaagggagcgcgcgtgcgaggtgtgacggagcacggagagagagaggatggatgcgcgatgtgagcgtggatggggcgtcctgtgcgttgatttggtgggaggatcctccgaaacatctcagccattaaattgttcaggactcaccgccaccactacataatttttaattagtagagattttgttcgagtataagtattacaccctccatcctaatatataaagctctgtttggttaatgggatagaaaaatgttacacacccaccaaaagacgtctctaaatcctaaccgttcattcttcctcttccatttaatcttaacccttcatttatttctcaatctcaattccacccctcatttcacattatccaaacacaccctaaaggttcctttgaattgcaggaataaaaaaaacgaagaaataggaaaatcacaagaatttgggaaggtggttaaaaacaggagggatttaccaaaacacaaaggaatgtaccggttttgattgggaccgttagaaaaaacacagggaatcggtatgtagaaagatagactcgaaggaaattttccaagaccgttgatctcttgttaagtttcctccaaaatctttatagattgttcattccatagaaatttcaaaggattggatggattcaatcctttgattcaaaggcattcataggaatttttcctataggattaaaatcctctaaaatttttatgtttttcctccaaatcaaagggaccctaagagactttgggatcgacatatccttcgattagccaagcgaatgaacacgagcgattatataggttcaagccacccggaggtgtaaaactctacacatgttttttttgctatatggatctggaaagtacaagctatgcctttttccaactaagaaacaagcatcctttttcatagcatgtctccttccttttatagcgtaaggaggggttcaccgtgttgttttctacttcccctccgtattgtctttcagctgtcttgtcaatgttggctgatgtcgagtgattgctccctcagacagcggggagtggagacccattctctagagtgaagatccgaccagggtgttagtcggcgagaggtgcagggtatctgcgttcgtgatggatttgcggggcccggccaccccgcgaggagagggagactggagtttatacagattcggggcacccggaggtgtaataccctactcctgtgttggtgttcgttgtcttccctagatcagctaagtacaaaggagacatttacaggctacaaagtgagagtactgatctaaaagaatccaacccttcatccgtatctggtccccttcctttcatactacaaggaagggctcacattattacgaatctactcttagtcttgtctcatcaaccgttttgtcgttgccaactggttccctaacgcaggtctcaacacagttggagctttatccagaaggtttcactgctttttcagattctcagaagctggctaccaaacaactacttttcataatctaaagcttccccaacaggtcctaagtttctgtaaaatcagttgttgctttatgcagcctcactaaaatattgtaaacggctttatttggagctttcccttgtttaatttaccaaatgatttctcctctatgcttttgattaacattttcttatatggggtctcatttgttaaaaatgccctgtggtgcgtcaggggcagggctggctgggcggttccaaagttagccagacaaaaatttgaatttcatagatgaaattgactaatttctagcaataaatcggcccgttttggctaagaacaaccagtttgcaaggaatccgaccacgaaaatcgatcaatttggaaggaaaaccgacggatgaaaagtaaatttttcactggtggtactaggtggacaatttgaccatgtaaaacatgttttcaaagaaattttgtgtccgaagtgttgccaatatgatcataccgtttgcaggaattttgtatttttaatatagcaacattgtacttcacgagacacattagtattaggagcatctccaagagcctctccattgcactctcaagccaaattttagccattccaaccaaaaaatatcctctaacagcctctccaactggatggtaaaccctccggctggccaaaaccctccctccactagccaaatttgaccagacaaaactcactagccaatcatgggccccacacgccgtcctcctcccatctcctctccgacttctcgcatcgagccatcgggccatgcgtgccacttcccgccgccggcgccggcgacggcgccaccagccgcttgagctacggcacgaacatgctcgacccagaggacacatgcatgaagtggctggacaccaagccgctgagcttcgtcgcctacttctccttcggcagctttgcgtccctcggcaccgcccagatggaggagctcacccgcggcctccacgctgccggcaagccgttcctgtgggtggtcagggccaccgaggaggcacagctgccccgccacctcctggatgcagcgatggcgtcgggcgacacgctcgtcgtgcggtggagcccctgcgccacgggatgcttcgtcacggggatgacggcgtttctccacggcgagatcgagcagtgcgtgcgcaccgtcatggataggaaggagtaggacgccgggagcgatgcggtcgcccccgcccacacgcgtggcgaggcgcggcggtgtcccccgcggcagctctgacgccggcgagaagtggaaggcgttggttcgggagggcagcgaggctgcagcattggagatgtgtcgacgacggcacagaggagagaggcgccggagctgtgaccgccgccgtcatctgtgccgtcgcccgcagcgacctccgcccgcgcacgccacagtgagcgacggcgtgggcggcggcgaggcgacggacaccacaccgacacgctcgggtagcaaggatgaggaggacgaaaatacaacccatgtcccattaatttataatacacggtgacatggatgaatctcagacgtctatttttttatccaacggtatttttcaggttttcagtacatatgtagtttgcactatatattttttatgtttactctttctgtttgtcattttatcctggactaaaacttagttttgctatgtctctagcttcgggtgtttgtttagtgtaaaaccattctgtaagattggtcagctcattttatttatttttaatttttgtacaaagataatccgttcttagagcatctgcagcgttgggttgaatcgacgggtttggccaaaacatcgaacctagcacactgtgagatgcggctttttgtcagagtaattcgacctccgctgaggagtcgatctagtctagctgattagaaaaaattactacctccgttttttaatagatgacaccgttgactttttctcacatgtttgaccattcgtcttatttaaaaattttatgcgaatgtatgagatataaatcacacttaaagtactatgagtgataaaacaactcatagcaaaataaattataattacataaattttttgaataagacgaatggtcaaacatatggaaaaagtcaatggtgtcatttattaaaaaatgcagggagtatttcgttttgagaaatttttagttggaagtttgaaacttgtcggttctcttttatttccctttcgctgtaagacggtcaagactctgtaagacggtcaagactctgtagcgttctcatttcattaatgaaatgggagagaacagcccattcatcctacccccttcaagccgcatcgtgtgtgagttccatccaaatcttatccaaatattgtgttgtacgtagaagtcagcggtcaccgtctttaacagagccgctccccgctgaagcctttcttgtgcgttcaccgatctctgcagaatggaccagagattgatccatgagcaaacaacataaatcagctctaaagggtcttgtgttcttttatttttgaaacatgcagtatttctgaacttccatatagtccaatcaacaactgcaattctcactaccacaaaatttttctcctttttttaagacaaaatttgctacaagacatgcaaaaaaacgcgtaattagctgaggaacatcgagaaaacgtgaaactgcccgaggacactgcaaaaattgtgtaattggccgtaggacaccgcacgcattattttattatttcccggttaaaagttgtgagtatttttttgaaatgccaagactgcccccaatggcagtatattctcttcttcttgttgttggttgctgaagcagtggcagcggagcgcgtcccgcatccgatgtccgtcccagctcgttggtcgttgtcgaatctccatggatgcatggtgtcgttgagcacattgttcgacaggtcaaatagggaaaacaggaggaggtgacgacgacgttagcggggatgacgccggcgcgtgatgtgctcctccgtgactccatcccgatgtgaaggacagagattagggacgtgcgcgttctcgcacggaggtgggccacctgctcggtgaggtcgtcaaggtggcgctgcttccacatccacgaccgccgcaccgactcccctgccgccgacaccgtgctccccccactcccacttgaagaagccatcaagaaccaaacaatcaacggggaggtggatggccacggcgtcaccaccagacgcccgccacctagccgcgcccaccgctgcttgcctcctagctacgcctgccgctgctcgccacctagctacgcccgccgctgttgctcgcgccgcagcccacctcccacccctgcacgccctgtgagagagagaggaagaggggaaggggatgcgcctagtcaccgcacgccggcgcctcccccatcgactgcccacgtcacactcctcgccccatcgcgcgttcccggcgaagtcaacaggaaggggaaagaaggaaagagaaggagaaaaccaaggagagagaaaaggggcaatccgggtatttagaaaatatctcacctcttttgacctgaaaataataaaataatgcgaccagtgtcctgcagtcaattacacaatttttgcagtgtcctcgggcagtttcatgttttctcggtgtctttcagctaattacgcgttttttgcgtgtcctatagcaaattttgccttttttaaaaaccatgaacccacctcgcaaacaagtgatgtatactatggattggtttcaaatcaaacaaacagctcactatattccaaatgagtatggcaattggtcattctagtaaaaatgtgctggtggctaaggtgatggggaagggctagggtatctaagattcaggtctgttgtggataggaaacatttggagtgggttaaactaatcaatcttgtcggtcaattgaactgactggggaggaggataaagtggtctggaaattgactaaggccttgtttagttcgcgaaaagaaaattttttggtgtcacatcggacgtttgaccggatatcggaaggggtttccggacacaaatgaaaaaactaatttcataactcgcctggaaaccgcgagacgaatttgttaagcataattaatccttcattagcacatgtggtagtagcacttatggctattcatggactaattaggctcaaaagattcgcctcgcaatgtccatgcaaactatgcaattagttttttattttatctatatttaatgctccatacttgtgtccaaagatttgacgtgacgttttgggaaaaaaaatttggtaactaaataaggcctaagaatggtatcttcactgttaaatcattttataaagtaatgatgattcaaaatactggctttcaatttaagaatatttggaaatttaaaatccctgccagagtgaaggttttcctgtggctgatgttgaaaaatagcattttaaccaaggataacttgctaaagaggggtggaaggggaaggaggctaaatgtcagttctgttttgaaaaagaaattgtggcattggagcaattagctctttttcagtggcatactcggcatactaccaaatagggtgcctaggagtgacaaaagagcaattgttcctttttactaagagaaacattatacaaattagggaattgtttagctaatggtcttcctcccagccagctatcctcccaaaacaaagttcttttgccattacccacattcttctcacataacattaagaatctctctttaactttcattaaccccctccaaaattgagaatctccaggtcttagctttttctgagataaagtcttttgacctagatacttagctaatatcaaatcttgccaaatgcctttctcattttttaggcgccaaagccatttacccaacagagcaacattcatgcatcctgaatctaggatcctaaacccccttgatccttaggagtgcaaacagtttgccaattaataactaagtgatacttcttgaccccttgatcctcttaccgtaaaaaattagatctgaaaaaatctattcttttctttactccttttggcaactcataaaagacatcatgtataacggcacactgctaagacttgcatttatcagggtcaatctcccacatcccaagagtttcccctgtcaacatcttaattttttctcaattttgttttcagtaggactccaatctacactgtgaattctcttcttatcaattggacccccaaatatttcatgggcaatataccatttttacaagttaaaatctgacaatttaccacttctttttcttgggcccctcctaaacagaacagctcacttatgttagtgaaacgccatagattagtgaaatgcaacccttcccttccgcctgtagattcgacgccccgatttaaccttccctttcgcttctgccctaaggtgtacatggcggccgcactttgtgccatggtgggcgccgaatattgtggcgtgcttggaaccccgcgcgctcgcatctcccctctattgggtcggatcttacgggccgcttcctctggaccaaacaattcagtaaggttatttcaagtcttgtcacatcggatatttggacactaatttagagtattaaatatagactaattacaaaacccattccataatcttggactaattcgcgagatgaattttttcagcctaattacgtcatgatttgataatgtgatgctatagtaaacttttgataattatggattaattaggcttaaaaacttcgtctagtggattagctctcatttatgaaattagtttttttattagtctatgtttaatactccaaattagcatctaaacatccgatgtgatagggactaaaaaatttgggacaatttcgtttttgcccacactttaatctctaatattgattttgtccctactttttagggttttcgtttttgcccccacttttttttgaacggaaagatacttttgcccctgttttggatggaggagttaatggtgttaaataggactatataccctctcccatatctattcattaattatgtttttgccctcaatccctcattagccggaacagaaagttgagatttctcatgtagacctagaaataacaagagttcaccagaaagctaaaacgtctatataatgcaacgttgtacgttaggagtaaatttgacatccacggaacaatgtaaataattggacacaattggacattgcagaaaatttgaagcccaacctcaaatgcttcaaatcgcacacagatttcatatatatggtactccacaatataatgtcagacagaaatactagtatccacaggctaggagaaacacaaaacgagaacggaattcaacaaactcctgcaaaggagaggcgagatccccgctgctaggcgtggccaccgcggccgccgccgcggcttccctagcgcggaggagcggcagcgccgagacgccgaggagcaagccccgccgcgccagcacgtacaccgccgctgccgactgggacgagccggcatcaccagacgatgatgccaagttcgatgcgacgatggccgcgcctctccgcacgcggcctcgtcggcggcagcagccaccggaggacgaccggcactggaacgcgagcggccgcggcgccggcgacggtgcgaggaggagctaccccatcccgtcccccgcgacgtgacaatccccaacccaccaaaccctagcccccgcttcctcctcccctcctcgcggtggcgctcgccttcgagctcggaagcggaagcccacagtgaaaatggctggagggaggggctgcgcctagcccgctctccgctgccgccgccggctaggttttgaccgtgtcctgtgtgcagcgagagaagtctggaagggttaactgtttcccagaggtaaaaaggtaaatcactaattcgaaaaatctttatttccttttttttctctattttttactgccataaatccggtctcactaacttccattcaaattaggggtaaacgtctctttcggttcaaaaaagtggggccaaaaatgaaaaccctaaaaagtaggggcaaaatcaatattagatatcaaagtgagggcaaaaacaaaattgtcccaaaaagttttagccccatctaaacagcccctaaatcgcagaacaaacccacttcactagattctgtttgaagtatgatagtttggccaaagggtttgagctaattgctgaatttatgataatgccttgactgtcctctatggtgcaaaagactcttccaaactccccattatttttatctagggatcatgaaacacccaacgagtaaagttgaccccaacaagtgattcatgtataagcaaagaattgtcaccttctagcatataagtaatggttcatgtaaatgctgcattccttggtgaaattgcattttgcactggcctcagatgaaaacttgcatgttcgacagcctgccacattccaacccaagattgcagaacctccagaattaccaccttgtactacagatccgggcttcagtgacgggttatctgtgacaggccaacacaactcgtcaaagatgagtcatctctgacgggccgaaaaaatatcctcttcaatatatggctactagggaggacccgtcacagatgtgaagtcatctgtgacggcttgcacttgtaacccgtcacagatcacaaccatggctcgtcacatatgacatgccatctgtgacgggtgtagtattatgaatcatcacaaaagagaccactcatctctgatgggtatttaactaacacacgtcacagataacgttatctctgacgagtggtagttatgacccgtcattgatgagtgaaaattcaaaattttaaattttgcaaaaaacctcggattgagacatgtcttatataaaagttgtagttctcgatgatatccacaactttataactaacaacatttctattagagatcatttatatccccgaacatgcattacaagtgatgagatcttacgtttaaaaacaaaattttgagttttttttcaaattacatggatggatacatgccccatatcaaagtaatagaactcaaccagatctacaacattataatcgaaaatattttcatttgacaaagtttacatgttcaaaatacaaatacatgttataaagtgagatctattttgaaaaatgaaattttgaattcttcaaacaatatcggatgaagatattttctatgtaaaagttataaaacacgatgactatttagttgataatattttcatttgaagtcatatttagggtgttaaatatatgttaaatgattcagacaagcatagacaaaataataatattgggtgagtagtcaatatgtattgagtaggtgagttggtaagggagctctctatggaggttgaggtcttgagtttgaatctcatgtttagcatgcaagttatattgcgtgaaaaattgtgaatttgtaggtagtgatgtgtaaccatgtataggatggctagtaaaattcaaaatatttttgaggtttttttgcgtttaaaattcaaaaattgtatttcttgctgtgtcatcagtgacgtgtcgtaagttacaacccgtcagagattagtcatcagtgacggtcaggtagttacgacacgtcattgatgactcatctgtgacgggtgacaggttttaacccgtcagagatgacttatataccggtcagagatgagttatctgtgatgggtgtttcactcgtcacaggtgattttgtcatcagtgaccactaatcactaaccaagaccaaacccgtcaaaggtgagggtttgggcccgtcagagatgacctggtccggcgtagtgtgggtctggaaacttgcaatagttggtatgaaaattattattttgatccttgagtaccaattgatttatgggatatttaactttggaccacttttaaaatgtgtcaattaattatttgccactcactatctatgacatgtgggttctcatgtgtctatgacatgtaggtccttgatttatagcctccacaacacaaaataagttggatgctactgatttgatcacatgatggaaccattttccaaaagactgaacagagttcttcaactgatacaatagtgcaaggttggcaccacatgagtccaggaaactgcaatctgacatttgttgttaaccaccgtcattatctcaactaaataatttgaaaaacagtccaagctgaaattcagttgcttcccttaattctgtgcactcatacaggaagctaattgatgttcagttggctttagtccgttctccttcccaatatcggtatgcatatatcatgcataattgcaattctggcctgagccatttgttcctccccgtagaacttccaatgattgtgtactaacacacccatgttaccgtagacgagcaaacattcacgtaaccacatatcaagtattggccatgacaggtcatagagaacaggcactggtggagaaaccatttttggtcggtcggccgaaatccacaataatcccggttcctctaaaaaccaagactaaagatgatttttagtcccggttggtggctacagtgggcatatttgatctttagtcccggttggtaacaccagggactaaagatgatctgtagtcccagttctaaacctgtcaggccttgtcaggccccctgggatctttactcccggttggtaacaccaaccgaaactaaagatcctaactttactcccagttggtgttatcaatcgggactaaagatcaaattcaacgcttaatatataatccttcttccctatcctctcctctacaaccacctcgcacttatcctctcagatcgatctccctctcctccctatcagatcgatctccctctcctcctccccctccgcctcctccatttgctgctcccatccc

SEQ ID NO: 65050 - DNA, 708 bp, Oryza sativa
attcctgcagccccaaagtgttggagcccttccgcctcctcgtccgggccgcggacgttggccctcgccgcatcgcggaatggctccccgtcgccgcccgccgcctcgccggagatctgttcttggtgaatagtacgaaagattcggagctcatcgaacaaggtacatttcttgagcttccctgcttcgggagcgccacctcgctctcgctggagctagggttccttggcctcgccgtgccgccgtcctgtgtgttcgcccggctcaccaatctgccatctgcggtgtcctcttccatggcccatgcgagctcggcgacgccgtctcctcgccgtagttcccgtccctgaagaagctcaccgtgctatctgctcacaggatgaacaatttcaacatccactccaattctctcgtggagattgtgctccaggggataggattgcaacagttcaatgtggtggcaccagcacttgaattattagatgttaattaccacttttctgatggttcagctcagagtcaacccgtcgccaacatctcagcacctaagctggagattctcgggtggagtactactaatttagatcagagctctgtcaattttggcaagatgtcgtatctcaaagggctgttcatcgcatatttctatgtgtatggagaagaggatcgcaatcacgattgtctaaggctcttgcagcactttcagtt

SEQ ID NO: 65051 - DNA, 673 bp, Oryza sativa
acgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatcagacaggagactgcaggaggctaaagcagcatttgacacaagcatagataatgggatgaccttatttgatacagcagaagtttatggtacagcggtaagaaactagaaaaacttcatgattcctcgctcatattttccttgcgtcaaaattctgaaggttcatttaaccttagttgttctgtccttcagctgatgggagcagtaaattctgaaagtttactcggagggtat

SEQ ID NO: 65052 - DNA, 1757 bp, Oryza sativa
tgcgcatacaaatgcttatttgcatatatatgatacgttttcttatcctacaatactagtagatctcttaatttatactccctccatttcaaaatgtttgacaccattgactttttagcatatgtttgaccgttcgtcttattaaaaaaaattgtgaaatatgtaaaactatatgtgtacatgaaagcatatttaacaatgaatcaaatgatatgaaaagaataaataattacttaaattttttgaataaaacgaatggtcaaacacgtactaaaaagtcaacggtgtcaaacattttgaaacagagggagtaattaagagtttcgtattacttatgcagatgcttgagatatcataatttatgtactactgtataaacggagtcgtcctctagagtaaatttgaaaatatactgttttttttagttttttcacagtaatattcgggatgcaaaaacttgtgcagaaatataccgtcggtgtcgcacaaccattgcgcgaaaatgacgtgggaatgacgtcgtggacgatatcacgaggtgaccgcgcgagaccgcgcggtctcgcgcagcaatggtgcgagactgcgtggtctcgcggaatggcacagccacatcgtccagcgcccctgaagcaatcagcgaccctgtcgaataggctccatttgagtagtaattaattacttaattaacaattaactaataataattagcggttaattatcctgattagcgattaattaatcgctaattaaatcggccagtcacggtatcgcagcttgcaagagcgatagcgctgcttgcttgagcggtctcgctgcttgcttgagcgagaccgcgctgtctcgcgtcatcatcgcgcgataccgcgcggtttcgcacttccactgcgtgataccgaccacaacgtcatttccacatcattttcgcgcaacggttgcgtgagaccggtagtatatttgtgcaaaagattttacatcccgaatatttctaacaaaaaattgaatgaacaatatattttcaaatttaattcgtcgtcctctttccaaccatcatacttatgctgttcccatgctaaaaaaaaacacacattcaaaaaactcgtgttctaacaagtaaaacgaaaaaaagaaagaccatgtaaaacctttcgtcaatctccatcccagatcccgatgtaacacacaagcttggcactaatttagtactataagttttcgtattttttgtcttgatacttaaaaaacaggatgtataccaattgagaagtgcttctatgctccttgaaaaaaacctgcatggaaattaaagcacatcaatggttcggattaaaaggtgattactagtgtaaaccgtcattagcaaagggcaatttcgaccaggaagtaaaagcccacatccagcccaggccgatcgatccatcgatctgggaggtcgacacggcaacagggctagatggtgaagatcaccagatcggccgggcatgtgcgaggaatgggagggcgacgagctgtgagggctattgtcgacttgtcgtcgttgcgctcggcgttgagacagattatacagtatgacgagatataggaccagttctcgaagggcagtgtggtgtggaagcggcagaccagatggagaatggccgcatcctctacggcggcggccgtccatgatgactcaaactcctgcatggtagaatacccgcttcttgtacctagtgaaacctagatagaaatcccaacgattctcctattttttgatt

SEQ ID NO: 65053 - DNA, 1833 bp, Oryza sativa
tatacatcctggagacaaatggcaaaactgtccagacatatcttttgatatttgcgattttcttttgagatgtttgtggtccacaatcatcatcttctgaaacattacaaaggaccactaaaataaatctttctaaatttccaccaaaattatctgagaatttagtttgagttctattgccatgagctacctaactatgatgtagtttgtgttgcagtctgaccagtcgatttctaaccgcggaaacaacagacagatatcggtatttcgagcagtaccagagaaatccaacccacgattgcagccagtgaagaacggagatgagttacagcaaatggctagctatctcgtatattgcatggtttataagttcattattatagaaaccagctcaagttccttttatttttttggcctaacatgttactgaaagaaatgcttcaggtcccggtcaaaaaaaagaaagaaatgcttcaggatgttgatagtattgccgcatgaaattttttgattaaacaacaaatttcttgagtaccttctcctgaactattgactggtttatgtacatgtgatccgtggatcaagcatccatctattttgcttccagttccagatatccagaggtatattatataatatcactgtgccgttctgaatgtaaatcgtgactgcaagttgtaacccattcattcgtggtgtggtcctacacactaagctttttgttcctgcttttgatgctactttactgctttgtgatctcctggtcgcaacagcttgcattcaaggatgtattagtaagggtatgtttgctgcagcttctttcaaaatcagaaactcattcaaacaatctagcttttgatttagattttaagaagccatagttgtagaatctaggaaataaactagaagtcacaagctaaaaaacctagttttttttattcttagaagcttagctaccaacaagcttaaataggcctaaaacaaggtgcggtttgaagttggacttattctggtgacctggtcagcaaaggtgcttagaaggtgccttgtcagctgattaaaaagtgacgcttttgttcgtgcattgatatttctccatgattttctttgtgacctgaacacgacaccttgctgcacgatgcttccaacggcagatacgtacgcacactcgttgggatgggatcgtcacctcggtgtttccgtttcattctgggtcgatctggcgtcaacatgtggcgtggcgacaacaacaacaaagtcgtcaaaacctaggagcataataacgaggaaatcgctcacggctcctccaacagccgaaccggttctagcgaaaattcctatgtttcaaattcactttaatccattggactacagctaattaggaaaaagattaatgagtgagcttttatatttatatccttactatccctaaactatcacggtcgatcgaattatacccttaaatcacaaaactagacattcttcatctataactatgcaaactggacaaataacccccccggctcaatccatggtggttttaatcctacgtgcgcggtagttttgatcctacgtggcgtgcgagaggatcaaaaccaccgcgaattgaaccgggggttatttgtccgatttatatagttgggaggtgaagaatgtctggtttgtggtttaggggtgtaattcaatcgaccactatagttcaggaggccattcatattttttcctttaatttaaaagcacacgaaaaaaactacgaaaaaataaatctctaaattaactctaaaatcacttttaaaattttaaattttgtctacggttcataagccaaaagaa

SEQ ID NO: 65054 - DNA, 16496 bp, Oryza sativa
  unsure (1)..(16496): unsure at all n locations
caaccgggagtaaaaataattggggtctgtcttgaaccccacaacttcttgaaccgggattaaaaatgatctttagttccggttggtaacaccaatcgggactaaagattaaaaagtacccctcaacttttaaactgggactaaagatgctttttagtcccggtttttattagaaccgggactattgtggaatttggccgaccgaccaaaaatgatttctccaccagtgatacctttaaatcgaatggaaccgacttatagtgacaatcggtatgatgcaaggctccgctttcagtagtatgtgtgcttgtgtggttgacacttggttcctggacatgtaccccggtgcacaatcagcctaaatagtcctatgctgcgtctcttgtaaccattttccccttaatcttaataacatttgcattaccctctcctatggccatccgccaactcaaatgaaacactaacattcgatgacaaaaagacttatgtataaacttattgtagaataaccagcctatatgatgtaattgtggtacacctattaaacacccctacatattattgccacatagaaacaccaaaaaaaaaagactataccaacaccaaaagttgattttttttcacggaagccaactactagctccaaattacctagagtcaacttaaagctaactcatacaataattacctataaacatatactacattattaatatatggtcccacctttcatacatattgtgtcttgtaatccgtgctacagctggctacaaatatgtagcccgctgctcttctctctcctcttttatcttctcaatatgggtttatagctggcttatagtctgctattgtactgctcttagtttatataccaagcacggtaataaaactcggtagtaaaactcgtttatactcaaagaacatcttcaaaaattaacgttgctgtgcctgtaatcaagtagtgatcatgaattcatgatcagcccatgtacggttcaagattaagcacacgtagaagtgagaaaatcataattaaataagttttaattattataaacttaaaaaaagatttataagatattttgaaaaatacatgaaattcatccgtttgaaaaacgtgctatcgagatgaaataacggggacatgtcttgtaactcaaattttcctggcataaaaaacccttgcatttgaagcttaattaattagcctaatcaaacggcttaattacgctaatgtttccacacgagctaaccgaaacaaaaactgccacagcgaacaaaaaaaaacttttacgagttttcaaaagttttttcccctgaacgaagtgtataatttacactgtactagccctgcagaaatcaatcaaaattaatacttcctctaaaaacaatcaaatttctaaaaggaaaaaaaaaatcccccgtctctccattcccaatctggacgaggtgaaggctgtcactcggggcccaccggtcgcgtgtgtccggaccgccagctggcacacagcccccggcgcacgtgacgaggcggcccccggcgtccgacacgtgtcgtttcgcacgtgcgctccgtccgggcccaccacgcccacctcccccccgatctaatccgacgcggacgggtgcaaccccccgccgtccgatcgcgatcgtacggctccacgcgcgcggcgcaagtggatagaggcgcgaggccagcgtggtcatttcgctttcgcagataagatcgtggggagtgtctgtgagtacggcgaccgtgagtggatgttttgcggctaaccccctgaggtttcctctaattatgttctaacggatgagattatccgtaagagagattttattttgtttttttttgcgtgtgatttggtgtttagataagatcaagagagaggcatcgttggtgtgagtgacgcactcacgcacgtcattatcgtccaggacatactccccctcctgttacgttttggaaagaaagaaagaatatatgtttgacaatctatgttttttttattataatatatataataaattatttttttatttatggtagttttttttaaaaacaaatttatgtatattgttttaaagtctttaaactaaatagttttaaagttgttgatagtcaaagttagaaaaaataactttaatcctattcaaaacgctaaaaataataaaatcggaggagtatataataagatcttgagattttttttctcttttgcttaacgatgttgctatcgagggaggaaagtagtgcagctgaaaggtgtttaaatccggattaagaaagtcaaggagttcctaccggaaaagcaatgttttgatagtcattatatcaggcgtggttagtacataagtacactgggacttcatgaagaagcagctgggtgctggattttctttgctaattcacgggtaaaagtggaggatgaaaatttggattttcatggcacacttttcaaactgctaaacggtgcgtttcgtgcaaaaattttcaatatgaaagttgctctaaaataccatattaatctatttttcaaatttgtaataattaaaactcaccaatcatacgttaataccacctcattttacgtaaaaaacttaatcttcatcttcatcttcaggagaaatgaacaccgcctaaatcactataaattaaaattactcttatatagggatgtattggtaatgccatgtatttataatatcgtagttatacttttccttctttttttaaaaaaaaaacttttccttgaatctgcccctgttgattccttgtatgtttgaggacaagtgaggttcaaaatccatgatctcatcttaccacaattttacttttagattgattaatttccaagcatgaaatttatttcatgagatcctagaggggatttgactcgtagcaacccttccttctgatgtaaaaagcacaatagtgtttgattttgtctctcatgtttagatggctttggtcaatgtcatccaacagaaaataatagtttcgcagcctcatcgtttggcatattggaggaaaaaacgaaacgacatatttgtaaatgaaaaaataatttgtgaataaaacttttatatatgtgttcttaatgatctaaaagtaaagattgaaaaataaagtataatgaaaaaaaaaccccaaaattaactgtacatatataaggttaaaattttaaattttagcttataaacataaagaaataagatgaggctgtcggtaaccaacgaagcccggttacctggagaagtccattccaattggacgagtaatctccttgggcttttatttctccattttgcctttggcattttgagtgttcacttcgaatttacgttccataagtattacttttcatttagtattctttttcttcttacgtataatttccttacaatgtattggtgtgttgtaagtatcaactctaccaaagtatgaaaacatgacattaattaatttttgacatagacgttaacggttttttaatctcattcaattcatttatgttttaattttatgtctttcagttagctctattcttaatactagttagctctattcttgatactttatgcttttacaagaggagcataataccatacgcagtggagctgcattcttggagtcggtagccaggggtctattttttcactttggctaacatagttcctataaaatattgttatagattctacgcgttttctttttacttcatccgtttcataatgtaagactttctagtagtgaacgtattcatataggtgttaagtatatatgactagatttattaacactcatatgaatatgggcactgctagaaagtcttataatatgaaacggagggagttgtatttttgctgcatatgatcaataaaaaaataggggtttttccatatccttgagtttttttatttataatgagatataaatcatttccattatatataaaaaatacacccacgatctaaggctgccgcttaaatatcttaaaaaaacgtggttttatttgtagagtgcaggaaatgcaatttgacaactataagccggcaagaaaatattaacattggatcggcagtttgggagtagcaaacaacgcttaattatataagtactgtactactactaatcatcaacgccttcttcgtcctaaaaaagtattaggacataaacgcggggtgttctccgcaaaatgtgattattttaatcggtgttgcgccagaggccgcgtcttgagcttgctctctctctctatcactctgctcagctcaagtagccagctcgaacaagaagaagaggagaaaaaaatcgcgcagcttctctccctctctcttacttatagcagcagcagatccgcctcccgaaacccagctctttgtgatcctcaagagccgcctccaacccccaatccacgcgcgacccaagaatccgagaaatttttctgtccagaataagagggtttggtttgattttgggagctccagttgttttcttctcctccttcttcttcttcttctttcttgcaatttgaggaggtttgctctggtttggtttggttctttgttgttgctgccgctgccgcggcgaatggtggcgacgcgaggaagggaatgggttcgttctcctgcgccgcgggcgatctgtcgtgtcgagatagtggcgcgccctgacctgagagatgtttgttcttgttgatttttgtgtgtttgtttgactgaaaggtgctcgtccttttcggaaagtgagggggtttgttcttatttctggttcttgattattattaggattagtttgttcctttgtgtgattcgattccttgccgcgccaaatcttggtttgagatttttctcttttccttttctctctcttggattggatcctttgcctccctcgccgcccattcctccgtgcgatttgagtacttcttggagtgagttcttggtgagtgagatcgagtactttgaggaggatctagaggagatggtttcgagatcctactccaacttgctggagctcgccgccggcggaggaggaggaggcggcggcgaagggccgctgccgtcgctggggcggcgacggattccgcgggtggtgacggcgtcgggcattgtcccggacctggactactccgacgacgacgcggcgtcggcggcgtcgtcgtccgaccactccttccgcccactcccacgcgccgcgcgagcgcgccatcatcgtcgccaaccagctgcccatccgcgcgtctcgccgcggcggcggcggcggcgggtgggagttctcctgggacgaggacagcctcctcctgcagctcagggacagcctccgcgcccacgccgaccgcgccgacgacatggagttcgtctacgtcggcggcctccgcgacgacgtgcccgcggcggagcacgacgaggtggcgcaccacctcctcgagggcttccgctgcgtgcccaccttcctccccgccgacctccggtcgcggttctaccacggattctgcaagcagcagctgtggccactgttccattacatgctcccgctgtcgccggagctcggcggccgcttcgaccgcgcgctgtggcaggcgtacgtgtccgtcaacaagatcttcgccgacaagatactggaggtgatcagccccgacgaggactacgtctgggtgcacgactaccatctcatgatcttgccgacgttcctgcggaagcggttcaaccgcgtcaagctcggcttcttcctccacagcccgttcccgtcgtcggagatctacaagaccctgcccgtccgcgaggagctgctccggtcgctcctgaacgccgatttgatcgggttccacaccttcgattatgccaggcatttcctgtcctgctgtggaaggatgctcgggttgaagtatgagtcgcagaggggctacattgcgctggagtattatggtcggacggttaccatcaagatattgccggtgggagttcatttggagcagctgcggtcggtgctcaatcttccggagacgggggtcaaggtggccgagcttctcaagcaattctgcgatcagaaccggctgatgttgcttggcgtagatgatatggacatctttaaaggaattagcttgaagcttttggcatttgagcagctcctgatgcaacatcccgaatggcgaggaagggtggttctagtacagattgccaatccagcgaggggacgggggaaagatgtgaaagaggtgcaggatgagagctatgcaatggtgaggcgtatcaatgaggcatttgggcagccaggttaccagccggttatattgatcgatcggccacttcagttctatgagagaatggcttactatgttgtcgctgagtgctgcctggtgaccgcagtgagagatggcatgaatcttatcccgtatgagtatgtaattgctaggcagggcaatgaaaaactagacgggatcttaggtcttggcccatcggcacggaagaagagcatgcttgttgtgtcagagttcatcggctgttcaccttccctaagtggtgcgattcgggtaaacccttggaacatcgatgctgtggctgatgcaatggactctgctttagagatgcctgaaggggagaaggtgctgagacatgagaagcaccacaaatatgtgagcacacatgatgttggatactgggcaaacagcttcttgcaagatctggagaggacttgtctggaccatagcaggaggcgttgttgggggataggattcgggctaaggtttagggttgtagcccttgatccaaacttcaagaagcttgcagttgagcaccttgtctcagcctaccggaggacgaccacgcgaatcattcttttggactatgacgggacgctgatgcctcaaacatcatttggtaagagcccaagctctaaaacgatagatatgctgaacagcctgtcccgtgatcagaacaacatggtcttccttgtgagcacaaagaagcggtcgactctagaagaatggttctcatcatgcgacaacctaggcttagctgctgagcatggatactttctcaggtaattattttctctattttacgtaaattcataatcaatgagccaatgacatcaactttattattggactaaaatcagtatgattttgtacttctcattgaattccaactgaacactaatttacacttgtaactgctgtaggctgaagagagatgcagaatgggagacgtgtgtcccagtgacagacagaagctggaagcaaatcgcagagcctgtgatgaaaacatacaccgagacaacagatgggtcaacaattgaggacaaggagaccgcgatagtgtggagctacgaggatgctgatcctgattttggatcttgccaagccaaggagctccatgaccatctggagagtgtccttgcaaatgagccagttacagtaaaagctggcctgaaccatgtcgaggtgaagccacaggtaagctggctcacagcaaagctgtgctgttacctcactagtgttaacatgacccatttctggtacctaagttttaaaccttgaactgttctacagggtgtaagcaagggccttgtggcaaaacggcttttgtcgataatacgggagaacagcctccttccggactttgtcctctgcatcggtgatgaccgctccgatgaagacatgttcgaggtgatcaccactgcagcacaggacaactgcctaagcccagacgccgaggtcttcgcctgcaccgttggtcgcaagcccagcaaggccaagtactacctggatgacctggccgacattgtgaggctgatccagggcctcgccaatgtctctgacgagatgcacagcacaatgcccacacctgtcgacgccgcagacaccgccctgaggtgaaaacacacctgccccagctccacccccaataaggcatgccatcttggaagaagggatcatcgatcgctgctccccccaggtgtacatactcgaagggatgcaacaaaaatgcaatcaaaacacatcatccaccatcttcatccctgcgtgttttcgcatcaaaataccaaacctttcaccggtgtgtacagaaactcggccgagaaattaaccccccccccccccatgttcttctatcaaaaactcagatccatctcaccatcacagtcagatcaggctccaaagtttggccgggatgaatccgcaaccactggagccggagccactccttttgctggcatggtgcaggtgtcaaatggttggtgcgtactaccctttggtggaggcgctaattatttcatcttctttctttcttttctttcgggctcgtgctgtactgtgcccatgtactgctgctgcacattgctgtggggctttggattggattaggtctcttccgttccagcttgtgtggtagcagcagtagttcttgctgccaatgatggatggcaatagtggaggcttgtgtttttcttggtgttatgccgtttgggggttaaaaaacaaagaggctatgatcatgctggtgatgagataaggctataatgctgtctatgttgaattgtagtaaccggctgtaaagagattaatgtgttcctggctgaattgagcaaaaaaaacatttcttcgtctgctccggctgggctaatcatcttctgatctctccgttctgtttgtgtttagttggccaacgtgatatgatgatggattttgatttttgacactaatgctggtcattcctcattttgtagtagcatttagttttctgaaccttggcgatgatactcccttaattcaacaatatatcaatctaatattggataggatacagcgtaattctacgaatctaatatagataatcctttatctagattcataagattggaatgtgttccatccatatcccttttttttcttggaggaggatgcagttttacttcctatttcatggcttctcaacaaccattagttgcgtcattttctagcttaattagggctccgtttgatatttcagttttaaacgcatgtgtaaggcatgcagcgtcgactacactagtggctaccccaagctttgtgtagggtaagataaggactggcttgtgaaaggattaggttaggtctacctgatcctatttttgtttctctccttttcttatctttttgaaatggataggtcgaacctgatataatgatcttgttcatttgctggggtaagggattgttcggtgaaaggattttttttttcatccttctttgaggaatagggtagctgtccatctgtcatttgtcgaagagatataatgtcatcaatttgtatactctcctgttgaagcttcagccaaatggaagcaaaggcagtttggcccttgccatccatgaggagtcttctggtgacagtaattcgcaaaaggctcaccagtaatttggcaaatggctatgcaaagggcttgctcagatacacaaaagttgatggcaaactgttgaactttagagtatattatctttattttttcatgctggcattgtccaatccttgacaacctattatcccctcataaacccataagtttggtaaaaaccataggacttgtgtctgtatttcatttatttgtttagcagcacaggcagatttcacttcaataggagaaagtatatataatccacagattttcgcacaatggacagatgccatgtttatatttcttctggactatgtataaactctacaatgattacatgaaacttttcaaatgttacaacatctgaaatgagattgttgttacaggcataaaacaagaattctaccttaaaagtataagagcatacagcactttggtcaacttgcatgtgtgtatctaaaaaatatatgttgcacatggtaaactgtggactgtggtagcattttactcaaaaaaaaaaagaaaacaaaaaatcgatgtacctgggggactactctataaggctctgtagcagcatctagttccatatcttgacttgagaaaaggctaaataatctgaaccgaactttacactagcatcatctctagtcttatgggtgcatactatcatcttgaaattgtcgactgcttccatatgggtggccagaagttccataattaaatgctacgctaaaacagcttctgtatagaggagctcattccacatatctgtgctatctgtgcagaacaccaaaggaactcttcggattgtgtaaaaaaaaaaatcccctcactgaagtgcagcactaaatctgtgcaaagaggagctcattccacatatctggtataccaggaaggcaccagtgcaagcaatcgttaatccctgttgaagctctacctttgaaagtagaattggatatatgcccctcatctcgtagctgtgaaacagcagttatatccaaaatcttaacccgagttccattcacagcactctccacaggtaagtcgcttgaatgatcctgcaatacctcacttccgttagacaagggaacggtattgccacagcttcccccagtattccagtcaccatttacaaaatgcctgggtgatattgtcctcaggaaagctttcacttgaggatatcgcacaagttctgaatccacccatctggcaatgctgtacaatgtaagattttttgcacggttcagatctgcaagtctacctttgcctacaggtttcccatcagcgtacagttcccagtgatttccattgaacttccctctgttccagtgatgacctgtgttaagtactaacacatcaaaactgtggagatacttcttcaaaaatgtaactggacgatcaagatgcaatgcataggatgtcactgaatctgttgtattcagaagttccagttcagatagactagcagaccagtagaaaaggattgtggaattagtccctggaaaccagtaagcccatccgtcaggtcttaaagcacctggagctttaactaggccatatttccatccaacatcttcaacttctgggctgtatttaccacctgtagctatacacatcatggactgaaattgctgtctaccaagagaatcaccaacaaaagcaagagttttatgcctcaacctgcaagcctcggaaaatgctaaaataagtccagtccttaaggagatccagacgaaaaggaaaattgaagtaaaataccttttcaaaatgttaggccccgtaaactcaggcatctgacatccatgcggctgccaccgaaaattctcgtaagagaaatctgcgcgttgcatcattcgacaagcccacattttcgatagccactgtttgcactcattgccagaatagagtggccgcttcttgtctgccacccattttccctttgcataattgcaatctataaggtaagaagaagattttatcaaaatggaagataatcttcagttgttaaaacaaaagttgataaatgccatttttagaaaaaaaatcactgtcattaggaattgcttccagtaaatgagataaaaataagcatataagtcagtagtgcaaaaatgacaaatgcagtgttaaactcattagaagatcacacaagcaattaaaattactttcgttctgtctggctgtactatcttcaagatgttcctgctcctgctgctgtaggaaacctgatgtcagaagggccatacaacaaacatgtgagcaaacatagcatagggtaacatctacatttcaaggggggaaaaaactaagggaagggtggcgcaccttgagataaaactttcaatttttctggcgttgagctgaagattgtgaggactggagcttcttccagtgacatgataacaatcagggcagtgaggagagccgcgaagccgaggcatagtttactgacaagaggtctctgtagacaaccacctttcatcctacaaaggtcttatgtacaaaatctcggcaaggtagcataggacttcagtggtctcctccaaaggaactcagataccgctctaaatcgatagcaccaacatcacacctgcaaatgcagatgaaccaataaataaggtccatgcctgaaaacagttcatacaagattggcaaacgcacgatgcatggaaatagaaaacaccaagagttaagcagtaaaccgcaagctaagaatgaaattgttcttcccccatttagaccaactacaagatataaatgatattcatcagggcataaatgctatataattcaaaacgtggaaacagcccaaactgatctacagtaacatgatcaaaagataagcagttcagatcaatctttctccggcatttgcgaccaatcatacagccaatgagggagccagtggtgtacccaagactaagcctctttttgctaattgaacaatgagtattaaaaaaaatagcgaccaagtctatccaccattggtattctctgctaagcgagaaactaaatctccaaaacgcggggcgcaaaatcgagatggcgtgtacgaatcgcttcagttttgatccaccaacccccaaaatccagaccccgggcattgcgtccaccggcgccgccgagcgccgacgcgggggaacacaagccgatctagctagctcgaccgcaacgctcccgatagatccaccagcggatcgcccgccgctccgcgggcgggacacgcgaaaccagcacggggccctgcctgcgctccgcacgtggaacagaagaggaatggtggtgggggaagagaaaacgaaccggcaaacccagcaagacgaaacgggggcaggcgccgcgcgtagcagcgccggtagccgctcttctcggccgccgccgccgctgccggcggcgagggaagagagggggagagtgtgtgtgaggcgagaaatccggttcgcccggagacgacgggctggaattggattcggcggtgtcggtgacgcattgcccttttcctttctctcactattcaaaaaccaactatgataaatacaaaacgaaaaacccacataaaataaaatataatgtttttataatgaatttgacatgcatcgtaataggaaatactattttatcataggagacgtcatttctatatgtcctataataagtttatttttaagcttcatttcatttgtctcaaaagaaatttattttaatttagagtaatcattacaatagagtttgtgaaaatagataactgtattcagagtagatgaagtcagaaataatcgcattgcgatttgataaagtagagatattataatctttgtgggttttttattggtatgtgtgaaatgggtgaagaattaatctttgtggttttttattggtacgtgtgaaatgggtgaagaattaacttattttaggtagaggtagtaactctaaacttttaatttcttattttccattaacaggtttttaaaattaaataaatttattatttaaatctataatatttaattaattactccttccataaaaaaaccaacttctatccatcaatttgaacataggcgaaagttagttttttatgagacggacggaatatgtgctaatgagcttccttcgctggaaatctctctcaaacaagagggaacaaacacaacatgattatctcaatttgctgtctaacacttttttcaaattactaaatggtatatttcttactaaaactattatatagagattgttttaaaatctgagataaatcaatttttcaagttccaaataaatgaaacccaattaatcagcatgccttaattgttttttcgttttaatattcatctttgtcactaccgaacggggtagtagtagtagttacgaatgcttgtttgaggagtaagttcacgatttcgttcgtattccttcgcctaaattttgatattccctaaacagctcggtcctgtcgaattatgaataaaactcacagaaatttcgcaaatttcatttgtaagcaacgaaattcgtagtctcgcagatgaatccacttacagccagctttgcatcttttttggtcactcctagctttgcttcagaacgccgaagacgatcactgccaccaagaatcagatcacggtaggcttaagcaaagtaatcaaaactgtttaaaaataaaacgagaatgttcgtttcttgcaacgtgagcaatgcttcgcttgctccaagagccaaaatgatcacatcctgttctaccctacctaacgccgcaaagcaaagcatttattccatagttgtttgtacccttttcaaccaacacatgagtcagctgcttctcttgtcccttcccttccagcctaccgactacttctttttacttatcttgtaagccaaaatttaaattttaaaccttaaatttaaagttgattttagggtttttttattgtagtttatttttcagcctttacttttgattactaagaacacatataaaaaaaatttattcgaacgcaaaataggtagagcggttgactgggcccccgtgtcgctctagggacagggggcgacatgggtggcgaccaccaccgccttcctccctcctccgcctcgccaccgcccgagtagaccaccggaaaccgcgcggctgcgaggaaggcggcggcagggccttccttctccctcgagggcgcaggtcggtgcccacaaccccgaccagttgggggtggcgacggtgcggcagcatcggcgtcgacgtcgggggcgtcagcgtcggggcgtcgggctaggcgcgcggaggcgaccgggtgggaagggagatggcaggcggcgggaaaggtggagcagcggcaacgactctccctcgcgtcgcctctccagatctaggctgggggcgtggttggcgccagggcggcgcggagaccggcaggcaggggcggcgtcgcggtgggcgggcgtcggcagcggcggctcgctcccgtcgtggtcgcggcgccaccgtcggcctctgtcaagcgtgttggcttcagtaatgctgcggcggcgcgccctagctagtcatcaaccccgtacctggctggatctagccgtccgcggccagatccgtcgcctccacaccggatggcagctggtcggtggggcggctgcgtgtggactccagcaagcgcggcggcggctcgctggcggccagctcctgctcggcatggggcttctactgccattggtggatctcgtcgtcgttgatgggcggcgatgtgtggatgtggagttggtgggatgacgacttgtgctggcgtgaagcaggaatggggcttgacgtccgtgacggtgacttcttcattgtcggccgagtgttctccctcccttcggtttcccccttctttggccggacccttttcttgtcgtggggaatgctagggggagggtggaggcttcggcttactgtagaagtttacggcggatggatggcgtttcgagggtggcaaagggtccgtctttgccgttggttacaatcaaggtatgattgcttgtgaggcgttatggactattttgcggccatcgatgtgggggtgcttgtgtgggtgatgtgaagatgctggcgaaatccttgccgtgcttttggccggttcgacaacgacggcgtccgtgggtgtcttttccctccttggaggcattgtcatggcgctctttcatatccccacaaatctccttttttaaaccttgttccgannnncggacgagcggcggcggcgncacgcgtcgngtcctccttgggggcgtcgcttctgagaagttccaatgcatcgatgaccgccgatggtccttttcggttcaaaagctttcatatcttgtgttcggcgaggcttcgccttcttgggtccgcttctttcttatggtgggcgacatgctcttcggttgtttctgctgatgaagtcgaagctgctcgctgatgggggtgcggcgacgcttggcaacgatgacatgttgcagtctcttctaagaagttctggtgcaggccgtgtgaaggaagtggctcctcggtggcttggttgatgtctattgctagatgttggagccccttttcgctttggcgactttcgtcttcagtgtcgttgtggttgtgaagttggcgctgctaggtagctggggcggctagctcggcaacgataacacctcttctgtaatgtgaaagctgttgtgtcgcttttgtgtttagcttggtagcgacgtcctacgattgggctccgccgtcgttgttagttgtgtagtggtgggtttgtaattaaccgtgcagttgtatggttttcggacccggttttccttataaactgggtcaattctcttcttctaaatataaaagtggaactaagttccgcctcaggtttcaaaaggaaaaaattattcacaaattattttttatttgcaaacatgctgtttagcgtattcacgatggagccgcaattcagtcggcagcagctgtcagggttatttccactttccacaatgaaaatagttttaaccatgggcaatcattttaagcatatggcttccaaacttggcaatttagcatttggacaacggcttccacaaccacaaacaccaagtttaaaagttgctcgatccagtgaga

SEQ ID NO: 65055 - DNA, 1012 bp, Oryza sativa
aggttagcactttggaagcagtaagatttttcctgtagacaatgtcgggggtgaagttaacaagagagcgaacaataggttcgaaagatccggattaactatttccaaatatttcagccgagtgcttcacgcgatagtctgtatggcatgtgatgtagttcggccaatggacccaacgttcaataccgtaactaggttggtgaaactacaccaaatgtgttggtcatttcagactggagcgaccgcgtaatttttgatgtaactggatggccggggtcagtgcacgatcaccgggtgtcctgatcgagtgctatgaggaagtatcttgatcggttccccagggtaccgccaggtatttacttatggtacatttgtttttatggtattaacataattcttagtgcacgacattaaattttttgttgtaggtaaatattttctcgtcgataaggggtatgcgaataggtaggggtttctcgcaccgtatcctgaagtgaggtactagcagccgcaatttgaacatgcggcacctccccaagatagggatgagattttcaatttctaccactcctctctgcgcaggtcggtcgaacgacttttcggacgtatcaaggtgaggtggcaaatattggacagtattccggcttacacaccacgtgcacacaacatgattattcatgctgccatggcattgaacaactttattgttgatagtaccgaaccaaactctatcagtaccaaccccctataccatactcatatccacccggtaccggatgtctctccagcacatcacacataccatgcgcgtgataccaaggctgtgatggatatggtccgtgaaaatattgctaatagcatgtattagcatttcatatttagcagtatttacttttgtaatagtatcggagtcatctgatgtaccatgtattaattgtgctaatatatatgtactgctatttattttgcaatgatgatatgctctctaatatatgtatgtactgctattgat

SEQ ID NO: 65056 - DNA, 1719 bp, Oryza sativa
agccccgcctggcctcctccccctccccgccgcgcgccgccggcgagctgcccctgaggcacacggcgtgtgcggcctcctcctcctccccttctcccccacccctgcgcggcctcctcgcgcgcacggccggcgcagcaaggtccggagacgcgacgcggccggcctcattccactcgcctccatccccggctcgaatcgaacccccaaggtactcgttcttctcccgtagcactctctcccttcctccctccccgccgcttcatgagccgtcgtggcgtggatttggaaatccatcccgacctggattgactactttgcctccaattaacccattcagtttcttccgtatttcttagtataatagtagttttttttttgaaaaaatgctgaacccccacgccccacgttaggtcggtttattttaacaaatttggtggtttacacttcaacgcttgtgctaatttcttggcttgctaattaattttcactaattattactgcgttcttcatatgctaatcatttgtagcactctaaatttagggggtacccgatttcttaaggtggacgcatgtcttactgtgtgcagcatgccatttttttttttgtgtgtgtgtgttttgcagttgaacaatgactgctcagaccaagaagaggggtggcggggagagcgggaacggtggcgctggcttgggccttgctgccttcatcgccaacggcgaggatctgggccctatcgtccgccacgcgttcgagtccgggaagcccgagtccctcctgcaaggcctcaggagcatcgtgaaaatgaaggaggttgagattgaggagctctgtagggtccactacgaggagttcatccttgcagtcgatgagctccgcggcgtgttggttgacgccgatgagcttaagggtatgctgtccggcgaaaacctgcgcctgcaagaggttgctagctccctgctgttgaagcttgatgagcttcttgagttgtattcagtgaataagaatgttgaggaagccctagggatgttgaagatctgtttgcaagtcaccagtctgtgccagatgtgcaacaaggacattgcagaagccaggcttcattctgctttgaaaagtttggagttgattgagaaggattttctgcaaaatattcctctaaagcttctaaaaaaggctgttcagaagcaaataccaattgtcaagctgtacattgagaagaaagtttgcaatgagtttaatgagtggctggtgtatatcagaaggacagcaaaggaaattggtaaggtttcgataagccaggcatccttggctcgtcagaaaaatgagggaatacattcccaacagagggaagcagaggactgcagccgtattgggtttgacgagcatgcttatgccttggatttggatctcataggtgaggaggaagtactggaattcgatcttacaccagtataccgagcaaactacattcacacatgccttggtcttggggaaaaattccgagaatactactacaataacaggcttatgcaacttaatttggacctgcaaattcccacgacacaaccgttcatggagtctcatcagcacttccttgctcagatagctgggttctttattgttgaggaccgtgtccttcgaactgcagatgggcttctttctgatagtcaggttgagacaatgtgggggacagctatttctaagggggcggcaggaat

SEQ ID NO: 65057 - DNA, 11308 bp, Oryza sativa
gtcaggtcatcagtattagtaactagatcaacacaaacacgcaaagaaagaagcttcatcagtgcatccaaatcgtcagctatgagcaaatcaaagattttttccattgtctaaaaagaaatgaacaaaatcaatggtgccattcctcatggcaggttctagaggaggttgctgatgcatcactgtccagcaataaaaacctgatgtgcatagtgatggtgctttgccaaattgggcatgagaattccaaagcatcgatcagatcatcaactgttgcagtgttcaagcaatttagaatgcactgtagaaaggaacgatggaaaggcatgtagcccctgagtggcactttgccttctcaacgaattctagcagtccaacggtgaagttgagagactcaccgtcttttgagaaccacatcaatcttgagtggttactaaaggatgtgctaaattctaggtggctgtgcatccaataaggaagaaactagaaaaggctgtagcagaaaaatggcactgaaaacgaactgaactttagatatacggtgaatgaatatccatagagttaaaaaatgaccaagtctaaactggaccaaacagttgcaagagctacggcgatgtttatagctttgtttgttttaatataaggaatgaaatgctttgttacacttcctgaaactgtttcatcctaagattgtgtgatcatgacagaaaatgcagtaaattgccaaacatttttctacctattatattaccaatttgtaactggaaagaagttgattgcctgagcatgtgcttaataattaacgaataattagtgtcttctgatgacacatgactgggaccaactgcacaaatcccctttacaggcaagtgctcttgtttttgtttaaagaaatgaagaccacttcctttctcccaatcacccacaagttccacagagtgataaaccaggaaagcttgcattagatctccatttggttgtgaagcataaaggagagaaccataaaggggctaaaaaggcttcaacgagtttgtgctcgaagaatatgctaagtagatccttcccagcgcgagcctacaaaaggcctagcaatgctaatccattacatcctgcagcatcaccatctgaggcaagactcacagaaggtctagcattcccttgtcatggccttcctcgtcgtctgttggtctcaaatccgttccatggcgaccgtgcgtcagagaagccatggctgacagaaggtccgcagcctgaaggaacgttgcatctgaaaagcctccggcgcagagggcaaccgagcatctttggcagtctcctatgtctccttgaatcgattataggtagtacggcatctccggaattcatctattcatcggaagttctatgctgtagagtagtgatcagttgatcacctgttcaatctcttactatgatcctatttcttccaattgtatgtcaagtatatataaaagcctattcaaatgaataattctatgtctcttgtggtggttgagctctcggtgagatttccatggcatttcactaatatcgcggctatcacccacacaggataaacaggaatcgcacatctgcttttgttgattgctcatgaatttcgtacacattggatatacaccacacgaaagcatatcctcatatccttcttctagtctcaatttcattttaagacagtcgaattgaacatgagaaagcagcaaattaaacatccaaatcaccaattgcaacacagatatgtagttaattaacacatattgcacatatctccatatcgattggtgtttcatttattatcacataatttttgatactaaagaagctcacaatacaacagaaagggggggagaggaacttacccagcgaccatcaccaccggagcagctaggtcttactcggcggcggcggcggcggcgccttgggcttggagaagtcggagatgtcgctcctggagaaccacttctcccagttcctcccgtcggcgtgcctgtactcgacgtgcgccagggtgcccgggtcgacgcaggcggcggtgacggcgacgccgtcggggttggaccgcggggtgtagaaggaggtgatgccgcagaccctgcagaacgtgtgcttcgccgtgtgggtgccgaaggtgtaggtggtgagggactcgccggcgccggcggcgagggtgaacttggaggccgggacgacgaagtgggcgttcccgcgcatggcgcagtcggagcagttgcagatccacaccaccacgctcgccggcgcctccgcccgccaccgcacccgcccgcagtggcagccgccgctgtgcaccacgtccgccgccgccgccgcgctcatcgtcgccgtcgtcgcctcgtggaaagaggaaaagaaaaaagggaaaattcggagaagaaagaagcgggtgggattttctcgatgaacaactggtccacgtgggcgcgttgactagagtgagaccaaggcaagcagtggctgggcttttttgtgggccaagattgatatgggcttaatatatggactcgagttgactggcccatgggctcacactgatatgggcttactgagcactgggcctacggcccacaaaagcccatgaggcagcccaaccagctcgcgacctcgtcggcggcggagagagcaagcggccttcgtgcgggtggcggtggcggcggcgcggcgaggaaggcggcggagaggcaactgaggcgtggttgagggattctggcgtggagcagcgccgggggagagggtagaagcggcggcggcgccatggacatcgagtgccttgtgctaggtacccttcgtcgtcctccactcctctctctccctctccgcttctcgcacggatttgattgattgatgggaatgatgcgtggattgatggcgatggcgatggcgcaggggcggggtaggaggtagggaagagctgtgtggtggtcaccttcggcggtgagaagcgcgtcatgttcgactgcggcatgcacatgggccaccacgacaaccgccgctacccggacttcgaccgcagtggcacccgccgctgtgcaccacgtcctccgccgccgcgctcatcgtcgccgtcgtcgcctcgtggaaagagcaaaaaaaaattgggaaaattcggaggaggaagaagagggtgggattttctcgatgaacaattggtccacgtgggcgagttgactaggctccattcgtttccacttaaaaaaagtggattaagttttggatattcgtggcacgctttttaaaccgttaaacgatgtgttttgtgcaagaattttctatatgaaagttgttctaaaatatcagattaatccatttttcaagtttgcaataattaaaactcaattaatcttacgttattatcatctcgttttacgtgaaacacttaattttcacattcatctttatattcatcattgaatcccctgaagataaaaatgaatattaagtttttttttatgtaaaatgatgtggtattaacgtatattcgattgagctttaattattacaaatttgaaaaataaattaatatgatattttagagcaacttttatatataaagtttttcgcacgaaacgagccgtttatcagttgaaagcgtgccgcgaaaatcttagggcctgttcactttatgccaaaaaaaaccttactaaattttagtaataccaaaattttggcaacaacttgctaaaattttagtaggatttcttatataattactaaaatttgacaacaaactaaatgtagccacttttttagtaactttactaaaatttggtaaggttaaaaatggcttcaaagtgaacatgccgttaatcttcatccaactcttgtcggagaaaagaacgggactagagtgagaccaaagtaagcagcggctgggctttttggtgggccaagattgatatgggcttaatatgcagataaagcgtttgactgggctctgacaagcagggcccatgggctcacactgatatgggcttactgagaactgggccgaggcccacaaaagcccaactcttctagccggcaagcccaaccagccgcacgccctcctcggcggcgcggcgaggaaggcggcggagaggcaacggaggcgtggttgagggattccggcgtggagcggcgccgggagaggggagaagcggcggcggcggcggcggcggcatggccatcgagtgcctcgtgctaggtacccttcgtcctcctcgagttcctcttctcgcacgggttgattgatgggaaccacgcgtggattgatggcgatggcgcaggggcggggcaggaggtggggaagagctgcgtggtggtcaccttcggcggcgggaagcgcgtcatgttcgactgcggcatgcacatgggccaccgcgacagccgccgctacccggacttcgaccgcctcctcgccgacggcgccgccgactacaccgccgccatctcctgcgtcgtcatcacccacttgtgcgtctgccaaaaatcgaattgaattgaatcgaatttgatctgtagcagcatatccagtttgcttgcacggttaatagctttgtgaagtttgtgcgttgcagccatttggatcatatcggagcactgccgtacttcaccgaggtctgcggttaccacggtccagtttacatgacggtgagttgtaaccactaaccagttcatgtttatttgttcagtattatgattgcgcagctttggtgtatccgttccaggtagaatggggtttcattaaaaaaaaaggggctatagtgaggttgaatttcaaattaacttgtcataggttggatttttattcatcttagctatcaaatactaatatccattgagcttgtgagttgtggctgtcactgcagtacttaatagtggtcatggtcctgcgtaaatatgtttgatggtctaggggttcagtgaacttgttgatcttattgagatgatcttgtcaaagtatataatacgcaaaaggagatgtgctgtgaactgatattgtccatcggtagcatgtgaaagcttgatttctcttgctgagtgattgatcttcatctcataacttaaatcgttgtacctcaagcagtacccgacaaaggctttagctccattgatgctggaagactatcggaaagtaatggtagatcatagaggagaggaagagcaatatagctatgaagacatcctacgctgtatgaggaaaggtaaatgttctgtgttcacttttcacatatcttttactagtctacttagatattgtgctggcacacaggtatgcatgtacgatagttctcatttggttatttcattggacatttcagttataccattggacctgaagcagaccattcaagtagataaggacctttcgatccgtgcctattatgctggacatgtatgtgctgtatacttttctgtcccatattaactgcagtgttattttttaaattcttggaaaattaatattaatgttgttctgtactttcttaattagtcatcattcttccacatgcaaggttctaggggctgcaatgatatatgcaaaagttggagatgctgctattgtgtacactggagattacaatatgacaccagataggcaccttggagcagcgcaaattgatcgtctgaagttagatctgttgataacagagtatgctacaaattcaaattatagttatgctcttgtgcatcatgttttccttttgaaatgttgacccagtgatgtagttgtagacttgtagtgaatcattgccactcaggattaggttctttggtatgttttagcagtaattttgctgtcttgtttcttatagctcttttatcttttgtgtgcgcttgcgcgcgtgcttgtgtgtccattaactatctttatgatatcaggttttccacacagctacgtaccagtaaaccagtatccggtttctgttgttaacctctgctttgacctgtatgtagttggaaatctcctttgtagttaatgattaggtaggtgtattttgctaaatttttcttgtgatgtttcgttttaatataatccatatttggtttttatggaattatggtctaccttgttctgtactgttgtcttaatgttttaccaatacggaatttgaggtgcagttctttggtgtatctgttttatgttcaatgtgtaagtattaaactgaagttttatctgcagatcaacatatgctaaaactgtgcgtgactcgaagcatgcccgagagagggagttcttaaaagcagtatgaaacctgaaccttcacactaccaattttattggggctttttttatttggtttcttttgtaacacttatgcaatccccttggtgatgcaagatatgtgttacatttatcgatgctgatggttgggcttgtagcattgtgcaaacttaagtagttttgtacatttctatggcatgaatacctccagggagttcatgctcacaaaatactaagtacaacttgttattagccaagagtttatccctttttcaagttctgatacttgaatcatgttgattgtgttgacacattgaatctttataatctttacttgcaaatttctacttagtaaattcatcactttaatgagagcgtattttatctaggtccataagtgtgtttctggaggtggtaaagttctaattccagcatttgctcttggaagagcacaggtactcaccactcctctcttaattatatgtgatgatgcatttaatttaatggttaagagtaggatccttttggaaaaatgtcctttggagtatgctgtttgaaacttccataatcagaagtgatacactgctgtaatgtggaaaacaaattaagattgccttgaaactccgaaaggggcaaaatatagatgtagctatgaacagagtggcattttattgaacgcaatctccatagtgatattttatcaaagcctactttgtggagtggcatattaccaattttctcctctaatgtgtgtcaggagctatgcatactactggatgactattgggaaaggatgaacctgaagattcctatttatttctcagctggtatgtgtctttgtccaactttaacttgctttcatgtatttgtccactttatttattgttgtatttgtttgataggtttaaccattcaagccaacatgtactacaaaatgcttattggatggactagccaaaagatcaagaacagctacacagttcataacccatttgacttcaagcatggtatgtccttgaataaacatttcatttgaatcatatgtcgaatttcgtagagtgtatctgtttagggaaaacttataaacctgcagtatgttttccttttatttgtatataagaaactatgtggcatgcattcatgatgcaccttctttaatgagtgttgataatactgatattgaagatatatgccattggctcctacattgtactccctccgtcccagaatataagaagttttaaagttggacatggttattaaaaaagtaggtaaaagtgaatggtagagggttgtgattggatgagtagtagaggtaggtgggaaatgtgaatggtggagggttgtgattggttgggaagagattgttgatggagaagttgttatattttgggacaaatcctgatggctaaaaattgttatattttgggacggagggagtatctcttaaattagagttctaatgcacatcatttatgtttctgactttctgttatgtacagacagtactgaatattttttttcctcacgttgcagtttgccactttgagcgttctttcattaacaatcctggtccatgtgtgctttttgcaacacctggtatgattagtggtggattttcccttgaagtgtttaagaaatgggctccatcagaaaaaaatctggttacacttcctgggtattcctcttaactcttgtaatttattctttcttctatattttataatgttgtaagacattatatgtttgcttgctgaataaaatatttctgttggtactggagaagcctaatcagccttctggattccttggacaatttgacataaaagatggtgtttgcttggagttgaatgcttctttatcattcatatatgcatttttctgcttcaattgtgacttgtgatcaaattattattttttctcgtcctgtactaaaagatgaacaggaggaaaaaggaaaatttgactgctttcttaaaatttttatgcagtcatctttgtgttttttatatgaccttactttgttgttttcaatgtagatattgtgttgctggaaccattggccataagttgatgtctggaaaacctaccaggattgacatagacaaggacacccatattgatgtcagatgtcaggttgctccacttaatttttacttttgtgtaaaatgttgttttcatggatcaaggacgcaacaaacaactggttgcaagaagttgcacacttactgattactgtcggtggctatacgttctagtgttctgcttagtgcttaccatagaaattatatggtgccttgaatattatcctgacctttgtttatacaccttatatcataactaaagctaccttagtgctttattaaatgtccactattgtttagatcttgcttaaagtcagttctttcacctctgtttatcgtgcaatacgacttctcaaatttctgaattttactatattcaagttttagaatatttagctctagagtgaaaaacataatattagcaactttagatcctttaacatcttaaaattttcattttgcccctttgattatcttgcctacctgttcaagttcctattactaacctttgtatttctttactatactaagtttccctctttgtgcaacagatccatcaactgtcattcagtcctcatacagactcaaaggggatcatggatcttactgaatttctttctcccagtcatgtaattctagttcatggcgaaaaacctcagatggctttcttgaaggagcggatcgaatccgagttggggatgcaatgctgttacccagctaacaacgagaccgtctctattccgacatcccagaacttgaaaataaacgccacggagaagttcattgtgagcttctgcatggatgaaactgaaaatgatccgcagaagcagaacctgaattttggtggcgacatgccacaaggctgcaggactgaaggagtagctgagggcgttcttctgatggagaagtccaagactccgaagattttgcgcgaggacgagctgcttcactcgctgggcatggaaacgcattttgtccattttgaaccactgcatccgtccagcattgaggtaaaacatactggtgagtccgcggtgcagcagagcagtttagaacatttagactgcgagtgaaatgaatgaacaattcttcttttcaactactctcgactttggagacttttgagaggtatagccagaaggggaagagttgtgtagttagactgttggaaaaaaagaacacttttcatccgtcaattgttattttggtggattaaaccctagtcttttctcttttcttctggggcgtcaaccccaattctatattctttggaggtgcagcgggtgcttatcaaatctgtcacccccaattctatattctttggaggtgcttatcaaatctgtttcttaggctgaacatataattccaactttgataagtcttttatcgtggacgatcaaatgaactccaatgctagcgaaagaaaatttccagcaactaagttgaggaccaatgcccaatacacggactgatcaccattgaccacaattatgcatggttcacagcacactgtgagctttgcagctgacaattttcaccttaactaaacaaatacagattataaagagcgacggcgaaaacagcggagtacgaaattaacagtgcccgttgtcgaacaagacgatacctgcgcacgtcaaaagaaacacataatttttttaaaaaaggaagagcatgtgctcatatataatataaccagataaataaagttcaagcttacatttcggcagactctttatttttagcctcaaatacctctttggtttgtcgaagaatagaggaccattcttccatggtatcactgaactggtccaaagtcaacaagtagtccaggtcactttccttcttcttcttgagcaaataccttttgtatgctattacttcatccctgcagacctgtagtttctgggcgaatggaataaataaaacatgggtttgcatcagaatcatggtgttataccgatcatcacaacgttttactttccatcaaaagaatatatgggttagctcaaattagaggtcattaattaactcaagttacacttacaggtcatcaactcagaatatctcagcaggaatttgccatgattaatatatacccttccaataaagaatacaggtgaactcaaattataggtcatgaattcaatatgtttcttcataggaatttggcatatactaacataaattctaacatatcccttccaatatcaaactaataactttcactaataataataatctatttgcagattctgaatcatcggacgcaaggaagatattcgacacaagcgagataatttgaggtaccacttaagaaggttacttgtcattagccaattacatctaaagtcacttgtttttccccaaccattgcatctaagcattgtatagtcatcttttctttttctttttttttgtttttgccacagattcattaattttgtgctccttttcccctcatattggcgttgcatcttgcaagacagaaatatgtatgcatgtatatgtatgtacataaaagaaagaaaaaaatatccccagaggaaacgaagattataattaatcttgatggtttcaacacagtgagcgtactcggagcgcaaggccaaggcatcctccagacgaagcaactggaactgggtcgcattgggagtggaggaggagggcggtgtggtgttcttcgcggcgccatcggtggtgaggagacgcgagccgggctccaccggaggggcggccaagcgcggtggacggaatatcgaccgccgccgccggagctcgcgggcggcggatcggaggagcaacgacgacgaagccatcctccaccaccaagaaccgaagctcttctttcgattttgattacgccggtctaaataatcaggtatccgatacgtaccaggagggttcactgtataggtttagggcttttgatcaggggtcaccgaaatcccgaaatttcagaaatttcgatccgaaatttccaaaattt

SEQ ID NO: 65058 - DNA, 4605 bp, Oryza sativa
agcaattttaccaagctgctgtgacaccccgcacttttaccaaggacgggccctctctacatcacatcagcacttttactaaggctgacgcccgcacttttactaaggtctagcagctttcctacagctgcggtgtagccaactggaacacaacgcacccgggaggaatttcccgatcggtcacccatcccgaaactgctccagggcaagcatgcttaacctcggagttttttcgagatcggcttccagaaaagaagttacaacttgttgattgagtattctattaatcctattaaaccttgggtcgggatgtcacattctcacccctttaagataccaacgtcctcgtcggtcaacccaggccaggaacatctcctattagcaccacgtatatacagataattttcggcgcacatacgtcatgccatacgaccacatcgtggatcatcccgtatgcaccgtatgcccgcatacatattcatatatacgtatagctgcaagggtcggctctgataccatctgtgacaccccacactttaccaaggccgggccctctctacatctagcagctttcctaagacatagactttcctcatagactaacataagtcttttctgcacactttgtcctcactcgtgcgcacccgggaattttaagcaattttaaaaattaaaaattatgtggcttatatcattaattaatcaggtaactagcaaaattgttggaaacaagaataagccactcaaaatttataacattcacatatgttgaagtaaaacaaataaataatgtccaatataccaccccaatatattaataataataacatggaaatattatacgaacaaacgccactataaacagtcagcatgtatacatacacttacactaataatgcaatacatcatatatttgaatatatggttgcacagcacatacatggtattaggttgggcttggggtgcatggtagttaatatgtcaataaatatatctgtgagaccgttatagggcgtggggtgcatagcaccattgtcctacaacatgcgatacgggtaagccgtctggcacctctcacttaagttgggttcatcatctggctaattagcactaagaagccacacatctcaaataaataattaatctcaccaaagggacctcaattcaccagcagtagtaattttccaccaaacacatagctccacataggaggcctcacacaaggccacaaaagagagtagcacggcttagcactgaagtcaagcagtcaaagtatggccatgtctatagcaattactacaagccggtgcatatgcttatgaacccaagcccatggtaggattgagcagagttggggagaagaaaggtaagtagcagggagtgaagaagaaatagctgacgcccccaattagcaaaatgcattattcattcccatttacctgtaagcaagctagctagttcttacctcttggccaaatgctcaaaccaccaccaatccaccatgccggctaggaaggggagagaagaaattgggtaggcagggaggtgatttaccaaggaggagaggccaacagatcggcgaggacgaacacgggtggatgaccgtggacgaattcgacatctagacaaaggtgaactttgcacacaagaagacttcggaaagtagagttacaacctctcgtagataaagttggatcaaggatccttggttggaaggggcgtttcttcacctctgtaggaagggaggttctggttaaaacaaccctctcatcgacacctatctaccatctcacaatcttgcataagaataagtggctatataaaaggattgatcgatttcggtgtgcttttctatggaagggggatgatccagataatgtcagttcgggtagtagtctcattaactggcagaacgtttgcaaacctaggaatttggggggcctcggtattcttaatttggaaaaattctcacgagctttaaggctgcgctggctttagtttggctggaaggaagacaatagaccttggcataacatggaagtgccttgtgatgaattggacagagtgccttttcgagctggaacagtcattaccctaggaaatggaaagaaatgctctttttggtctgataactggctttagggttgctcacctaaagatttagctccagggatcttcaacctgtccaggagaaaaggaaacaatgtgcacctcagccttcaaaacaaccactggctgccaatcctaaaccccattaccacgataagtgaaattgatgaactggtccagctgggtagccgtttgcaaaaagtcatgctccttgaaacacccccgatgacattcgttggaaatggactcccaatggagaatactcagcaaagagcgcttatgaagcacaattccaaggtatgattactagcataaacttctctcccctatggaaggcccaggcggaaccaaaacatcgtttttttggctggctcattttgcatcagagaaccctaacggcggaaaacttgctgagacgtcactggctatgtaattggatatgcagtctgtgtacaaacgctttcgaagatgcaaatcacttggccaaagaatgcagcttcacaagaaatgtgtggaatttagtatgcagctggcttggttacaatctctccccacaatcttggcaagacacacccatttcgaattggtgggattccttgatttttcttgcaaaaggagattcggcaaagaagaagattggagctctactcacaacgtggtggcaggtctggctcgagcacaatcgtcgaatcttccatcataaatagcaaagcgaatcacaagtagcttgcacgatcaaaaaaaatattgaattaattgagctttcgagacaagcctaaaggctgtctcagctgagtcgtttctcttctctctctgtaataggctttatgagtttattttcctttctggatgtcccctcttttctttgaaccttgatgtttttcgttttgtctgactctttttactccttctaatatatccggtagagctcctgccgttaatctttcaaaaaaatagacaaaggtgaacccctcatttcttaccatcatttattgagcatatagtgcagccatggcatgagcatcaattttctctgcacttgcacatcactatgagaaccaccaacaatttgtatccatcacacaaatgctagagccagagaggaaaggaaagagggagagaaagagcagccacagccgcagctgcagtagccgccgtcgccatagccatagcagcagccgtcaccgccttagctgcagtagagctgatccacacctagaagcagcagatcggtagccatggagtggatggtgagttaggggaggaacaaaagccttagcaacagcagcaagggaggagaataggaggggaataactagtgctgctgccttatctgttcgagagagaaggagagaatggaaggggattaaattgctggatgtacactactagactacacaagtcattaaattgaacctactaccggaatagtattgtgaagttcaagcttagagttagataaattagctattaaacataagaaagctggcacaataaaataaactctgcagagcacattttaattagagagcatttgcatttcttgtgctgaaattttattgaaacctcagcgtatataacaaatttcaggaaagaagctagagttggaacgtgtcaattggcagcagtatattatttcggtttcgatcacagaaaactcaggcaagtctctcatttgatcatgttgatagacataattctatttcaacgtaaaaacctatttcatacaaatatttctcctagtattgcatcaaaatatattttctagaataatgatatggacgatgatgatatgattgacaagccgatgatgatggagatcatcgggatactagtatggtgggtagggggagctcacggatgagatgattgatgatgatggcaggtcagggctctccctacatacggtgtataaatataaggactaatcaccccatcactcgtatcagagaatcgtatataccgtgtcgaccatagatccgtcttaagatgggctagtaccttatcaagtttattatactccacatgggtaaatagtagtagaatgggagatgatataaaccccatgaatgccgatgaagtgcattccaggcgcatatagtagcgcggtggtgtggagagctgataggctcaacacaaacgtggagtgtagtaacctgaagtaggagaatagttctgtgttcttagtatggtgccgcatctagcgaagtgcgacagtcaaacatgttaagagtagctatgggtacagtgatacaagcctgcacagtgctaaattaaatcatgattcacgtctgtctcctggattggaggctacggggagttgctacaaactctattcaatgttacgagtgtattttagcttttgcaaatcttcttctttttaaaaatccctttacaaaatagacttagactggtgatagtaatgtaggtgactatgttacataaattatggtatataatatagattattaacttattatgcatgcatttgtattt

SEQ ID NO: 65059 - DNA, 6338 bp, Oryza sativa
gtcatctattaaaaaacggaggtagtattatattaagacaaattttgccatagaaaatcgcgccttcgtggttttagcagtaggacaccgtacgaagtgagttttggtgaacactttataaacgcggtaatttactagcagacaccacgctgattgtttcagtgtattttgtgctgacgttgtgagagggacctacttttatagtcggcatgaccaagatgcccatatgtgttttggttacagtggcagacgagaatgctagatagcgatcagtcgcgcgcctccctccccgcgcgactggacacgtgtcgtgcgcggagagggggcggccgacgcgtcgcgagggaggaccggaggagcgagttttctttttttttttccgtttctgttcagttgttttttctttctccggttttttcgtttctgttcggcctggttttttttcagtttatcttctgtttggttcttttttcggtttttttaaagatatataaatacaaagtttgtattcatatgtatactaagtttgtattcgtacgtatagaaagtttatatacgcgtatacacttgtatagaaagtttatatacgtgtttgtatacgcgtatacaaactttctatatgcatatacaaagtttctatatgcaatacaaactttgtatatgtgtatatattttttatgcattaaaatatattcataaaaattatatatatacgtatgtatatactatatagtatgtatacatacgtatatacatacgatgtatatagtacttacatacgagagagactagggggcgactgatcgcacgcgcgcggaggcgcgcggctgatcgcgtaccagcgcccccctgttcctggcccggcccagcagtgagcgcaaacgaagcggtggaaggccagcgacgcgaacagatcacatgcgcgggtgcgtaaagagaatagaacaagaacagatcgtgagagtgccgccgtctgccgccaacgtcctctcctcccggcgaaatcgcgcgcaaccaggccaccagggtagcccgcatcgtcgcgtgtcgcgccagcgccgacgcaattctgcggtgccgctgcttcttccttgttgcaatttgcttgccgccggctgccctcgagtactggacgaggaggacgggacagtcaccgatgactgattcaggtgagtgcaacaccaatacaactttgctattgctaatttgtcattgccagatgaaaaattgaagttctggaacattgtgatttcatctgtaatctgatctgctggcttttaaattcagatttgttattttgtagtgtaatttatataggataaaccactataataatgttattttttgattattaggctatgtagtcgagaaagtatgcatcaggtagcaataaaatgaattaaatggtttggcaactttatgcatcgagaagaaattattggataaaaaatgataccattatcaatgacttcgcatctagaaatataagaatttttttaggtaacatgtacaatgttttgtatataaatattatttttgaatgcaatttaaatgtttataatttaataagggcctctatgtcaagtttcgcaccaagaccctgaaaagtcaggaccggccctgcgtacggagcaagggagcggcgacgcgtggccctcagcgaacccagccgtgcatggactgctgcggtgcacagagggaggtagcaacgcgcgcatcccttggcgaacccggtggcgcacggagaactcgatggcggcgagcaagcccttgtcggctttccatccccttcctgctaccgccggattccctaatcaattcttcggctttccctctcccttcttgccgccgttggtttcccctcccacaccggtgacgacctcgacaacagtgctctgcaccgagctctccatgatttgaagtcacgacgtgccaggggcaatttgtcatgatgagtcaaaaagtgcccactcttgcctagtcagcaccaaaacactaaataaatgggtgtggtgtctactggcaaataaccaagattacatagtttcttccttcaaaagtgatttcgtgcggtatcccacagctaaaacatgaagttatgatgtcctgtagcaaaatctgcctattattagtgagaatattttggtcttttcttcttctcttcgtaactccttagaattttagaggatgattttttttatacatagaatatcgtgtagttcacatgagtgttcaatgatgcacaaaacaccatcgtgtcccggttcttatcataggtgaagtcgctgtgacgtttcaagaggttgttcaacatggagcccaagaggcagatgtgggaagcgctcgcgcgccacgatccagctacaccgagtggatcattcagcaagcacaacaactagagcctccgcgaagtggtcaccagcttcctcctcgcgagcgttatacacgtcgtcggtgttgacctggttctctagttgttgtccgaccggtctgacatgtagccgtggaggacaagattgtagtgagatccaagtggtgtgtagcgcatcgagtgccgaagacccaaacggcgcgacatacaccacctcatgggcatcatcgagttcctatgccacgttcgtgggtaaagggtggctggtgatctactacgcctatgccatgaggtatgtggaggacatcaggggctcagactgcgaggagttcaggttggagcagtggatgaacaaagccggcgtgttttagccgaaaagctcattcaagacttcgagtaccccatcttctacattggacaaaggatgtgcctcggcaaggagatgacgtatatacatggattcggattcactgcattagagaagctaatgcaaagggtggcattagctataatccttccatccatcaccatccaatggttgtggctagtcttcatctttcttatctccgttgctagaacgaatgtcctgtttcatgtttgattcgctgaatcaataccaagctcttcataaattttgatagggaagagaattgttgcaaagtctaaatgttcatggttctttgctcgtttgtagtactgacttgtggcaaaagccaaactaaagcttcataataacaattagttcataacaaggttgattgagggacaaagtacaaaaggcatttcacaaaggaaaataaaactataaccctgattaagtacaaaaggtatcttagggaggaagataacactataatccataaaccaaaatatgcagagtagcatcaagtccacctctcagatgagtgaaatgtcattacttttcaccaaatagactacctgcactggaatcattctgcacaatgtagcaataagtatatatcaatcatgaacaaaatatagttttctagataaaaattaagtataagttccagattaccataagtaattatgggtacgaagtaaagacgtcgaagttttcaaatacttcttcactttttgtggagcttttttgttcttgtccttgaaattgagacacatgggtaagatcttcttcctgtgaacaattctttttttaaaaaaaaaacattgaggcatctagagaaattatataagacattgcattgtttgatatttctaaactttgtctgcaggcacctttttttgtgtcatgctctttttcttgtgaaacttgtcaacccaacctggtgtctgctttgctcctcgtctccagacctcctttttctccgaatgttctttcatcctcatattcaaatgcgcgggcactaaattcaccaagtatatttggtctatcactcttggtaagtgtcaaaggctagcttgaccgcactttacatgatgtgaaaagtacaaagcccatgccaagttccatgaaatactataactatagcctttttcatagccgtaccttgatctgttagatggcttttggatgcttttgattatgagctgccaaaaatgtttcaaaaagtcatttgaaggagtcgaatgtttcatcatacaagagagcacctcaaaatatatactctttctccgtaatggttaaatccaacaaacacactaagtgatctatgatctctatttgttccaaaggtggtatcaaaagtaatgacatcaaaaaaatatgttagcaatcctcatcaatctaagtgtactacatagtgaaacgaaggattctctacacatttatattgaaagtattttagcatacttccagtttcaccataaatccaaaggttacttgagccaccagcttccttactagctaactcatatccagctttaggtctgattccataatcatctaccatgtcaatttgaaaaccttgcacatgtgaaattttctgtggtgatggcatttaggtggcatgtttttggcaactaaaggatgtggtagcgttcagtcaccaaatcatatacttcataatttccttcaactttgtttaattttattcccatatgaacattgtagtcagttcttgtctgtgctcggggattcttggttagataatctcttttatcttttcctcgatgaccagcacttgagcaaacaaacctactagaagtaaacaacccatctacaacacttttgttgttatgctgctttctaacatcaaaaccaatcttaccaccatagctaacccaaaatttccaagcctcatctacactgctaaactttattccagtatccactttacaaatattgggctatattattggaatacaagtatgtccatctatgacatacttatgtttgattggaatatgcccccaaaaactgctagtggaaaccaatgaaataataaggataaattcaagcaacaaccttcacttctctgcatttttgttgatcctgctttcctttgtagcgttgactcatatttgtggaagcatatttggtgatgagagaaattgggagataagtatggtatgagagatagaaatgtgttactagaagccaagaaaaccataaaaaaaaatgcaagcaacgatcttcacttacctctctaaattttggttgatcatacttccatctcgtgtttatttatcttcatggaatcacttcaatgctaagagaattggaagaggtatgtcatgagagagagaatgaaaagacttatagaagaagcccgaagaaattggagggaaaaggaggagtcctgtagggttttggtgcctaaaatcgacctggacctatggtgcttcctctaagacctgtctcatctttgccttatgtaatagaaaattatctacaaccgttagatggagatggatggccaagattagagctaatgccaccctctgcattagcttctgtaatgcagaggatctggatccgacatactccctttgtccccaaaagacttaaattttagagataaatatagacacatgttaaggtaatatttttttagtgaatcttctgatgaatgagataacttttgttttattatcaacgaggaaatggattttatatcttaaagtgtattcgctgaactcatcaaatctcactcatatctgaaatcagtccggaaaacctaatgcgcgaggcgaacacatttttccttttctgttcaccccgcggcctgcatgctcccacgctgaaaatgggcctatgggcctatgggcaaatatgatatttgttattgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgtttgttatttgggagtacctatacatctttcgaaagatttttataatcgtatcacacagatttttaatctttgtattaaaatccgatagatataataaaaagaaaaaagcaattaagaaataccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcgagtgagatatagcaaaatcgttgttatttttatct

SEQ ID NO: 65060 - DNA, 3475 bp, Oryza sativa
tagactaccagtactcagcagtgcgagttgtagccgcagccgatccgtgcggagagagagagagctctggtcgctactgccacggctgcagcggtcggagaaggaggtgggcacgacggtagcggcgacggcggccggctggggttgggactgggtacgttgtaggagcggagcttcttaccttggcaaaaaaaaaacttaaattttgatttgcagaaaaatatatgaatttcgaaggattttaattctatagaaaaatttcctatcaaaccctttaaaataaatgattaaatcatatccaatcctttgaaattcctatggaatggacaatcctataaagattttggtggaaacctcttggtaactttcttttgagtatatctctttcattcaattcctatgtttttccttgtggttcaatcaaacggtaattcctctgtttttcctgcattttataatcctctgttttacacttacattcctatattaaaatcctgcgttttttcctatttctacattttctcaatcctgctatttaagggctcctttgaatcgtagagttgaaaaaaatggaggaattgaaaaaaaaacacaggattctgataggaattgaagcataaaacagatgattgtaaaacacaagaaaaacattgaatgatcatttcattggactacagaaaaaacacaggaatcagatgagagagatagacttaaagaaaattttccaagaggttgaacctcttgctaagtttcttccaaaatccatatacaatacgtcattccgtaggaattcaagtttcaatcctttgaatcaaagggccaaataggaaattttcatatagaatttaaatcctatgaaatttctacataaatcttttgatttaaaggggccctaactctctatcaacaagttataattgtagaataaaaaacgaaatataagtaaaaagcatcagtttagattctcatgagttagctatcgaaaagctatttcacagaatattaatctcccaaacattttctctgggtgaaacgaaaagggacggcttgttttccaaatactttaccttatccactcatatgaaatttgagaaattgacactttacattatgaggattcctttgaaacaaacaaaaaactaacaataaaagaattttaatgcattggatttctgtacgagcaaaggaatatgtcttacttcgatatttttatggaatggaccgaagtgcatattttttagagaaaaactagcatgaggttcaatctcatgtttattattcctatatgacgcaaagttttacgtttttgatatgtgtcatccaaacattagttttggaagtctagtgtgtttttaatccctatggacattcaatgagtataatactttgttctcgtattttctttttctgtttttacaatcctagtatgctcatagaaaataattaaaaaaataaccgagtgctaatcattattcactcctaatattgtacatttaaaatagcactatcatctctctctgtcattttaggagtttcaaccaattttaatttatttttcacatctagccacacacacaaacaaataaacaaacaaaactaagagataatccattctatgcgattgacaaaacatgaattctataatatgccgctgacaaagctcagttctataatataccatcgaacaattagttttcttcctaacatgctatcgccgctagtcaacagttagtcaaattccgttaagagcaagaaaatatatattttacccctagggtatcatgcatcttcatcgatttcattggtcatgatccactatttcttctcatcgatgaaaaatagaaatacttgtcttttcatcatccaagattttttagtgcgacgtggcattgtgcaaaatctcaattttatcctaggtgtaaaatggtcatttttcctctcttaatggcgtttgactaacgacgatgacatataaggaagaaaataagttatttgatggtatattgtagaattgagttttatcggtggcatattgtagaacctacgctttatcgatggcataaaatggattgattcaatccttagagtgtgtttagttcacgtcaaaattggaagtttgattgaaattggaaaagttggaagtttgtgtgtaggaaagttttgatgtgataaaaaagttggaagtttgaacaaaaagtttggaactaaactcggccttaattaaaaccctcatccatttgtgatgttcttcttcgtacctcacaagtatggatatctgccatcaccccaccaccaactccgtacccttttggagtgaagaaagaacatgtggggccaaagaacatacatgtcaactaccctcataaccatctctacttttcgtggaaaggaaaaataatattgtgaggctataggacctatatgttagttagaaatatatataaaatttaagagataatgtataaaaagtaatgataatagtcggttaatgatcatttttagcaattaaaatcctgttacaacacacgagagtaagttattaggttggttgtagatgatctattaatttttaaaactggtagttgtcttatactatttttttatgaacgcgcaaaaggattgcacgtcaatatattagaatgaaagagtttttcttacacaatacaatcagccagatcggcttatgccaggggaagggagaaaaagcaaagcaaaatctgtctacggaggctaaactcaactccgatcagtaggaagggggcaaaacatgctaaactcccaagaaatctccaaaagcagcaacgccagttaaagaccacatatggccctctgagagaatggactccagaaccactgaaacagaagaatggactccagaaccactgagacaaaagagagcgcaaagtcgaaaaccctggagttccgttccttccacaattgccaagagaccaggagtaccagggagtccaagccgacacagagatgctcaggcaagtaggccctagaggatgatcaccagtcctggagccagctacctcgggggagggggtgggtaccctagccaggaagcgacaccacacggagccagacctaccgagcgaacacgcagtcgagaaggatatggttcgccgtctcaagatgctgagtgcaaaaggggtaggccgagtgactatcaatgccatgcttctagaggagatcggccgtccagtagcgctgctgaaatgcaaaccaaagaaagaccttgcatttagcaggactcttcgtgtgctagagaagatcagcacgtacaaatgagtgttgaccaaaaaagaacgcctggtatactgaacgcgccgagtagcactggtcactcatccaacgccaaacaagatgatccccgactcctggcgagagcttgtatgtgaagcaccacatcctacacaagaaggagctgggaaattaccgggacagtgagggcatcgcggatgtcagaaac

SEQ ID NO: 65061 - DNA, 2139 bp, Oryza sativa
agatgggcttaaaactcttagggacgaattaaaggtagttctaactatttctctgttgcgatctctaatggtgggttattatttggcaaaataatagtttgttaaataataatctacagtctggcacttttatcttcaatgttaaaagtgcggggcgtcacagctgcggcaaccacactgtggtgcagcggctgcaccttacagccgaacaggcctagtatgttttttattctctgaacttaaatttggactttgtgagctagggccattctagtcttgcatttgcaatccataccacctcaaatttgtctcgctaatttagtttgaaatgtgtctcatttgtaaacggtactacgtaaatatggtattgcttagatgttttttttctcaataaacaaaatataaagatcgacgaatatgggtggtttctaaacttatccggttgtgtcacccaagtgaaaaaaaaaactacttgatatagcacattttgggtggtatggaagttaacaataataattgaatggaactaaactagcatataaaaaacccaagaatctcctatataaaatcctaaaaacaaaaatgtcaagatattataatacaagtgttacacgttgttgaatacaccaaggtctccttttgaacccctgaaatttacaaggttttcacattgactaatttaatcggtaaaattatgtcaacttggggctgaatctggaccgaattagcatgggccgatcagcccgaagcaaatcatgaatttttataccggacagacttgatcttgtactggaaatagatccctttcttttatgtctctcaaccataggtcaagttgcaatcacatcccttggccacaaaaccatgtataactcgtctctcagacttccaaaatcgatgcaaattcgaaacagttttaattgatgtgatgcctatgtagcatgttatcctggtcttttaggtgatgtggtacgacagcattgaacggggagcaaacaccgagatagcgagacaagagaaatttaactatttgccacataggaatgtcacctcttacaaactctttttttttaagaatttgccattttcgatgaagtgacgtgccaactcatactactagcatgcataggacatacaaaatgtccattttaccccttatgggaccaagtcagcccatcccctccctccatctctcttcatctcctgctagccaggcaaatcgagaggcttgacgtcggcacccactatctcctccgcctcaacgtcctaggtacttactagtaattcaaacgatgtaacctaatggcgatcgatgtgcttgatggtcaatttattatgctgcttagagtaattttcttgttttatattgaagagttcaaggaggaggatttccaattccaggtgggattgttgtcctctaccattgaagtttttttttatttgtaggcaactgcattgacatcctctaccttcgttattatgaccttttaattgttgtatactccctccgtactcgtaaagtaagtcattttggacagtgacacggtctccaaaacacaactttgacttcttgtttctataaaaatatttattgaaaagtaatatatgtatacttttatgaaagtatttttcaagacaaatctattcatataatttttatattttcaaactctacaacttgagagttattcatgatttatattcccaaggtttgacttaaatattgtcctaaacgacttcctttacgagtacggagggagtatattgttatttgcatgtagacccttttgccccacacggtcattttttttattagaaaaattagacagttggtgagagtggttgacattctattagaaaaagtttggagttggtgatggggtgatgatagaactgccaccactactactcaattttgtaagaaagtttggaatatgatgtcaaatattgggagacaactataaatcagacgctcaatatacagctaaaacttatgcaccgtcatagatgtcttatccccactatcctttgctattgtattgattagcctccctccccctttctctccatgcccggatgactaagatctgcgtggtacaccactaatctcttaatctttttcaaaaagtatttaaccaa

SEQ ID NO: 65062 - DNA, 1078 bp, Oryza sativa
aaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcagggctgcaggaat

SEQ ID NO: 65063 - DNA, 10958 bp, Oryza sativa
ggccaatgggccttaatgatcctaatataaagtctccacaaatatattttgagttgatcaaaagacgtttttttttttcgattttgctatatctcactcgaaagattttttcttatctctcactcgattttctcactcaaatttacagtgtattttcttgtaagttacagtgtaatttatgaaacttacactgtatgtaacttttgtaagttacactgtaatttttgaatcttcacatgtaaattttaaattttgtatttgatttggtctttttcttgaggatatggtaatttaatgttcattatggtatttcttaattgcttttttctttttattatatctatcggattttaatacaaagattaaaaatctgtgtgatacgattataaaaatctttcgaaagatgtataggtactcccttttttttttgacagagaattcatcaagacgttgttgggctaaagcctggtagaaaaaaaggaataagttcacccgaggtccctcaacttaacagcgagatttttcgaagtcccttaaccacaaaaccagaaatctccacccctaaactatacaaaaccgttcactcaaggtccctaggcagtatatatgggtggtttcgctgacatggcatcctagtcagacaaaatttttttttaaaagtaagtaggacctacatgtcagccgcacgtttttttttcttgtccttctcttctcttttctcgcttccctcttcttcttcagtgaggaggccggtggcgggcggagtggcgatggcggcgtgcttccgctgcgcgcagtcggcggcggcggcgtccggccccgcggggcccaaccgccttcctcccgcgggacggcgctgtccatcgccgtggtgcacgacgccatggccgcctcgaggctccgcggcagtggcggggcggtccaagtcgtcatccggacttctggaggcggaacgtgaacactgcggcgtagtcgtggatgacggtggcgtcgttggcacgagcagcggtacggtccacggcgaggatctcctcctccgccatgcttctgggcacctggccgacgaacagccacatcctctcgccgtcatcatcctccgcatctccggtcattaccgcgatttctctctctctctctcccgtctcttttccttttctgatggctatgcaacctcctgtccgtcctctcctcgtttttgcctgcgcctttggcctttctatatcggacgagcactaaccactgattgattgattgatcagtatcagtgtcttgagtataagttaattaatcgatgagtagtaccaactaccaagtcttgatctcgagtagcagtgaatgtgatcgaatcatctgattgagcaaaaagcagcagcaacattgatgcctccgcctcgccgtccagcgcgacgacaatgtcgtgctcggcgccggactccaggaaccgcgccctcgtggaccagcacccacacccgacgaggagacactggccttccgcgtccgtcactgactcctctggtggcagcgcgggacgaggcggttccgcgccgccggcgaccgccgcatcgacctggcgtgggacctctcacccgcgcacacttcccggtctcgggttcgcctgagccttcctttgggtgtagccgacgagccgccgtcgcgccgtggtaccgccccgcagccacagcagctgtgcggctggaacagcggtggtggccccttctcctcctctttctcccccggtgagtatagatggacagactacatcggcgtcgtgcgtgcatgcatgctgcattcttggcgtattagttttgtgcatggatcttacgaaggtcgggggaggacggcgatgatggtgtgccacgacgtcgagatgccgttcctgcgggggatcaacgtgaaccggccggcaccagcggcggagacgacgacagtgaggggggcaactgtagcgaggaggaagaggagcccagcgcgacctcccccaacagcacgctctccagccggcagcgacgacgagaactgcggcggcggcggtggatctcgtgtaccgcggctggggcagggatgggagcagcagcagtagggagaagagaagagaagagaagagagaagagagaaaggagaagaaaataagatatgcagctgacatgtggaccccacatgctttgctaactaggatgtcacgtcagcgaaaccacccatatatactgcctagggaccttgagtgaacggttttgtatagtttaggggtggagatttctggttttgtggttaaggggcctaaaaaaatctcgctgttaagttgagaaacctccggtgaacttattccaaaaaaaagacaggttgaagcccatgggctggtttttctagcttgcagcgatgcacgctggttgccacatgcggatgtacaatacataggttgttgcaacgttcgcgggccgcgaacgtccacgtactagacgcccctcaaatcagtctctatcataagaaagaaaaatgaatttaggatatcgtaataagaaaaataaataaatttgactaaatataacccatggtgacgtatcgactatcaattaattaagcaaacggcttgcaacctctgattgccagctaaaaaaatccacgatatattcttgtcctaagtacagtgacttatgacctctaatcccaactacaggtctacagcgatcaaatcacttgcgccactagcaaaattgacgaactggatttactgtttataaatgaaaaccacttcgtcgctcactcgcttgtagtctccagccacacaaccgtaaaggtccacacctcttctcgcaaccacttgagccactcgcaagtctcaagccaaaatcatatcacagtcgccatggaactctcctcaacctcagcttctctcctgctcatcctcctgctcaccctcgtctacttcctctacctgcaccaggatcccaagaagaagcctcgcacccatggactcaagtcctaccccgtggtcggcacgctgccgcatttcatcaataacaaggaccgtttccttgagtggtcgaccggcgtcatgaagcgcagccccacgcacaccatgtcgttcaaggagctcggactcaccggcggcgtcatcaccgccaacccggccaacgtcgagcacattctcaaggctaactttggtaactaccccaagggcgagcttgccgtgtccttgctcgaggattttcttggccacggcatcttcaattccgacggcgaacagtggctatggcagcggaaggccgccagttacgagttcaacaagcgctcgctgaggaacttcgtggtggacaccgtccggttcgaggtcgtcgagaggctgctgccgctgctcgagtatgcggggcgccacggacggacgctggacgtgcaagacgtgcttgagcgcttcgcgttcgacaacatctgccgcgtggccttcgatgaggacccggcgtgcctcaccgaggagagcatggccgcgccccagagcgcggagttcatgcgcgcgttcaacgacgcgcagaacgccatcttggaccggttcaactcgccggccaagtcgctgtggcgcatcaagaagctcttcaacatggagcccgagaggcggatgagggattcacttgccacgatccacggctacgcggagcggatcgtccgggagcgcagggagagaagggaggcccggctggagcgccgcgacgacttcctgtcgcgcttcgccgcgagcggcgagcacagcgacgagagcctccgcgacgtggtcaccaacttcatcctcgccggccgcgacacgacgtcttcggcgctgacctggttcttctggctactctccggccggcccgacgtggaagacaagatcgtgcgcgagatccgcgcggtgagacagtcgtcggccggcagcgagggaacgcgtggcgcgacgttcagcttggacgagctgagggacatgcagtacctccacgcggccatcaccgagtccatgcgtctgtatccgccggtacccttcgacacgcacagctgcaaggaggaggagttcctgccggacggcacgttcgcggggaaagggtggctggtgacgtactgcgcatacgccatggggcgcgtggaggacatctggggcgcggactgcgaggagttcaggccggagcggtggctggacgaggcgggcgcgttccggccggagagcacgttcaagtacccggtgttccacgcggggccgaggatgtgcctaggcaaggagatggcctacatacagatgaagtccatcgtggcgtgcgtgctcgagcagttcagcctccggtacgccggcgacgccaaggggcaccctgggctcgtggtcgcgcttacgctgcggatggagggtggcttgccgatgaaagtgacaatcagggagtaatcaaacaagcgtgatgctaggctagctggacttgtcgactccatactttatgtgtgtatcattgctctcgcttgtttggagaaataaaatagaactggtgtcgtgctccggttttttacccgaatggtgaatggcccacacacagccacgcttttcgggattcacgtgagttctgcggctgtgtttggcgcaccgagcgaaatgagatgggcacgagttgtcggatataggattgcagatttgcaggagaagctatttgcacgagttgatgggctgcccatggcgcgcccacatcgagcaaatttgaatacttcgtctcagccgaaaagtatgccgtggcggagcggtgttggaactggagacaaggccgagcaactgatacaacccctggtgctcggtgttcatcggttcatcctctcgccttccccgctgatcaatgatgagtgggcaagaatctggaacgtgtccaactcggttggccgaatcggtgagcggacttgcttttttttccgaatgcgcaaaagggtgagcggacttgtcttttttgcgaacacacaaagatgagcgaacttgattttttttcttgattccactgtggcgtcaagtttgccccatcacacggactaccttttgtctttgtttgtcgctatggcctcgatagaatctgctaagagcaaggtcaataatatagcccgttgttggctttaaaaaccagccatgtcatatatagtaaacaatataactaatgtctataataaaaatactataacacgaatattttattgtttcatgggacccaccaccttctcctaccggctacctcccattctctttctctctctttctcccatcagttcatgtcttctcttctttgtttggttcttgagcaacagagatggcggcggggtggaaaatagcggcggcggacgcaggagatggcggcggccgtgcggcgggcgttggagacggcggcggctgggccgagcggcggaggcggaagagggcggcggccgtgcggtgggcgtcggagacgacggtggccgggccgcgcggcggaggcggaagagagcggtgggcgtcggagatggcgtcagccgtgcaggcgaggggtgacggggaccgtgcgacggatgtgggagaccgcggcggccgtgcgtcgacgccggcgaggctgagggcggtggtccagtggccgcaggagttggcgacgaaggcaggcagcgcaagcatctaggcgagccccacgaactcctcgaccggcacgtgcagtccggcgacaaattagtcgtcggctcactctctctctctctctctcttcccctctctcctccagatcatcacaaaatcttatgtggaagcagtaccgccggttattgtacctgctctaaggggataagatgcaggtaaagctaatgggcggcgcccgcccctcccccctatacggctatacactccttcctccttcccttcttctcttcctattacagtacactataaatttttttttaaaaaaaataaaagttggaaaaatttatgtatagaaatactatatataaaaaattgaatttaaattcaaatttgaaacaggtatgcagacttttgacttataaactttgggtctataaactaatatttgaattcaaattcaaatttgaatcgggtatgtaaacttttgacttataaactttgggtctataaactttaggtgtatagaaatactatatatagaaaatatttaaatttaaattcaaatttaaaacagatatgtaaacttttgacttataaactttgggtctataaactttagatgtatagaaatactatatataaaaatatttcaatttaaattcaaatttgaatcggatatataaacttttgacttataaactttgggtctctaaactttagatgtgtaaacttgaggtgtacaaacttttggtgcacaaatttactaaaataggaaagtaatgcggtaccaaaaaagaaaccaggtggagggaggagggaccgaaccctgatcgctaggggcgatcgatcgccccttagcaatctcgataagatgcctcccacatcacagctcttagggcaacaacaatgtatatagcaaaagtagtccatatagatagatccacttatacaaactttaactattgtaacattcacaatgtatatggatagcaaatagtagtaggaggagagaagaggtagagacaaataatatattttattctctatgggcagcccatatgcttatgagtagcttttgttatttctttgctatggactagttccacaatgttactaggtggctgaaacaaatattgtattgcttatggacacttttagactatattgtggatgcccttacagaatggtaacaacccgacagtgtccgtcacagcgtgggcctaagaccaaatagaaatttcatcaaataataaatacaccaaattatccttatttatgcatccaaattaacacagggagacccatacgtggttcgaaattctaatacacatatagtttccatgcgagaaaattgtatatctaccatcgtataaaatgggattcgctcaaataccattgtttaaatgggtttcgctggaataccatcctcaaccaaggtgtctttgttcaaataccatcccagacgaaaatgccccatagttcttcttcctctctccttccatcccatcagctgaatagttcgccggcgaccaccaccggctccactgcctcaccgccgtcgctcgtgtcatcttggacatcgtcgcgcactgcagccccgaccagactcaccagccgccatcacgtgctcgcgtggtctcggctggccaccgtcatgcgccgccgcccaaccccgacttgtcgtcctcgccggtcgtggtcgcggtcggtgctgccgccgccgcgacgagagagagagagagggggggaggagacgccccgactcgtcggccgccgtcacgcgccgcctcgcttgtgtcgtctctgccggctgccatcgcacgccgccaccctgctccgacttgccagccaatgacgacatgagcgacggaccgccggcgacctattcagccattggagggagagagggaggaagaagaatagctaaggggcattttcgtctgggatggtatttgagcaaagacatcttggttgaggatgacattccagcgaagcccatttaagcaatggtatttgagcgaatcccatcttatgcgatgatagatacacaattttctctttgcatgcaccgcaaactgctatctatttagcactgccgcattccaaagtacacactcctttcttcccttttagtagcaccttctcttttcatatgaaaagtttgagattttgaattgattttttgattcaaaataaaagtttgatgtcacagttgtatgatttgactataaagtatttgagtttttaaatgaaagtttgattttgagttgaaatttttgtaattcaaaataaaagttatggggccatggtcgaaagtttcgtatgatttgagttgaaatttatattatctgagccgaaagttttgtgaaaatgctaataaaaggaaaaggagtttataatgggaacatgcaaacaatgtgtagccacatgcaatcctatatactccttccataaaaaaaatgaatctagaattggatgtgacttatcctattacaacgaatatggtcataagtctagttataggtttattttttatgggatagagggagtagcgcaagggaggaagatatacttaaaagtttattagccgtgcaatgtagatcttgaaagaagacattaatgagatgatcaacaattgttatcttgttatacatggtgaaactattaatttgacatatgcttcatatcaaactgttatttcggtttatattcacgccctcgtgatatatgctcaatgggaagtgactggcgtgtgctttgtgtcacgcatagaaaaatcaatatttttttaagtacataagccaaacggaaaatgaatggaattgacctaagggaacattgaaaagctaagcacgttagagtagttatttacctgcaggatttttttatacttgtttgtgcccacaagttaatgaaatacatctatactttttaaacatatttttaaacatatattgccatgtgattatatgtaattgatttttggttaagatttattgtgtccacacaatatcttataattgtactttccgttaaatacatttgatgtacaacatgaattgaattaagctcaaatgcatagattgctaatataaaaatttgaaaattattaaataaaataaaattgcatgtagcgtttagcatgggtatattactagtcatccaaaagaaaaaacaaattcactcacgtgcactcctttgtaattggcgggaatatattctagttacttgaggggatgacccctcgtataccttttctcctaaatgcactgctaataggtttttaaaaaaaatctttaaaaagtaacgatgtagagtatattgacatctatgatgcatacaccaaaaaataatcttaaattcgatctacaccttgaaaaaaaaagataataatctccaatttctacagcttcagaaaataatctccaattttcatgattagcaattgttgtatatatttcttcctcttcatccgatagtttgctaggaccgtcttcttgaaaattaaattgtccattaatgatatatatataatgaattgctggacgaacaggtggtgtgaattttggtggtatggaggagaagataatcctgtatcttccatgtccaagtctcctgcagacatctttcacagcgcttcctaaatcaaattgaaggatctgatcgagggttgcatagaaggaattcacaagaccatgatctataatagtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctccttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcaaagcaagatctgttgagatcaaaatcttatctgagaataccttggtattcttatctgttgccatagattgttcaacttccatgggaagtttatcttggccatcacgggatttctcctcgcgataatctagtaacctctcctcatgatgagggatatcttgtagtttagcccttttttctgttatcttttgatctgagggcacgaaatttttgaaataatatgccaggccatttaaggcatgagctttttcttttttgttttttgcctgccacaagaggtttaataacccttgttgtagctctgttactctgaaattgtgattaagtcgttctccatggcctctgggcagttggggcagtctccatgaactcatattcgtgaaccattcagacttttgtgatgccatttccctgcatatatattcaaaatttttagtagcttttaataaatatctatcttcctatgatgtcttacctggcaagtccatagattttggaagatatgatgggaaggaattgtcatgtagatatattgtattcacaacttgttctcttttggtctgaacaagctggtcaagaatctcatctgtgttagacgaaaatcttaggctcacctgtttgcccattatctcaaattgaatatcttcgtttgtgacaaggaagggacgaatgagtgataaaaacggtgttcctaaaataacatcttgcttaagatttttaacgagtagaaaagatgttttaatgcaaacttcagatatgcaaatatagatttcagggatttgatattctactgttaaaagtcctccatctgccccacgaattctgtgggcggctttacagaaatatttatgagggataataccttctcgaatgcaattgacatcagcaccataatcaattaaagtgatatactgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctcaat

SEQ ID NO: 65064 - DNA, 1598 bp, Oryza sativa
aataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggcatggcggcaccgggagatggggaagagaagaaggccgggagcgggaggaacaagcacgggttcccgcgcggcttccgcttcgtgccccgggaccaggagctcctcgacatcctcgacgacaagctccgcggcgccccgctcgaccgcgcgctcgacgccgtcttccacgacacgcggatcctcgacttccaccccgccaagctctacggtagccaccgcctctcgatccctctccccctctctctctctctctccttcttcttcttctccggcgacgggctgggtgggtgctcttggggatttgattttgactcgggtggattggactggtttggggcgacgcagggatgtacgcggaggacgaggagaacggctacatctacttcttcagcacgatagagttcaaggcagccaagcccaagcagaagaagtggccgcggcgcgcggcgcagggcggacggtggaaggccgtcctcggctccagccagatggtggaggttggcggcgtccccgtcggccggaagctctccatggagttctacgtcaagggggtcaggaccaactggggcatgcacgagttcgtcaggatcatcggccccaacatcgaggtaaactccccatgttgtatctccttgtgatgatcgaattcatttggtctgatttggatgcaatttgtgcgatcttgagttcttgactcgtacaattttttctctgaactttcgtttcgccaaggttgcggatcttgccgtgtaccgcctacacaagctatggacgaacggcgaggagaagccgggagacctcgccgcggacgttgccaagagcacgaaccagagtggacaagcgtcggcggcggactactaccagacttaccagaacgcggtctctcaggcgtatgcgtatgcgccgccgtacgtcctccagccaggatggagccaagggtacccctacgatgtcgcggcggcgccaccgaccgcgccctggcctgtctgttgggcgccgccgtccgcgccgggatcctatgactgctgctacgcgtccacgttttcaaggccgccgccgccaccaccaattgctgcgagcacgctggacaaggcgccgataaccagtaccgaccacggcgcatcaacgaacacttcggcggcgacacccgtggcgaacaacaagccgccgccgccaccagttgctgcgacagcgaccacgctgggcaagaagggggagggcaagggcaaggcgccgacgaccaccagtaccgatcacgccggatcaacgaacacctcggcgccacccgccgcgaactaccagccgccgccgacgacgactacgccgccgctgcagggcacgcagcac

SEQ ID NO: 65065 - DNA, 4874 bp, Oryza sativa
gccccccatgagccgagtccgtatccgtccataggaaggcacgtcgcttcttgtcaatagctttaataacttagactggaaggccgattgccatagacacatggatcgcaatggaggagagaacaaactagaccaacacagagcggctagccagagtggtgagtcgtcccttccgtgggggagggggggggggagtcgatgggaagctttatccacaagcggttgcagggctgccttcaacaacatgcgaacagacaacgtaatgccgaggtaggtgtaaggaaagtcaaaaatcgagcaggaaagcaggactgaaccaactccaggtcctcagccgagcaacgcatcagagtaatcaagcatttggcaaagctgatgcgcaacccggacgctgcaccaaagacagaaaggatgccctggatgcacaatatacatacatacgagttgttacattagaggatgagtttccaatcgaaaatctatatatacataaggcttccgacaattttttttcgtccgtgcgttttttttcgccgttttccttttttttccgtgtctttttcggttttattcccatctgcttcttttcatgggttggcatggctgttgggcccgaggatggtggcccaagaaggaggaaaggaagagaggtggctgctgggcccaagtggagatagggatgacggccaagaggaagggatggcagcccaagagggaggagaagaagaatgggccagatttgacctagacttaggagagggcttttagtttgtttttactttaaattaattattaaaattatatttgtattattaaaattagcaattgagctttgaaaaattcaaaacaattctagatagtgtggttcattcatgaagaatttaataaaaatatatttagtattttattttaataataacatgttatttaattctaattctaatatatacctctatacctaataaaaaaatatgtaaggattttgggtgatccgtttaattgtcgggtcaaaaccgtggttgatatagtatatgtatcttccatgtaatcacctctctctcctttttacacctatattacttgcactgtgtctataggcctctcggaataagtctacctttttatgggcctctcctggaataagtctacttttcctccctcctgtcaaatcatatttgcgcgcaattttttttttctctaccactagcacggaccatgcacatccggttgatgaaaaatcaaaactatagtacctctttcttcaacaaattttttgttgattataaaatcttataatgaacccgtttttaatttaaaaattaaagttaattatattatgtgcacaaaaatcctaattgcagctcatgatcttttaaaaagtatatattcaagcaaattcccacggtgaatctcaccttaactaaaccgtataacaacaataagattaaaatacatttcatccgttacaacgtatgggtattttttctagtaatatagatatgacattgttgtccgactcctgtgtacgaccaaagcaacgttgaaagcttcacacccgatagatgattcagtctatgatgaatcttggtgtgcgcatgttagctgtgcccacgccgtaacacgatcggacagcaacgtcgtacatatagtagggttcgtttccaatatacttgatcatgaggtggaaccattaccatatttttttcaaatcctgttgcaacgcacgggacccttttgctagtactagccaaaagtcatgaccaaaatataaaaatgggtttacacttgaataagagttacgttggaagttgcccttctttttggagtcaaccaaacacatggagtttatcaagaataagaccgatagaaacgaagctagggattaacaccagaaagtatttaacttgatcatacatacaagaaacatgattaggaagagtagcaaaaaaaagcatatccaaaacagtgaggtctacgcacttattattgttttctatttgaactccaatttctagaattagaggcttcttctcgtgtaagcaacgggacaactttttgacagtagatgacaatcttttacgaaggagcttctcctcccgcttttcatgttctgaaatttctgcatctctaaaagtatcctcctccccgttcttcccgaattgccttctgtgctccaaaaactcatccattgataaaagtttctgagagatggaataaaacagtaacttgcatcagaatctggtttacaatgattaccataacctgttgctctcctttaacagaatatggttaaactaatctgtttttattacaggcatgctatcttctttctacttttcttttttgttgcaaatcaggccgtgctatatctgttgagtaattcgccatgtaaatatgttgtagctttactggttgctttagcttgctactttcgttattgaaaatacaaggtctgaaggcagtttatacttttagtctaagttgctgttcatggtaaaaaaaatgcattcaaagttctctgtagtttaactatatagaatgtagacattcaatttgaacagtacagtgaaaaatactgcatcactaaacacattaaatgttctatttatttcttattggtaaactcgacagtttgaattgctaaaactgcattgtctccaaaaaataacttgtagatggaaggttacctctgaatctctggtcacccagaatactatcagccactttgaatcaggcaaaccaaggcgtggtagaaaattgtgaagcagttggagcataaggatgccagagttgaatttttcacgttgatggttcgtgctacaattttaatcacaatatctacccttgtgtaatattttcatgtgagaacctccagtttttatttctgtgactaacatcaatttgtttgtcaatgcccatttacttatctgtcactgactcactgttgagctatcagcatatgataaggcagcgagtactccatgattatgatttttcttgttaatattggtcacgaaatattttcagctgttggaggcaatggtgaagaactgtggtgagtatgtctaatttaaagttgctgaacagaatagtttaaaaaataaatggttaaaattgtgaagaagaaggtatctacctccttaggttattgccactactctcgccactactcttatgttgtttaaattagcaaaaagaagtaaaaaggagtactgcatttttttaaaaaactaatggcctatttgaatacaagggatttggatccaaatgcttaggaatttgaactaaataagcaatttaaaagaagttgcatcacccaaacggtgggaggttttggtatgttaagaatttgtggaaaagttaatgtccgcattttgattaagatagaagaccgatgctcatataattttgtcaggacatttacagtgacactgtttttctgagtattcattttccgaatttacaaaattgtaagatttatgaaaaacatggaatccaagtttccaacaaatcatccatcacgggaaaaaaaagaacagatggattaaaacattaacttgcatcaaaacctggtgtatgacgattatgacaacctattgctatccataacagagtatagttaacatgttttctatgctaacttatttttttatttttttacaaatcaagccatgctatctctgtatacggaaggttaaatatacagtcccttcttgtagcaggctattgattgattccccccaccatatattttggaataaacttgttccgaggtgtgttctgtactccctctacccaacttctactctcttttcttccgtgcccacacttcttgaactactaaaaactttttttaaaaaaaatctagaggaaagttgctataaaaattatattaatctattttaagtgtttttgtagttaatacttagggccctcattgtttcgcttatgtttatgcttataagctaaatttgaattttagaacttagtttttattttgatttgtttggttttgtcatcgtagtttagtttattctacaacatttatttttgagtcactaataacacgtatataaaaaaaattactcgcaaacgatgatttttttttaatttgctaataagcgattcagatgagcatacgaataagcgagataatggggctctcagttaatcatgggctaatccaccgccccattttgtgtgcgggtgacgggttaccaaccattagcttctaacacagcctaattaagatgatgtgtatgccctgataagcccaaaaccaagaactcaaggccagtggaggaagaagaagaagaaaacagcaaggctgtagtatgagatttcacagatgtaacgggatcccagaggaagggggggggggaggaagagtattatcacctcagcgggctccgtcctcccgctgcaaccggaggagctgaagaggcgccgcgggtggtccgcgaccgcgagcgatggccgggcgaaggaggaggaggggaacgccgcctgcttgtagacggattgtctcctcccagccaaatcggtggcggtggggaagaagaagaggctggattgctcccgcgctccatggatcgaccgccggagcacgccgccggcggatcggagcagcggtgaggaagccattctcaagaaaggataaaaaaaaaagaagaaaaaccttggtttttgttttttgttttttttcttctcgtgggacgcggtcccgcagtaataaaagggaggagtaggagagtaaatagcgaccgtgtcggatacgcctcatatttcgtcccggccttgttctcctttacggccgaaaatcgtgctgggccttgtctgcaaccctggcctgtttatgtgttccttatctatcc

SEQ ID NO: 65066 - DNA, 5014 bp, Oryza sativa
ggtctttgttgcttaaggaagaggatagccacaaattgaatggatattgcaagatgttagaggcaagggtcatggagttgtatgcaaaatatgggtggaaccttagaaggagattggtgtagtagtgtttctcttttctcttttaagtgttgtcactttggtactttttttatccttattgtaaagaattcgggtctaagtactcttgtatgacgttgggctgtgtacatccattgtggatgtagaggccggattttaatccattttctaaaaaaaaaaattcatgcgttttcaaattcactgtttccatgcgatttcctatcctatttctaatttttttttctgttctgcattccaaaggatccctaaagttaggaatattctcaactaggtacattaaaatctttccacccaacacatgcaaaatatgttcatacatttttctttctcatattcttccttcttaaaactattgtattgctaatttttaaaaattatgatttttaaattagtcaaatttgggatgatacaatatatttttagtgcaccatgaaaatatagaaaagttgaggaacgttctgaaatggaggaggacaacgcaagtgcaaagtcatgcatttactggtgcattagctaatacttttatgcccagtttaaaacatattatttagctgattatctacttgattgtagggatatttttttatatgaatgctttgaataagttatctatgcaatacagtagaagaacggttttttaaatactagatgacaccccgcacgttgtagcgggacttctaagtgatcaacattgatttttccagtaggattgcgtgtgtaagaataacactgatacaattatagtggatcacttccaatcaaatatggaaaatctacagaggttgtaaagcaatgtgacaaaagaaatacatttttttgaagaaagacatcatataacagtattaataaaagctatttgacagtacatgaaaaattgcaatccttgtcatgggcacatgccatcctctttttcaactcaagatgcatgctagtaactgtaaatgtcatatgaaaacactaaattcactttaggttgctcccggaatagtgtattcgatgataatcgagttaaactcttatatcaatagcaattgacatgaaaggaaaggttgactaatgaaaaatcagatgaaaggtctagccttcatagacaattgcgtgaaaaatggtgcaattggacttgtgcattggaagcaatggtggtcatgcccatggttattaagaccggaccagtgactaaaccgttagggcactcggtttactggtttattggtttaaccggtcacaccaccggttgaatatggtttaaatagatgagtgttgcaatactaaacacaacatgtggcatagcctggtggttgaaagtcttcttggaaacatggaggctgtgggttcgattcttccacgtgacgctgcagcctctgctcctccacatgagcggtcgaaccacctccggttttgtccggttcaagcggttttcgccggtccgtttgattgccgatcttttagccgccggtctgtttgattgccgatcttttagccggacaggaccggccaacgcccaggttccggttttttcgggtcggactgttggtccggtccggttctaataactatggtcgtgcctagagtgcttagtttgcttgttacccgagaaaatgcaagccgatcttttagctggacaggaccggccaacgcccaggttccggttttttctggtcggatcgttggtccggtccggttctaataactatggtcgtgcctagagtgcttagtttgtttgttacccgagaaaatgcagtggcagttatttaagaattttactatggcacaaccatgatttatctcggaacatattacactcatgcgctttcctcaaagagcgtaacaggggtgactatcgtatccttgtaacagagtgaatgcatgtagatggatttgggatgagataaatatagtaaacaacctttctcgtgaaaggatgaataacaaattgtatgcttaaagaagattaaattctatttgaaaattcagtaaaacgaagactaagcatctaattaaccatttcagtatgcctgtgaacattcctagataaaatattattcagtagttttccacacatcttctgccagaaaaaatgaagatgtcagttgaaatcgcaaaaaaaaagttccatttgtaatgtggttagaaaaacgaaccagcagatatgagagtacataatgaaattgaaaactaattaatcataccgttcaattcaagttactatgtacttaaaaaaacacaaagccaaatcaaatgatactgtaaaatgatagaagataaacagaggagttaccaagatgattggatctacccaactaaatgtgtagaaaatacatggattatacactttctacgtccatccaaacgaacccatcttctacattcttgtgttttcaaattcgctgtttccacgtgatttcctattctatttctatttctttctgtcctgcattcctaaggagtgttgaatttaggaatatttttaactaggtacattaaaatctttccacccagcacatacaaaatatgttcatacatttttctttctcatattcttccttcttaaaactattgtgtattgctaactttgaaaaatagttacatttttcaaaattttcaaatttgggatgatataatatatttatagtgcatcataaaattatagagaagtagaggaacgaggtgaaacggaggagtacaatggaagtgcaaagtcacccatatatatttaccggtgcattagctaatacttttattcccggtttaaaacaaattatttagctgattatctacttgattgtagggatatttttttatatgaatgctttgaataagtggtctatgcaatacagtagaagaacaaaaaatattttagaagatgcattttcatagacatggaacaagtaatccaccacaataatccgagatgaagtaattgtaaagtattgatctttagtactagttggtgccaccaactggtacaaaagatctcccgctctgaccactgggcctgacaagagtctgacaggccacaaccgggactgtggggtacgcagtactcgggtactcatggcaaggccttgggccatggagcattgggtggaccgagtgtcttagggctatatggtttacttgtaatttaagaaagggattgaaaataaggtgatcaatcttatcccatgtaaatagattgtaggtacacaaattataaggaataccgtaccatatccgcccggccgaccttgtaactatataaggggcaccggggcaaactctaaggggtgatcacgctctgcatatgtgcctacgagcaattccaacgctgtgctgcgcaaacctacagatccaatctacactaactagactagagtattacctcatgctgagggcctgaaccaatataaatatcagtgtccccatctctccttaatatttcgcaccctataaattatattgctgatcataagaatcgacagagactaaagatcatatggctgggtgggctaaacaaccggtagtaaaaaataatctttactaccggttcattttacagccgatttttgccgatagagcaaagattggttctcaagtactgtaggaaataaataaataataaatttaatattattatagtatttttaaaactaatcttgttatatactccctctgtttcacgatatacgaattttggtctctccatctcttgtctctctttgttagggttatagataccacatacctaatagtagttgactaaatctcggcaggacccaccacataccatgtcttatatggaaacaatcttcggatatacgatgagttccgcataaggaaggatgaatagagttctacatgaaaacgataaggactacttggattgtatccatattgatttccttaattctacttggataaggagacacctatgggtataaatacaaggccccctaggaggagaggggatacgaaacaatagatcaaggcacaagatcaacatacaagtcaacatgcgccaagacaagatgccggagatcgacttcagagataagcatggctagtcccctacggtgtctacggatactgtcaggagagacatagcgctgtctctgatctcgccgggcacagattcgaggaggaagactaccctgttgtcgactacgtgatgatacttcaggtcgccaagtcgacaacagttagataggctaccccagatattgtactggtgtgattatggtgaataagagcaacgaccagtttcggccaacaggatgtagggttattacctgacaattcaggggcccgaacctgtataaaaatcctcatctctgtctcttttacctcaatctcgcatatatcctagtaccaacgatccccatactatgcaaataccagaatcgcgacatcaaacgtcaacactcttgtctagaatcatcaacacacatataaatttggatatagatatgaagcacatacatgaatacatacataaatctatttaaaatatgaaacatcttataattaatgtgaaatagtgggagtaagttgttttactccattcaaactaactatttctgaagtttaaagcttaaccttgtatgaaatattaagaattatagaatcggaggaaatatggcttcaaggcaatatagtacataattagtgcacttaggctgtggtctggaaccttgccttctgacagggaaaataaagcaagcgaatagagcgagattaactaagtattagcctaaaaacttgaaaaataaactaatatgatttttttaaaacaacattcttatagagaaattttgtaaaaaaatacacggtttagcaatttgaaaaccgagcgcgcgaaaaagtgagaggtaagttgggaaagaagggggagcacacaaccttaaatggttctgtt

SEQ ID NO: 65067 - DNA, 1208 bp, Oryza sativa
agactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagcacctacgacaacgacaacggcggcggctgcatcgcgatcgacgcgccgaagctacgctccttgcacaacctcgagtcctcgtcgccggcaaggcgagacgagagccgagcacctccgcactttccccgacctcgagcgcctcaagctagtaacggaggcgcggctgcccgctgccggcgatgaggacggcggcggcagcgatcgccaacctactcgatccgttgctgcccttctcttcgagacctcagcctcaagctcgacacgttgcctacaccatactcgatgtcatttcatgcacaattaatttcaacaagatttcgacaagtccattggtcccttcacacgccggaaatggatgccggcgacggcggtttcattatcggcacggcagcaatggtgatcgtcatgacgacatccccgcgcgttgagtgaacgatcgttcacctgctttgcacagcagtctgagaagagttagcctcaagtttcagatggattcacccgacaactttggagctcggcttgtcagattcttcgctcaaattacgctatggttctagaagaaatgtgcatcgatagtggtttgtactccctccgtttcaggttataagatgttttgacttttgtcaaagtcaaactactttaaatttgaccaagtttatagaaaaaagtagtaacatttttaacccaagacaaatttattatgaaaatatatgcaattattgatttaatgacattaatttagtattataaatattactatatttgtctataaatttagtcaaatttaaaaaaaaccaaagtcaaaatatcttataacataaaacggaggaagtaataaacagaggtctacaatgaaacaaatgtggcagcagatggctcatccaagatttctctgaaacaaaagaacttcgttgatggttcgtcattggtcttctcaagaactcatatccaggtaggagtgaccaacaagctttatggtgttaccacttgaaatggggaagagtagtatggatgatttaagtttgatctgattctgatgtggaat

SEQ ID NO: 65068 - DNA, 715 bp, Oryza sativa
attcctgcagccccacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaatgccctgcagcaaggaccatccaagcttaaagctaggagcatgtttcaggaaaggagcacacgctccagttacagcctattactacatggaggtagcctcaagttcagccaaaacaactatgttttgtttttcctttttcttcttctttttttttgtgcagaacagaaagcatgccctccctgatattttcctcatggtaaaaagtaaaggggattgataaaaaataataataactgatgctaattgtgctatcaaacaattaaagtttttttttctccctgtagagattttagcagaacattgctctatttcctcttttattctaaaagaagtgctgctaatcagctgattgcctattcacaaattttgttaagagtttacaacaattgtataatcagacaagtcccaatactttcgccttttctttttaagtaaaacggcataccactgtcagttctattaccctggtatacccttatgaatcactagatattatgacatagacatcaaaattcagaagatatttcgtaggcgtca

SEQ ID NO: 65069 - DNA, 3738 bp, Oryza sativa
  unsure (1)..(3738): unsure at all n locations
gcggctgagtcaatgtgggacccacatttaggatgccacgtcaatctctctcccttcctactctctctctctcctcatctgacgccgcgaggagggcagcgccacgacggcggccggcggcggagaagcggcgcgcgggcggttggggagcagctggcgcgtgcatctgcccatgtcaaggggatagcacggcgagccgccgcccatggcgagcacgccgtcgaggttggagggcggcgcggtggatggcggagacggggtgcggaggacggcgagcaggttggagggcgccgggaagggcggggacggtgcggcgagcagcgtccccgagagggagtcgagttcggcgacttcatgcaccgccgctccttcttgccgtcacttcactccacccgccgctgctccgcctcgccgtcgctccactccgcccgtcgccgctccgctccatcccaccaacttcgtgcgccgccgctccacagcagccgcgtactcctgttcccatgtgcgactcctcctcgtcctcgtcctcgtcctcgtcgttgttgttggcgttggccatgggagaggggaggagagcgcacgcgatactgttcccgttcccgtgctcagggcacatcaacccgacgttgaagctggccgagctgctgcactcgcgcagggtgcccgtcacgttcgtcaacacggagcacaaccacgagcggctgcggcggcggcggggcgctgcgtgggcgggacgggttccggttcgaggcggtgccggacagcacggtgaggctgtacctgtcgttgcggaggagctgcgcgcgatgctggtggaggttgcgaggagggtggcgagcgacggcagcagcggtgtgctgcccgtgacatgcgtcgtgctcagtggcctcgtcagcttcgcgctcgacgtcgcggaggagctcggcgtgccggcgttcgtgctctggggcaccagcgcctgcggcttcgcgtgcacgctccggcttcgccagctacggcagagagggtacacgccgctcattcgctcaaaggtccgtttcgtccggtgagcgatcactccgtcgcacgtgtatgatcgatatcgccatggatgtgtttgttgtcacacgtgcttgcacacttggcgcgtgctatattgtatgcgatggactaaatcctttgcttttgcttcccctgccatggcagacgagagctacctgacgaacagttacctggacacgccgatagactggatcgccggcgtgccgacggtgcgtctcggcgacgtctgcagcttcgttcgcacgctcgacccgaccagcttcgcactacgcgtggacgaggacgaggcgaacagctgcgccagggcgccggggctcatcctcaacacgtacgttcgacgacctcgagtccgacgtcttcgacgtgctcagggacgagttcccgcgcgtgtacaccatcggcccgctcggcgccgaccgcgcgaacaacctagtcggcggcggcgccgctgggctgagcctgtgggaagaggacgccgcgtgcatggcttggcttgactagcagccgaccgggtcggtgctgtacgtcagctttgggagcctgacgtgatgtcgcccgtcgagctcgccgagctcgcgtggggcctcgccgacacccgcgcccattcctatcggtcatccacccaggcctcgtcgccagcggcggcggcactgatccgctcccctctgctcggctgatcctttgggagagagtggatacatacagagaagagaggggatgaggacagttnaggagaggagaggagagaggaagagaagtggagaggggagggaaaaggaggctgacacatgggtcccacgctgaatcagctgccacgttggacaaaacaggagtcaaaaccgccgagggacctagtttgcactagttttgtaagttggaggacgcgttgtatctggttttacggttgggggatgattttgtaactcgatgacaagttgagggaccttcggtgtactttttcccagtgataatagcaaagagtaaagttcatcaccggtctctaaacttgtaccgttatgtcatcccggtctctaaactcgcaaatcgaccgttcaggtcctcaaacttgttcgactgtgtcatcccggtccataaacttgcagatcactcgtttaggtcctctaacttattcagttgggtcaccccggtccctaaacttggatttgaatatcatctgggtcaaatatgacggtctaaagactttatatttaaaaaataattcataactttttcatgtgaactctaatgaagacaaactttatatcaaacttgtagccctcgacgcgatctacaactttgtagttgaatttttttttattttaagtcattttttgtcccaaaatgtaattttaaaattaaaatttcaaaatctataaacatgcaacaatattttgggaccctaaacggttttaattcaaaaacttttcaactacaaagttgtaggtcacgtcgagggctacaattttgatataaagtttattttcattagagttcacatgaacatgttatgaattattttttgatataaagtttttagaccgtcctgtttagggacctgggtgacacaactgaacaagttggaggacctaaacgagtgatctgcaagtttagggactaggatgacacagtcgaacaagtttgatgacctgaacgatcgatttacgagtttagggatcggaatgacacaacggtactagttcagggaccggtgatggactttactcaatagcaaaggtataagttcactttaggttcctcaatttgtctccgagttcgaaatatgtccctgtaccacaaaaccggatataacgcacccccaacttacaaaatcgtgcaaacgaggtaccttggtagtattgtccccggttttggctgatgtggcgcctacatggtgctcctttgactaagtcttcgtcccaacgtgacattgatgtgatgattacatgataattcgattgaaaaaataataaaacccgtgggacccatatgtaagttacacacaaataataaaaaatggcatcctcactactcccctcttctctttatcctctctctctccggcgtagcgggcggcggccagctaaagatggcgatctttagtcccggactcgtgatcccggtttgcaaccagggattaaagagggttgcaaaccgagaccattatggatttctatagcagtgcatctttttcatgagaccattcggttcgtatggctatcactggtcacacccttattattcactggtgctatttttacttattcccccatctgacattaaggactagatgaaaagacctaaatgcatctcccatttaatcctcctccccacttctccctctcatctattctctctttcatcttgtgcatccgtcaccactagccatcgcctccgattgagaaccttcctaagcaacgtcaagatacatcaagatggaggccaacagtaggccaagtggcccaaatcgacgacgagggaggccgtgcaatcaggaggcggaaggtgtcagtgaagttttcgacaaacgaggagtcaaagaagatgatgatacaatggaatggagctgccccttagcttagggaggaggaggccaaccgagtgttgcccactagtgccattggtggcttagagcaggtacaataaagattcatccgtcggcgatagtgtatccatgttggctcgcatgcatgctgtgct

SEQ ID NO: 65070 - DNA, 769 bp, Oryza sativa
  unsure (1)..(769): unsure at all n locations
ctcggacaatgaacaaggggtaaccacattggaggaggcaccaacaccatccattgaattcatagtcaattcccctaaatttcctgagaaaggtaaacttttgagaatatcagacaccaatgcacttttacccagtttaaggacaagagtagagcacctgccaaatgattaattgggtgtaaaatcaagtgccctgacccaggaaaatttagcatcctccttgcatgcatgaaagcggtcatccataaaccttgaattaactgcaggcccagaaattgcaggtgtattcttggtgcataattgagctgaaacaaaaattagaagtaaacagtatattnnttgtgcaggatataannnaattgtgattacacanatataggtagaagnaatatggntgccacttctgnannaatcgtagtccaagaggntatagtacaacaatttagccgctaatggtaatgttgtttggcataggaatgctactctttttttagattgttttactccaccatttgtaaaatctactcaaatatgtcaagtaaataaaagtttcatgattttgtaagcgtaaagaagtaaaaattaactaaatcttatattgtaaaaaagctcttgcgatcatttgggtagctaggtcacatttaataaaacgagtaagatctaaatcaacataatctttgaaaaaagttgagaactactccctccgggtgataatacttgtcgttttggacaagggcacggtctccaaaaaacaattttgaccattatt

SEQ ID NO: 65071 - DNA, 4510 bp, Oryza sativa
cctgcagcccctatttcatacgtattaagactttgaaagaccaaaccttatcatccccgtatttctaattattagttttttaaaagtcacatcaggtgctaccccttatgtcatctcttctttatttgcttgctcgatctaccactatttaacgtggtgccctccttttaaggctgtcttaataatataacaagatgggtggcccgcgcaattgcgcggttagcaccaatacaaaattatatatttttatatgattttacttaaaatttattaaatagttatcttgttgtcttaagagtttgaaagaccaaaccttatcatttccatgtttctaattttataattttaataagttacatcagttgctaatcgttacttctgtcatatccatatccttctttagttgcttgctcgatctataacggtttctattcattcattggatcttatagtatttagagtttattgtccagttaggtttcatttttataatttttagaaatctcgtcgaatgctgccattataaaaatcaaacataattatcatttttgttttttttactttctagaagttccgctaaaacgtcagcgactttgtcactatactccaatacagctcacctgctgcctcccttctttattgtcattgagattttaaaatcaaacatgattatcattcgtgtttatttttttttacttttcaaaagcccgaaccttttaaaattggatcttatagtttttataatttattgtctcgttggattttcttttttataatttttagaaatctcgtcaaacgctgccacagtactcctgccacagtactcctctacgacccgtccgccgcttattctttattgtcattgggattgtaaaaacgaatataattatcgttggaattcattttttactttctagaagtcccaccaaccataggcggctcttccattgtactcctgtacgacccgcccgctatctctcatttttattgtcattgaaattttaaaaatcaaatatgattatcattgggttttactttctataagtcccgccaaccaccttgaccggctgcttcacgacctgaccatcatcattctatttggtgctttattaatagtttttagatgtcctatcaaccgccaccactctaattatttatagacctattacttaattaatctcgtcatgtgttttagatggtcttttcttccaatagtccttatttgttatcaccaattttagttatttataaattgtattcctagttgaaatcttttttctttttctaattttagatttttttttcaaattttaattaataccgtatagtgttcttttaatatttttattttttatttctgaatttcagttgtttcaaaattgtattcctacttgaactctcttttaatttttctagttttggatattatttttattctgaattttaattaatctcgtattgggttcttatatggattcttctttcaatattgcttatttttaattcctacttgaactcttcttttcgttgtgctaattttggattttatttttatttttattctgaatgttaattaatctcgtattgggttcttatatggactcttctttcaatatttcttatttttaactccgaatttcagctattttcaaattgtattcctacttggattctccttttctttttctccgattaatgtgggaatttctagcccccatagcgaacgtggtgccttctttcaaagctgttttaataatataatagatagataaatagatagataaatagatagatgtgtatagtattagagcccagctattgtaccacatgtctcttaattcgtatgaagatgatgtggaagaagttggagccagaagcgggcggtactattaaacctgctcttataggggcatgcaagccgggaggcgacctttataagttgattctcctcttactaaactagcaatatttcacgaaacatatcatcacagttttcatgggccacgtaggtcacatcctaattggataggatgtcaaatgggggtaagctagcttgatctgctaagtgctcaacgtgagaaggaaggggcacgggagcattattgttcatacacgaatcttgatgcaatcttaaatgttaaaaaaactgcatgaaatttagggtattttcatgtgactagaaagataatatcccatgttgttgcatggatcgtagtctcacatgttcatcatggttctgcatagattatttcaaaaattgcatcattccgattcttcacttgtagtactgaagattttgattatttattgaatttagaaaaataaagatttacttttgttattcattaatttaaattctttgactgtcaaccctttttttagctccatcaatttctcaaaagtacttgaaaatcctatagcctctccctctctctctctaaaggttaaatctagtatttcaaaatttcaccatctcttctattaaaaattcttgattcaaaatgtgtattccacctcccttccattgaaataagccgagtcaaagcttcctcgggattccgcttcctacgaaacatacgttttatgaattaacggttaccaatagcaagcgatcctttcctacaaggtaaggccatggacaaaggttttttttatctaccccagcaggggcaattttaggagtcttttcaatccatcttactttgaatccgggttcgctttcactcggtcaagggttgccctttacctcgttctatggtcctttatcccctccttgctttcctagtttgtttcctttccgagacccaaaaccatgcatcacaatcagagggttaatcctccaaccagaaccaacttaacctatggatagtttctgccggcagctcctgacctcttctctcataccggcttgaagaagataagcacgtaaaaggaatgtaggcctcgctttgtagtactcgtaaaaggagctcactatcatgccgattacgagcagccgttcgcagcaatggatttggatctatatatgagaaatatcatgtggagggactattgctttttcctctaatccgatctggtaatcgaattcgcatatcccaacggtttggttcctttccttgtttagttttaaccagttccccctttgcttttgccaatcgcctgccttgttgtttttcctattcaaccaccccaacttgtgacgtataacgatgcaggtatttcagtggttttcttctgatgcttctatgaaattggattatatatggagaaaacaagaaaataagtaaaacaataactccaaaaacatgaactggtaagtaaaataatattgagcatatataaaatcaaaactcacacatacatacatgtgtaaaatacaaggggaaactattttgatctctcgagagcatgtcccgtcgtgtgcttaaaaatcatctaaacagttatgaaaaattctagaaaaaattaacgaatacgttgcctgtgactgaaagaataatcatcagcctcaaatgcaagcacctatgttaaatctaaaacttaaatcctagcggataagtttcaccactaaaattctagacaattaaactatgctcactttactcgttgtgtggggagtccaaaagggaatgagatcctctgatataagttatatggctttgagccaaaattgtctcctttgttttttgtttcacagctcaaggaaaaagcatacctacatgattttccatcacctccatcacttctgcattaattaattcctagtagaatacccccgaggttcctctagctgacttccaagaccaagcatagctcttatttccttggaaggattttaattctctatatgaaaaactctcctttttgtttcctgtatacagaccaggtctacatctctatctttgatcacctctttcaattaccttttttctggctatatttcccaaacctctaacattccagaaaaagcatttatttttttcctttgttttttggagccacctctcttcttctgcacaggacccttaattaggagagtcatcatttgtgttattcacctcttcctcatcatacacttctttctgtcccccatcatcattaccaactgcttgagtttgagacatctctatggctttgttctcctcctcttttttccatcttaattctgcaagcttagcctgggccaactctttgactttaattgtatccatgtttcatttatctctacagagttattaccaagggaaatatttgcagcaacagcaatcctatattcaactcatcatgatcaactaattggaaaatagcaaaagggttagagttacctggggcttccatgtttttcttctgcatgcgtgcgccatcatcgagggcgggaagcgtgtggccgagtgacaggcgatcgagaggattaattcgcttcgacccatcgtcgacacatcgccggcatcgtcctagctactaggagtagttttgacgacgtgttcatgccaacgtgtgtcatcgcgtc

SEQ ID NO: 65072 - DNA, 966 bp, Oryza sativa
aatgccatagtatggagtatctattttcatatattgtggcataatactttaattgcttaactgtgtaagtaatgcatggtttatcctatcatatcatatggattagccccatgatgcattctgccatatggcacatgctttctcagggcaaaagcccccgttttttttttctacaatagaagtgcagcaggacattcgattttccctcctttttcaaatacacatctttagagcactcaaattgtgttcccaaatacctcattctacagttttgagatgaccttttatcatctttttttgtggtatatccatccatccctttacctatttccagtgttgtttataattatggactagagcacacacaccatccgaaaaacaatgagatatcagatatattaaggaattgagggaatacaagctcgtggtttcaccaaagttgcacttaaatagctgactttgacatactttttgaacagctgccggactggaacattatgtggagtctctaatgaaaagagcagatgtggagtttaatgtatggattcttctcctgtgtcttatactaatttaagaagccacctctctaattttgctaaatccacaatcaccatttttatttggatgtgggggatcttggcacaatgtccaaactccaatcagccccccctcccccccacccacccaaagtacttaagactgaagtgaaactgcagcctgagtttgattgtagttgacatgaatattgtcaagctttgaatttgttatttgtggaaaaatcagtgtggtttgcttccgtgtttccttgtaggtggttgtcacccaaatgaatgggaatgattactcatcgaactctgtccatgcatttcatatcggaaaaatgagaataaagcttcgaaaaggatggtctacaaaagcaagagagtcatactcgaccacaatgaaggtacgcgtgtagtttaaata

SEQ ID NO: 65073 - DNA, 12145 bp, Oryza sativa
cagcacaggcacaagactcaagtgggcgcaacgtacgtgtaaactcgactttgacgaacgagttgatatgaacagcgacggcggcatggccctgtcggatctcggtcgagttcatcagtttccactacaaatttgtgcccattcctttgtatagcttcatggcccaccaaagaagattgacagtatagcttcgccggctagcttcagagcactgcaaaacaaatatataattaggcaatataattcatttattattattattattattattttaaatactattatctcaaatagatactaaccttgctgacatccaggacaacttgattctgtttttcgcatattccttatcctttgcttctttagctttggttctctcggcttccatagccctcctcttcgcatcttatttccttggaaggattttaattccctatatgaaaaactctcctttttgtttcctgtatacagaccaggtctacatctctatctttgatcacctctttcaatttgatactaaccttgctctttaagaatagccacatatgctaccctttttgtatcggcaagttcagccttagtctctttcagttcctcttttctctcagccataccctctttcagttcctcttttgtttcaattgtgttcttctttaccagtctcgacctatttgaacataaatgttgtaaggggatgtgaaagatataggatacatatcctttgaattctatatttgtgcaatctcgaccttaaaagcccattaaacattatacaaacacactacataaataccctataaacgctcttaaaccatcacacggcattataataaattaaagaaatcctaaaaattttgagaaaaaacaaaatattcgacctttgattttcacttaaaaagtgaacacattattttaggtcactagatctattatagataacaccgattaaatatatctcaagaaacaatctctcctcccaccctttggccgtacgtacgcatataaatacgcaacgtatgtactacctccatgcacaaatatatgacgttggttagctcaacaacatcaaacaaaaaaatatggagggagtacatgcttatccctcccctctgaccctccatactcttatatattttttaattcactataataataaaaacaattaatacttagatagcttagtaatttaagacccatataaaaataatgtaaaaatgaaaatacgttatttgaacagatctatgttttggagggcaatcaaataacatccattttttaatttatttgaactatagttttatttgtaattaaaaaagtaatttaagatttatattactcatattttgctatataaaattaaaatatataatttgaacatagtccaacaatgaaacaacaatggaacatttgaaatttagcaatatgtattgtgtcatcttaaatcattctaagtaataaagatccattaaatattctttatggtgttattaagtcaacacatgtcatattttacaaatcagagaaaaaatcttacaaatttaaagaaaaaaaataaaacatctgaccatgaatttccacttacgtcgttgacatattattttcaaacattagaaacatgtcatgtctttaaaaaatagaaacaaaatatctgagaaaaaaaaatctgatcattagcttttacttaaatagcttagaaaaaaaagctccctccacctcccttgctcacatgcacgcaacactacccaccccctcctttttggctcgagctctacgctagctattcatttgttataagctatcaaggtgaaagaggaacaactaatagttaatagttaatagaagctacgtatatgctgtctaatcttaatgctgctctattataaccaaaccaaaaatttaagatccatatgcatatactacctccgttttttaatagatgacgccgttgattttttcttacatgtttgaccattcatcttattcaaaaattttatgcaaatgtataagatataaatcacacttatagtactatgagtgataaaacaactcataacaaaataaattataattacataaatgtttgaccattcgtgcctccgccgtcgctgaccatgccgcccagtcgctgccgcgccttccgacggccagccatcgtcgccgtgagctctgccactctggcctcacctcgcgctgcgcagagccggccgcgccgcctagtcgctgccgcacctcccactagccaaccactatcctcgggggcggccacctccgccatcggccacaaccatcgcgcctatgccggctaccatcgccgcgggcttccgccacctccgcccgcctccaccaggtctccatcgcattgagcaccaccaacatcggagtcgaccactcttgatctagccgggggggggggggggggcagatccgcgttgatggggggggaccggatccgtctccagcatgaccagctccgtcgccctgccccgttgaccgcctcggccgttgcctcccacgccgaggaagagctttgccatcagcttgttctccccgccgccacctttccatccggccttgcggtttccaacggcgggctccggtggcggcgaggcggctagaggggaaggaaggtggtggcacgggcgggtagggtttccctcgagccgctcgcgtgacagcggcacgagggcatatgctttgctagctttttggttctctgaataatggattctatcttggcctatgttgttatgtgaaatggtgttatatattgattctgagcctatatgctaccattattatatttcattacaacccaaacattccaaagtttttctgccattcgatacattacaagttgatgtaattttttttctagttagcaggttcattcttactcatacctaatggaatgtaagaagcgttgtgaggacaagaagaaacactatatcgatctatcttcatggatttggaagagtttcaatgatttaatggagaaaaaatcaactatgattcaagaactcattgatcaattggaggataaaaacagatgctctatccaaaagttagtccacactaatgttgtttggatgcatacaatatattctgtcatgtttttctaaacatggctattcttttaaccgactaccgccgtgtcaagcaactaggtttgttaatttcttacacatttgtctttccccttgcccttcataatatgcatttctttggtgagtaatttcaccaagaacgagtaaatgaagagattaattggaaggcatagaattaatcatatgtattttgatgatctacatctgtcattatgtatatggtgttatgcagagtgcgatgccgacagatagatcgagttacatctgtcattatgtaacgcagacagagtaatttttttttttatgttctgaaaaaaaaagtatatctttttagttccacacacttggaattgatccaattctaagtctcctgcagattttggcagcaagttcctcatacgtcattcagtccacacgcttcaagttagtcagattgacctgaaagacaaagccaagcacgaagagtctaaatttcaaccaaatgaattcgttcggtcatcaaatgaccggtggttaaactggcacatataagtacaatctgcctgcatgcaatcttcagtcagctcttgaaagttgaataatcttcagacaccatatatacgaattctgcctgttaattaatccgtcaagaacgtcccccctgcgtaccggcattgtcgttcaggaaacttcagcttaattttcttcttctcgtttgaacagcgagagatcgatcgatcgagctgggagaaactattataagtagctcgtatcctctgaatctttggactcacaccattcctatacagcaacctagccagctcagttaagctgaaattaaacaaactgctgcaagctataactagagctaagtcacagttgtacatccgggagcagaagatgaaaagaggaggctcgtcgtcgtcgtcggcgactgcggtgacgatgacgatggtcgtgctgctgctcgtcgtcgcagcggcgtcgctgcgtgccgccgacgccgcggcggcggcgccgcgccgcctgctgggagctgacggcggcggcggcggcgggtcgccggcgctggtgtccgagagcaaggcgtcggcgggggcttccacctgcacgcacgaccccaacacgccccctagtggcactccttgcccaccgcataattgataattaaatcagctgcacgtcgtgcaattgcatgcaagattttggctgattaattctttcgtggcgttgattgaaatactacaggagtatatgtctatgtttatacatatatatgtacaacaagtatacatgttaatattgttcgtcattggttgtcgaaaataaaagtagagttaattagtttcatatatatcattgatgcacgcaacatatatagctctgaaagtagcttgtaaacattacagagtatactgtaatttattttgttcagtccatttacttgtgtgtgtatatatatacccccaggatggttacacgctgaaagagcatcagatacgaatttgtcatattcgttcaatagcgaaatacaaagctaatcttaaatttgttatggggtgtgtcatctaacaaatcatgtttaacaaatcacatttaggatataaatttaggatatccaaatacaccgctaatcatgttttattttatagaaaacatatacaacgttatcccgttggaacaggataccgttctatgagacagtacttaatacctgacacctgttgtggtactagctgcatggtagctgatacctgtgatatctgctaccagtacctgtgatacctaggacctgatacatgtgacactcgtgcaagagaatagttaatatgtctatcctgttgcaatgggatcccgttttgtagcaaccctcatctggttaagaattttgtattgagccccctcttctatagtatatccacaaatcaactcccagcactcccaaatccactctcacctagagacggcaatggaccccgttcaccgtttccctgcggtgaattcaccgtcctcctcctggtcgtcgtgtgcgtcgtcaaggcagcgatgtggcggctggcggtgatttttgcttttttttttggtttttttggttccgtgcgggtggtataacacaaccgcatgggataattgattattctgtgcggtcggcccgcccacacgcgaaaatgccgattttcccagacacccggctgcagacaggccggacaaccgcacggaaaaatcaaaatgcccgcacagaaaaatcttgtatgtagtagtgactatcgatctatcttttaaggattatgaagagttcaataatttaatggagaagaaatcaactatgactcaagacctcattgaccaattggaggagaaaaacagatgctctttccaaaagttagtccacactaatgttgtttggatgcataaactatattctgtcatgtttttctaaccatgactattcttttaaccgacagataccgtcgtgtcaagcaactaggcgtattaatttcttacacatttttgtctttgcccttgctcttcacaatatgaattttttggttaggaatttcaccaagaacgagtaaatgaagagattgattggaagacatggaattaatcttatgtattttgatgatatctgtcattatgtatatggtgatgtgcagagtgcgatgccgaagcaccagtaacacagacatagtatatcttttagttccacatagttggaattaatccagttcttaagtttcctgcagattttgtcagcaagttcctaattttttttagactttttaaattttttaattttattaatagatctttcaaagaaatattttcgagaactgaaacttttttgactatgcggccaagtggctggcgtggtaacgttgttttgccacgccagccacacggtggcgtggcaagaggctggcatggcaggacaatattgccacgtcagctgcgtgtggtgtaacaaagttattacaccagtcaggctggcgtggccaaaagattcagatttgaaaatactttttaaaaaatatattaataaattttaaaaatagaaagtctaaaaaataaaaaaaatccaagttcatcgtacgacattcattccacacgcttcaagttagtcagattgacctgaaagacaaagccaagcacggagagtctaaatttcaacaagaaaaaaaattcggtcatcaaatgaccggtggttaaactaacacatataagtacaatctgcctgcatgcaatcttcactcttcagtcagctctcgaaagttgaataatcttcgatcagacaccatgcgaattctgcctgtttaatccgtcaagaacgtcccccctgcgtaccggcattaatgtcgttcaggaaacttcagcttaattttcttcttctcctttgaacggcgagatcgatcgatcgatcgattgaactgggagaaactattataagtagctcgtatccctcctgaagctgtggactcatcaccactcttcagttaagcttacataccagctcagttaagctgaaacgatttagttcgaagccagaagcaggccggagctgaagatgaagggaggaggctcgtcgtcggctactactgccgtgatgatgatggtcgtgctgctcgtcgcggcggcgtctgacgccgccgcggcgccgcggcgcctgctgggagctgacggcggcggcggcggtgggtcgccggcgctggtgtccgagagcaaggcggcttccacctgcacttacgaccaaaacacgcactctaatggccctccttgcccaagtccaccgcataattaaaccagctgcacgtcctgcagttgcatgcaagattttggctgattaattctttcgtggcgtcgattgaaatactacaggagtatatatttatacatatatatgtacaataagtatgcatgttaatattgttcgtcattggttgtcgaaaataaaagtagagttaattagtttcatatatatcgttgatgcacgcaacatatatagtgctgaaaaagtagcttgtaaacattacagagtatactgtaattttatttgttcagtccatttgcttgtgtatatataccaccaggatgatttcacaaagagcatcagatacgaatttgtcatatttgttcaatagcaaatacatgctaatccttaaacttgtaatggggtaccatctagatccgaacttgtatttggatatcctaaatcatggtttattatatcacccgatatataaagtgcagatgtaacaacttgaacgttgttgtgggcgcgtccaggcagtttttgttttagctatctagttgagaattttgtatttagccccctcttctatagtatatatacaaatcaactcccaccgtaccactcccaagtcgactcccatcgcacccgtgggagaggaggcaaagagacggggatatattagtgttgctgcggtcatctattattgaaggatgtcggagccaagatagagggtgatcctacgagttcaatgtggtgttattgtacaatcgcgcgctgtgatcttcccgtaatatgtagtcaaacgtttggcttcaattgatggtgacaatcacgccacatcaagctcgcgagatcactctcttcatatcatacggtccatcttggtaggggagaaaatgaatcgaataatatccgatctggcctgctctgaatccgtccaaaacgaggatatgaaatgggtttatagaaattcgacaagtgtggattatccgatagtatatttgccggataatccaaaattatcaacctacataacaccatatttgttctatacaacatgagctgacttatccaataatctaactcatcaattaattctactctttagtttgaggctcctattgtctcatctcacacttacttagctgcatttttatctatactactttatgagataatctaagaaatgctgttgacaagcgtccaaatccaagaaataccatcaataagtgtgagtttcaagaaatgccatcgtacaaatgactttgtctcaaaaataccatcgtcgttagggttccgttcatctcgcgcccatccgcctctattctattaattaagatgattaattaagtataacaaatttttaatatatatttattcaatttttaaaaagcttttatatagaaagtatttgaaaaaacgtattgtttagcaattcagaaaatgtactcacggtaaataagtgagtaggcaatccaataagcgctttaattagaactcaactcatcagggagctacagggacatcttcacatcttcagttatatattcacgggctccatgttcagtcagctcttgaaagttgaatgttagactcaaaacttcgcaagaccgtcatccagataggctatcttagttcttcagacaaccatacgacgaattctgctgcctctttaatccgtcaagaacgtccccccatgcttaccggcattttcgtgcatgaaacttcagcttaattttcttcttctcgtttgaacggcgagatcgatatgatcgatcgatctatcgagctgggatctcttataagtagctctcgtatcctcctcaagctttgcactcaccattcctgcagcaacttagctaatacacttatgcacctctgcttagtaaattaattaagcaggaaactgcaaaagttacagtagtgcagaagctaagtgcagtgactagtagtgtgacatcgtcggaggcgaccggccggaactgaagaataatgaaggcgaccgcggcgatggtggtggtcgtgctgctcgtcgcggcagcgtcgttgcatgccgccgacggagccgcggcggcgccgcgccgcgtgctgggagctgacggcggcggcggtgatcagtcggagagcaaggtggaacataaatccggctgcacgaacaacgataacacacccccttctggtgtctgcccgccgaacgcgccggggccgtgattaatttgttcagctacacgtcgtcgcccgcatcgcaaaattaatactcctatataaattaattaatcagtataaattaatactcctatttggctgatgaattaattccttcttggccttgatgaactatattttttccgtaaataaaagtaagttcaggtgtgtacttgttgcatcgcgtttgatgcacgcaacacgtttaattgattcaacgaatgttgatttgttcagtatactcattgggctcttcctgtaaaagtaaatgatgaattttgttttggtgttttgttttgtgtgccccgcttgaatctgcacaatacattttggaataattatattaaggatgtcggtctgaacaaacacccatgttaaatacagtaaatacaaacgtcatctctctctatctaatctacctatctaaaaaacgagaaaaaacaaacagagacatacaaggatttgaaccgtttagacgtacacattgttatctagacatgtggccacgatcctgctttcttatatactccctccgttatgagatatatgacatttctgacagcatcgacgaaattaagtatacaacggtgaagtgaacatggcttaactagttaactagttatgttttttttaaacaacccacgtacctaggttcatgacctagactagaaatggattctcgtatttacgactaattattttttcagcgctagccgacatacccgtcaacatcgaggtgcccatggtgacttcgtcaatctcaaaatatctcaacatagtctttcggatgtgctaatagggtagggtgtatatgtgtgttcatatatatgagtgagcatgggcgtattgtgagcacttgcatttgcactgtgtgtgtttttttttaaaaaaagtatagagcgaatttactattttaccctttattcctcttcatcgatgtgtttgtccatgccgctgcgtcgccaaagccttggacgacgaggaggaccgagggggtttccgtctcccttcacgccggctcgttcgccatctctcccaagccacctcgaagctggctcactcgccgtctcccacatgccacttctcgtgaccacagtgtttagaatagaaaaatatggatctcacaatgcttagagagaaaataaatgtgggcgtgccagtgtatctaaatacacaaaatataaaacatgtacaacatatacagatacacgtgatctttattaattgaattaataagatatagttttcgtgtataatataaaaatcatgcaccattgcttgtcgttgggcagatcttgacatcagcgatgtgatcttctggttctcaggacctcgagaggctactggttattacctccataggttagaacctattggagaacctccgaataaactgcttgtgatcatctttttgtcttaacttcgtgttcttcatgcataatgataagatgggtgttgatgtagatgtgtgtgggtgccaacaacatatccacggcttcgtcggttcgtgcgccggtatcggtgacaagccttcatatagtctcgatccgcccgccattattgttcaacctcatcggtcttgaacaacgtgtaagtgtagtttgttggtgaagacatgatttgcgtagcttgaatagctcgatgtcacaatagttgcatcgagattatattagaaagggagaagccattggagaccgtccgtgttgatgatagcctaattaatcgtggcttggcacctcctacggattacgacggctctataattatgtaagaactagaggttggttgcattgaaattattacttcacgactgttaactagcattagcatatgaatctaaactgcaattttattaattatttgcatgcaatacattaatatgaacaatagcatactgaaattatgcactgccttgcaatatttgatgattatttaaaaaattaaaatatgacacactcaatttccaattgtcagttcctcattaattatttgaatagagaaaaaagtataaaatggatttaatatttacctgaaaccagcttgacctgaatacgcctgtaggtggtagctagttctggtgatcgatcagattgtgtgatccaaatggccgctagctcaggttatccgtgacgtcataggaggaaacttcatatgcattacatcatcagattaattaattgatcggtcattctatattatcccaggcaattcaacgaagtcacgattcaattcaactattcaagcagtctttgcgtcaaaaatgaaaatattcaagctgtcaatttgatcaggggctgtcagtatatttactgtacatattcttgtgacaattcagttctcaactggtatcgtacgcaaagaatgctagctggcacgtacatacatgtgcgaccgttattccaacagacatggcagtcaaccgggtcacatcatgtaaactagctgcatttaattgtatgtttagttccatgctaaaattaaaagtttgactaaaattgaaagtttgaagaaaaaagttgaaagtttatatgcgtagaaaaattttgatgtgatggaaaagttagaagtttgaagaaaaagttaggaactaaacaagggctaaaaactggatgaaagacttacaaaaaagagagagagagagaacatttgtatgtacgtagagagtctattttaaactctcaggagacttcccttggttacttgcatgttactcgaatagttatgaaaatttttttgagtagatgtattaatatgtgatattaatatcactctacaaacattcaacttttaactctataaacattcaacttttacatgtcgccacgaaaaaaacattttgattgtgaacatatcactgctagagaaaccatctttggtcggtcggccaaaatttacaatagtcctggttctaataaaaatcaggactaaaaacatattaatttagccccggtttaaaagctcaggggtactttttgacaccaacgggactaaagatcatttttagtcccggttcaaaaaaaacagcaggcggggttagacacctatattttttttagtcccggttggtgttaccaaccggaactaaagatctatttgtagtactggt

SEQ ID NO: 65074 - DNA, 733 bp, Oryza sativa
tcccaagtactaccaagtagcatcattgcgcattgcccgaaacgaaaactcgaaccaagcccaacacggtcaccaacggagaacaactcgctatagcgacgccgacgcatcaaagcatacaaacaagcaaacaaaaaaaaaatgaataaaacgaaccaaccccctttagtgccttaagaactcagagcgacacatataaccccatggattagaccaacaagccgtacacctcccagctcgatacccaagtaagtccccaaccccgccaaacccagcagaaatggggccggcgatccccgccccgcgcggcaccggagcacggccgccgccgctgctgccgcatcgcttgcatgcgcgcgagcggagaaaaggtaggagagagagagagaggaggaggaggaggagggggagagagctagggacgcggagatcaccttcgcgacgcacggcgtcggcggcggcggcggcggcggcgcaatggcgacggcgacgcggcgggggcggagcaaggagagtggggttttgtggggggaggaggaggaggaggggttttgatggccagagcgtggaacggaacggaggaatgaaacggaaaaaagaataaatgggccgtgttggaagtgggctttctagggccgaaaagaggatgtaggccttgcttggatgggccagaattctggcccatacagttcaggccttgtttggaacgggcccaatctgtctgtcatgggct

SEQ ID NO: 65075 - DNA, 26111 bp, Oryza sativa
cctggaccaggtcatttaatggtgccatagttgttaccacaagggcgtcaaaatatagactaagccattgaggcgtatgcacttcagttgagttttctacacatttggatataccagctatcactaaagaaattaggaatatgaaactttcaggaacaacaaaaatagaaaagaagtttgcagaatttatccaatcttgttctcagggctctgtttttttatggtgcatgctatgaatcacatcttttttcatgaaaagatgtgcatagccgcataggattttgttagacttgctgaagctgatagagaacaaaaacattccaatccaagcatttctgcaagtctgcattctaagagtatttttttgtaacttatgttttccatggtcaatcttcagttgtgtgggagccgtggtgggggtaatgctgcagctacggcagttttctggcaggcaaggaaaggcctgtcctacaccttagcttttgaaacggacagggataggaacgcagcaatcatgcttgctcgtaaatttgcctcaaattgcaatgtaagtgcttttgccttaaaattgcattttgtttctaacgataatgtggtcaagaatccgtttcattcacttgatgttaggaagcaagttattttatacccttttgtttgctcaatgcagattacgctcactggtccaggtgatgaagttcatgctggtagctgaatttacagtgttcacggtgtgacagcaggagtatacatgtaggctgtgaattgtgtactgtgtcagtttgtgttttcgagagtagaggttgtacactaggctttcctctttcagcatacattctcaaggcaattctttttatttgcctgccagcagctgtttgtggtgttcgtcaaacatgctgtgcaaaatgatgattattcttgagcattatatctattaacgttcgaaaagtgatagtttgcttagaaggagcttcccttgaataatcaagaaatgtacatataatcacttccatctatggtgcgtaactggtcgcacgaagtcagtggtgattgtgttgtattcaaaggatcaactattgtgttatctggcaagtgattttaatagggcgttttgccacagtaattcttctaatggagtcatttgtttgcctcatggagaattcacccctactgaaaaccttgtcctgttgaactaatgctgtatatgaggcattctgataaacccctgtaaaatcgtcctaatttccagtttgaccgttttattctgttcacccacattttcagtagtactacggcataggagtatgcactaatgtactccgtatcctccccgagacgtctgtccactgtcatagtcacatgcaagtcaattcaagtcttgagatacactaatcttcaatccaaagctagctgtactggccttttgtcagtgcacaatttggaccacatggaccacatattcacatgcctctctcaagctctcagcaaaattctcagcagtgtacagtatactcttgtatgcggtgtacttcctcgtgggtgtaaataaggcttttgcttaattccatcagaaattgctgctccactcttctcgctcaaagtgttctctcttttattttggagatgcttttcttgcccaaagttgagctcaagctcactttcatctcctgggaagtttgcacagtgccctgtatgacacatgctcgctcaaatcaacctttttctcttatgatttttcatcgtcagtaaattccaagcaggtctgtatatgttaataaaaagaaaactcgaatgaaaatgaaacttccagcctactacgtacgagtacatagtattgtgttgttaatggcaactccactaaaatggaaggcttttccagctcgatggctcaatccatacccatacctacacccaacggctagtttcgcgtggcagccgcggccaatcatagccgtccgatgctccgcttcctgaccgttgcgattcgaagccctcccgaccgttggagcggccgctccccctccgctccacgtaaaaaaggcaacgccacccgacacagaggacgcgccctgccctagctcgctatatctcgcccctcctccacgcgccgcctccaagaactgtataccaccacgcatcaatcacacgccgcacgccgacgccgattggttgatttgattgattgattgggcaagaggaggaggaggaaggggattgtttgctgctgctgctgctccagagctcgccggagccgcggtggctgcagcgctcgacggcggggaagaggggtcgcgggcggcgcggctgcactcgttcttcgcctcggtgatctccgggatcttcggccagggcgaggaggaggaggaaggggagatggcgacacgcagccagaacgtcgctgccgctccgcagccgccgcagaacagaggtgagcgaaaacagcgtgtctcagatctttggggctttggcggctgcgcggattcgagttcttgtcgtgttcctcgttagtttcctgttcggatcctgtcccaagattgggttttttttttttacacgagttgccttatctttgggtaggcttctcttccccccaaacttggtactcatcggttcattgtccagctccagcagttgatctttgttcttgttcttattatttcatttacctgctttttgattggatttctgaagaaaagattccaatttgatccctatttggtggtgttgttcagtccgacttctcaaaatcgcgaaattctcatagcgtctgtctcctgctcaatttcaggcaatgttgccgctctgggaaagcagaaggccgtcgtggccggcaggcccgacgcgaagaaccggcgagcccttggcgagatcggcaacgtcatgaacgtccgcctaccggaagggtacgtgatacgaccaatcgcttagcctcacgctgtcataatttcttctgctctttatctgaaaccttcacttgtgttcatgtaaacagcaagcctctgcagcaggcgccggccggccgcaccgccaactttggtgcccaactgctgaagaacgcgcaggcaaatgctgcggcaaacaaggtacatcggccaaccaaatccttctttcattctttgtcttgattcttgaagcatctgaatctgaaccttactgaaactattgggtctgcagcagaatgcagttgcacctgctgccgtggcgaggcctgcgcagaggcaggccaggaaggcgcctgtcaagcccgcgcctcctccgcccgagcatgtcatcgagatcagctctgattctgaccagagcatgaggcagcagtcggagggcagcgccagctctgtccgcaagtgctcgaggaagaaggtcatcaacaccctcacctccgtgctcactgcacgatcaaaggtgggttatccactgaaaatttcaaaaagaaaaaaaaaattctgcataccaatcactgacaggttatcttaagttcttaacctgtatttactccatgctaatgccaggttgcctgtggaatcactgacaaacctcgagaagtgattgaggacattgacaagctcgacggtgacaatgagctggctgtggtggactatattgaggatatctacaagttctacaaggtcgctgaggtaactgagtcgctctctctgcttgatccttcttcgatgcctacgcaaatgctgtatgtgcttggtcactgaaaggtgcaatctttcctggccttgctgcagaacgagtgccgcccgtgtgattacatcgacacccaggtggagatcaattccaagatgagggccatcctggcagactggataattgaagtgcatcacaagtttgagctcatgccagagaccctatacctctccatgtatgtcatcgaccggtacctctcgatgcagcaagtgcagcggagggagctgcagctggtaggtgtctctgccatgctgatagcttgcaagtacgaggagatttgggccccagaggtagcaacatttttagcccctttgctctgcactgcccatttctagcagggacttgttctgattggatctctgtctatgtatttgcaggtgaacgacttcatcttgatatcagatagtgcatacactagggaacagattcttgcaatggagaaggggattctgaataagcttcagtggaatctcaccgttcctacagcatatgtcttcattatgcgctatctgaaggcgggggcgtctgcagataacaaaagtgacaaggaggtaaagagccatggcttctgtttgtttctgtttaccatcggattatatttcattgctaagcaacaagtttgagcgtgtactcaaaatttcttttggtgaatgcagatggagcacatggccttcttcttcgctgaattggcactgatgcagtacgggctggtggcatccctgccttccaaggttgctgcctctgctgtctatgcagccaggctcaccctgaagaagagccctctatggactgacactctcaagcaccacactggatttaccgagtcacagctattgtaagcactacatgactcgatgacttgtttaactagcatcactgaaattctccattgagcagatatactgaactttatttttctgcgatgatttcagggactctgcaaagcttcttgttacctcgcactctactgcccctgagagcaagctgagggttgtgtacaagaagtattccagtgagcagcttggaggagtggcacttcgctcaccagcagtggaactctgcaaataaatggagattagctttgtctcgtatttcgtttgcttatttggtttagagtgcaatggaaggcgagtctgacattcattaggcgtttgcttgttttggagtcaagaaagtttggaatcttgacacgcttgctatgacttctaatggccaggatttggcctttatgtgataatacaccttggtgtatataaactgtcatctgaatcttatcaataacggttcttgataagtatgaatgatgatcgaattacatgtttgcatacaacaatctcgtgtcttgaatcgatcccatactcctcgaaatgttttaatagctctggcaacctaaaaaaactggtaatcaagtggtaccatggagatatggtttgcatctgtagtctcttgaagaaggttatagccactggtaatcaagaaacttgtgtctgtgatgtttgccaatcgaaggtttactatcatattcttggtgcctgacagtagcagttttgaaaccttagataatccatgtaattttcaactcacatataagatttataaaaatgaattaagtatagagcaagatatggttataatagagtaattcgaataaggttaaacaaatgatacattaattagactttcatcggcacattcaaaatactggcgttcatcttgatgggcatatcatctccatcagtgaagccagattacaatgcgaagatacacccttgtcgactgctctatgagaaatctctttccactcaagagcgtgcctccttattgctttcatctcagcttcttcagatgccatcagcctcttaacagcccttgcaatctcctcccttctgatcaggcgatccttgtctgtcgagtccctcaagttcactccaatcttccactcttccacaattagccggccattaattggttgatcaaagaacaatggtaaggtgagcataggtaccccagcaaagacagcttccagcgtcgagttcattccacaatgggtcaggaagcccccgactgaagggtggcacagaaccttcagctgatcacaccatggaagtatcatgcccttgttggtgttaccgacaagttctcgcactcgagtggattgttcacgaagaatccacaagaatctgacctcacttgtggcaaggcccaaggcgatctcatcaagctgagaggatgacaccgagacaaaactgccaagagaaacatatagcactgagttctcaggttgacaatccagccacgcgaagtaatctatccgtccaggagcttctccattggacttggtatgctcgttttcaagggtcatatacggaatgcagggcccaattgggtacactgggcaggtgactaatgattcaagagagtcgattacactggcctcaagctcatatatggtggtgaataggaggcactgtgcttttctgatgctagagatacatgctaggatatactccactgttctctcactgtgaattaaaggcttgagatcagataacattattgaacttgaagccaagcttgagatatagtgctcaagtctctgatcagggttatctgctgatcaaaagtagataagatcgtaagagtgaataattttgtaaactgttagcagtagatgattcagatgcacagaaacttacctctctcaaatgttagtacaaaacaaaaaaacactaagactactcaagtttggtacagaaagtggattcatcttaatagagaaattaaaaagaagcgatacctctcaagattggggtgaagtggcgatgtgttctgcgattaaaccccgactaggggatttgttgattggagagccaaaatgagaaagacaaccattttgacgacttaaaagattttgttagctgaatcacgtgagctttgttccagactcgcagtaatggatttatgtgaaagaacactaacaaattgttctcctatttgacggtgtttcatttaccacgctatattcacacctacaactgcctatattcaaccacctttttgaacgaattaaacccaaagcactcaaaacacttcggaatgtgcgtataagtaacaaacaaagctaagtgtctgcgcgagttcattccgcaccttgtatagtgtatagatttcgatgatctcacattttttccgcaccttgtcagctctgcttcagaaaccttgagaccgcccaacacctcttcaaagaatgtccctttgtgcagcagatttggactgaggttgggcgtcagatcaggccacggcgcttccaagactcatcagaggacagtacactgcttgactggtggcatagccaaacaagcaatgcagagaaaattcagaaaaaaggactacgctctgctttcctgacggtgctctgggaaatttgtacggaaagaaacaaccgcatcttccgaagcacagagtcgacacagccggcgattgcaagcaagattgtggacgagatgcagctttggggaatggcaggcgccaagggagtgcagaatgtaatatcgcgagagtagttcttttatcaccttaatgtaggcgggaagtgtttttcaagtactacaccgcaccccctgtacagtgtttttctaacctctctataatataaaaccagctccgctgggttctttcaaaaaacattttttctttacccctaggggttgtattttctcgtgctatattcaatgaaaaggcacactaatgctatttttccgttcagaaaaaaaaaacaaacaaacaaagcaagaagtaagtaacattgtattcacagcaccgagtaatagccaacatatgtctctcttggagccttatctagtaaacaggcagaaatcagattcagtaaatctcctaactcatcagttcatggatgtaacaatgtgggtaaatctctaaattgattcgtatgtgggtgattcagtaaaaaatgagattcaggagagggtaagcttgacagtaacaggcaatggaagcaatgaagagacctcacctgttgtggcaccggcgaccggctggtgcggcggtttagcgagccacgacgggaggctgtcgaagtggtagtaggcggagaagaacacggcggccatggggaagagggagcagacgggcacgcccctccggttgccgacgtccacgacccacggcacgtagaagtcggccacgaacgccgcgacgggcgccgctgtctcctcctcctcctcgagccggagccggtcgagcagtcgctcgaagggcgcctccatcctggcgccgacggcgtcgaggaagcccgcgtggtcggcggcgcggccgttctcggaggggatgacgttggggatggcgcgcagccgcacgccgggcggcgcggaggaggaggagaggaggccgagccactcctcggtgactacgaaggtgaccgtggcggcgccccgcgcggcgaggagccggctcaggttcatcatggcgttcacgtgcccgcgccccggaaacggcaccgccacgacatggcagcggcacggctcgtccccggcggcggcggcggaggtggaggcggccatcgcgctcgcaatctctcccctgttgtggctgcgtgcgtgcgtgcgtgcgtgtggttctcgctctcccctctccctttgtgtgtgccggcgccacgctgcccacacacgcatgcccacatgtgcacgtgtcgatggatattgatacgatcatgtgtgatggcatgatcataatataacattttgagtaattctcatttcggatcatatttcattactgatagtttactttaaaacatcttttaatcgacgttcttattttggacagggtagtcttgttttttctttttcacttttgactaccgaccctcgtctcaaacatatgaacgattgtttgaacaatctagaatacgtcgattcctactcatcaataaactcttaaatctcacagctatatacaagttatttctttttcatgtaacaagttagatgtagataattaaaattaaggatggtctaaaacaccatgaaaataaaaatacccaatccaaaacaaaaatattggttaaggaactattcaaagcaaaacattgataataaaatattatttcgtgaccttgggtaacagatcaacagaggataggcggaaaagtatcatttttcccgcctattctaagaacgagatgagttcgagttgtaaagcccaatatatggtatggtattttactatgagattaggactggcttatatagtccccaaacataaatgtggagttataatcttaaccccgatggtgcacaggaagttactacaatacccctatgatgctagaaacccacattgatgtggtcctccagagttcctgccgctagtttgtaagtgtggttggagcggcccagcgatatcttctcgagaaatattcctcactagcaacgtaaccttcaagcttcatttgccatgatcgaatagtacatttctcttgcagtgggctcaaatattttcttttccgaacaccggtcatttagtatttaactgtcacattaagttagccgcaagtaaaaatcaggttggtcagtaaaagggtatctgccataagtaaaagcctcttaggctggtaatctaagagagtgtttcgatagaacagggatgatgtttgcctcgtacaacagattacctaaagtaaaattttctcttccattattctccacgtggatactgatacacaacaagcattcacgctagtacatttatttacttttttggtttaattcacgctgttctctcactggaaattaagtctcccgtcggcgagatctttcacgaatccgttcaacgagcggcgcgacgagccaccgtccggtccgtcctgcacggcgccacggcaagcctcgcgcagcagcgcggccctcctcctcatctctcggctctcgccgtcgtccggatccatcagcctcgccgcggcggcacggatcgcgtccctgccgacgacgacgccgccgccgtcgtcctcctccctcctctgctccgacaggttgacgccgatcctccactcgtcggccacgacgcgggcgtccaccacctgatcccagacgacggggagcgcgagcagcggcacgccggcgaacacggcctcgagcagcgagttccacccgcagtggctgaggaagccgccgacggagcggtggcacagcacgcccagctggtcgcaccacggcaccaccaacccgttgccgccggcgatccgtcgcaggtcaccggcgctggcgctgtccctggccacccagaagaacctgaccgcgctgtcgcgcagcgccacggcgacctcctccagctgcgacggccacatggagacgacgctgccgaacgagacgtacagcacggagcgctccggctgcgcgtccagccaggcacggtgctcctcgtcgtcgatcttgccggcgccgccgtccagcggcatgtccgagattgaaggtccgactgggtacaccgggaacggaaccgcctgcgtgattctgtccatggcgcagggttcgagctcgtagaaggaagtgaagaggacacactgcgctttacgcacgttgacgaacgcctccgttgtcagcttcattgaccgttcccaagaccggaagatcttgacgtcagagagcctgactgatgagcagcctgggacatattgctccaaggacttgcggcttaggtctgcaaagaaaagaagtagagcatataataagttatgcaatgttaggccctgtttagttgcaaagtttttttttccaaacttccaactttccatcggatcaaacctttcatacacacgcaacttttcagtcacatcgttccaatttcaaccaaacttggaagtttggttgaaattggaataatgtgacagaaaagttgaaagttgtatcaaaagatgcaattgcaaatatgcatgatgataggaatgctttagcataagaattttaaaaatgcattgtgactattagttccatacttgtatctttttatgactgaaaactgaaatatgtttcatccaaaaaagggggaaaagaggaaacttctcatgtactagaatcaaatacaaatatattgtggaataaatcactcattttccattattttattgataacaagtacttgtagtcactgaaaaagcaaaggactttacttactcaggacacaccgacaaagaaatataaagtttatgagaaagggttgtgcataataagctaaggaagggctctgtgtttgtgacctcatttaatacaagtaaaaatctctgttttggcatcacggcagtagacacgtttcagcaaacattcctaaagttctttcgactgcatctaacttcaacacttatgaacctatgaaaaagttaattgatacaaaatgcattttggtttagttatatccaacttcagaacttatgaacctgtggaaaagttgactgataaaaaaaaatgcattttggtttagttgtcctagtaatcagattatctacttctttggtttctccgcaattctacattttaatagtgctgtaggggcaactaatttatcatttatggacaatgtagcagaataatgttttgacaatggtgtacttcccaaaattgaggacctcaaagtcaaatccctgtaagtttcagcccctatcttcattaaaagaaggtgcagttttcatcttaggccttgttagatccaaaaaattttggcaaaaaacgtcacatcaaatgtttggacacatacatgggatattaaatgggaaaaaaccaattgcacagtttgcatgtaaattgtgagacgaattttttgagcctaattacgccatgatttgacaatgtgatgctacagtaaacatttgttaatgacagattaattaggcttaataaattcgtctcgcagtttataggtggaatctgtaatttgtttttgttactagtctccgtttaatacttcgaatgtgtatatgcatacttcaaaaaatttacgcccaaagaactaaacacactcttaggaaagaacagtaggacactatttcaattagaattcacgaagtagcagaattcactgactgtgcatttataatttgatttcagaaacattaaaacataagatgattcagttagaaattgtctagaccaaactgaatattgaaacagtatgtttggatcatccaaagttcttggaagcatacgatatcttaatttgtttcaacaagaacatacccctatatttgaaatccccaatatttgtcattttcaagagtagaaaaggtgctacacactcgaaatttgacgtagatgtctagaaattattgtggaaatctcacatgaagtcggagacatcgtggaaactacagtagtgttgatttaaagagagaaaattcaaagcgagaaaatcggagacaaggactgaagccaaataccttgctcgccctcccggtcatccaccggcggccagaggtggatgttgtagagcgcccagaagaacgtggccgccatggtccacagcgagcacaccgggatcccgcgcgccgcgccggccggcacgccccacgccaggtaggtgtcggccacgatcgcgtcgggcctccgctccagccggtcgagcagctgctcgacggccacccccatcttggcgtccacggcctcgaagaagccggcggggtcggcgccgcggccgtgctcggaggggatgacgttggggatggtggcgaggcggacgcggcccgccggcggcagcgtggcgggcacaccggcggaggccagcagcccgtgccactcctccgtgacgacgacggtgacggtgagctcgccgtccgcggccgcgaggaggcggcacgcggccagcatcgggttgatgtggccgcggcccgggtacggcaccgcgaccacgtgccgggacacggctgtcgacgccatgctaatctctatcggactatctctgctggaatttgtgtcttcttggtggaactaatataaaggcagcacagattggagagcttttgatacactgtagtacttgataagtgatacatagacccagctgtgaattgggaggtcagagcaaacaaaggagaacaaattggcttgtcatttcttctgctcccaccgtcgtagcaaccgacgatccaatcctatatgtccaaattcgcagtggttgctacatattgagatgaagagagtacaaactagttatataaggtttactttgttgagcccaaatatcgatagttatgtgaggttcactttgtgggacccaaatattagtggggtggtgcttgtgactctgtctagcgaacatttcttgcttccatatcccaaattacatgctattccggagttgaactccattgttgctcttctagtgaacaattaacagcaaaattatagcccttaagggtttattcggtttggaggggatccggtttggaggggatcgaagagtattagaggggatgtggaataaatctccttcaatctcttctttatggggattaaccgaacaaggtctaacgatgttatatttccctacagtactgccatggtgtcaccttattaaaactgattatatttaatcttaacatagtatttaatcttatattgaaaaaataatccctgtgcgttaggtgcactgtacacttagttctcacataaacagataagctataacagtactgccatggtgtcaccttaccaattacagtactagctctctactatggtttccaagcttcacaagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgccccgagcaggaggtggacggccggagtgcacggagtagcggggagaagacggaagaggaggccatgaatgaggacgcgtccgcgcgggctccgtgtcgtgtctggtccgcgcgcgcgagcgccaccggctctttatccagacgccgagcgcgatatttttctctctcgcaggaaacgagaccgcaacgacccgtagacgtacgtacgcgcggctcagccgtgtcctcttgtcaaactggttgggataagataaaggagcggagcccggcaaagccgagcggcagcagagagcacagctcggcaacaccatggcgccggcagcgctagccgctcccatcgcgtccatttcccccagctccgccgggagggtcaccgccgccgccgccggcctccgctctgccaggatggccagctcacctgtagcccagcccattggtattgattgctccttcttccttttcttgccctcgcctctcggccttcttcacggatgtcacctgtctaacctttgttgctgttcttgcaaaggcgaggcagttgtgttacggcccaaccagatgttcagatcagtgctgcgacagcggaggcgtctggtggtccgaagcagcagctcagatgaaaccaattccaccaccgaagagaaggtatatccacacgaccacacgcctgatgaattgaaaaaaaattaaagcctgaacccaactgtgacgaccatgttttgttcacagacgccattcggatacacgaggaaggacgtgctgctcatcggcgtcggcgtgacactcttaggctacggcctcaaatacgggctggaggtgacgtctgttctttctctcttctccatcactactccagttcgctgcttcttggctttgacttcatcatcaagtacacttcactgacgaacatgtatgccttccctttcacatccttgccacaactgaacacagctggtcggagtcgatcccttgcaagcaggaaacgccgtccagctgatcatcgtgctcgggatgacggtggggtggatctcgacgtacatgttcagggtggccaacaaggacatgacctacgcccagcagctcagggactatgagaagcaagtcatggaggtttgacacttgttcattctagtatgcagtgtttgttactaccaagagtatgagtgactgacctgaagtttcttgctctttgttccagaaacgattggagagcttgacagaggctgaactgcaagttctgctcgagcaagtagaggaagagaagcagcggctgactccagtgagggatcagggtgttaccttcactaggaaaacggaggatcaggcgaatgccagctagaacaccttgattctgtaattagctagctctcctgcactgttagatagcttgaattaagaactagcggtggatgtggatcgtacgtcatacgaatgaccagctaatgtcttccatgtttgtgcatcattctgaaataaaaatagttggtaattctgcttatccagatttccagacacgtttatctttggataacccaatatttgaacaaaataaacatctgaatacataaattgctttcacaacaaacatttcggcgtgctccaccactcttacactctaaacttgctaataaaacagtaatgaatagataaactacttgtgcagtagaacaatatcattatttaaatctcatcagaactgcagcgaaaatttttttgttagaaataacgagataaatgcattaacatatgaatttccatgttatacttcaattgctttggtattgtgtcgggcaaagaggaatgtgcagaaaaatccagagggttctgagcaaccgtaggaagtataacatggaaattattcatcactttatctactcccaataccagggaaaaaaaagaactagatgtaatggtatatgtatcttacgaatttgattgaatgaatctgaatctttagctgacgttgatcctcagcagggagtgatcaaatcccagcatagcatgattcactaataaaaatgcctcttatggttagtacaaggtaaaaacaactgtaggatgcatgtagtactacattaaggttaacgaaatttccttggaaacgatcttgactgaataattctttgtttaaggaaaagaaatagggtacaatacttgcactgttgcctattaagcagcacggagtatatgcacttcacctgaaggttaacaaaatttccttgcaagtggtttgtactgaatcgccatttatgttaaggaagaaaaatatctatacaatacttgtctatagaaacactgagctcatgaagattaacaaaggaaatgcgatctttactgaatcacccttctttaaggaaaagatatatacatagtgctatcaagtaacactgagctacatgtattacaactgaaggttaacaaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatcagataagagtagaagattcccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctcagcttcgccctcgcacacattgtaccaataattccctggctccacgtccccaaatttcctaacgatcaggggatccctcgacttggagaacttggtgggcgcaaccctgctgtcctcgatgatgcggactccaagctgaccctgtgctccccacttgtcccaatcctcccagaaccgcttgtgttcaacgatcccgaccacggattgcaggtgctcaatgtcaatatagaaggcgaggcgcttgccctcctcgggcatgcccccggcgtaggcggcggcgagacagacgctgagatcgaggacgagggtgcggttgaggtagcgggcctcggcgatggagcagaggagactacgaagataatgcggcatgggcttgcaccggtcgccgccgccaaggtaagagaggtacttgcccgcggcgaactgggagcgcgagagcgcgggtgggggcggcggggcggtggcgttggtcccgccgcggcggggcttgcgggcgagggggccggagtggtattccccgatggaggtaacggagtaggcgcaggtgacggggtcgcgggcgacggagaagcggcggtagtccttgtagttggcggaggcggtggatcgggcgcgccaggccatgtcgcaggaggacgacggcgggtcgccggggacggggcggccgaagcggttgaagtggacgtcggggaaggcgtcgatggcgcggcgcatcatgaggtggaagagctgcgggtcggcgcagtcgagcgtggaggtggtgtcgcagctggcctgatcctgctgctccaggtgggacgtggtgggcgtcaaggcggcggtgggaggggagagggagatggggaggttgcggagggtgaggaagaggaaggcgacgagcaagagggcggcggcggcgtgggcggaggaggtgatgagggcgccccgccccagcaacggccggctcgggtccatccggcgacggcgacggccgacggcgatgagatctggtggctgattgtgtaataaagccccgtctgcaggcggcggacggtggtgaacttgtttctaggaagacgacgaactgttcctcttaatgggcctaacatgagtgggcctaagacgaaggcccatgatttggcccaagaatcgcatctcgtcgtggataagacgataaagcaacattgtgtggggatagccatagccctgcaccgcacctcgactccccaaacatggcgctcgccctcgtctcgccaatggcggctctctcactccactccgggaggatctcagcggcggctatcggcggcggcctccgctctcgcagggcatccccgatgggcgccgccgccaccccgttcctccggagctccttcgtctcctcctcctccacgtcatccgcctccgcctcccccgccgcgctctctgccgcggtctcggcgtcgctgaccttcacctctgcctcctcatttgctggtgagaatgtgtactttactcgttcctgattcgcttcgttctgttgctaccatttgggttggggaactagatggaggagagagttgcctgcaaagagaaagggaggaatgaacttttgtgctgctggtttcggctttaagtactgtacaatggagtgtttatactgtcagataggtagcgtgtacagttaatcagtgcttaatgtcagaagataactaaactaaactagcgattttaatgcaattgatatatttgaaagttctgatggtattctggcaatttcctgagaaatcttaaattcaaactctgccgtacttgttagctgctgtacgcagcttgttataatctgcaatgtctgatcctaaagcccacgcattcttatagttaaccatgtgctagagaattttgcttaagatgtggattccgattaagattaaaaaaaatcacttgtttacacatccagttttttagtgtaagaacgtgtatatatattcataattcagtgattagttctagatggttccatgttaggaaacctacacggctgaaagtttcttttcttcctccatgtactgtgatactgatattgtgatttccagtagtgccagatggactgtagattgtagtacattcttgcgacagaatcatgaaaacatcacaaaaactcaggaaactccactttttggagcgagcgcatgagcttaatttagtaaactcattatgaaatatatcatctaacataattatactacgaactaacgaaatcactgaatcaagaacgtttaactggacaactcaactttttaaacagttcagttacaattaatagccttgccacctaaagcaaaaccaaaatgctcctaaaacaagccaataacgttagattaaaggaactattgcaatgatattatccttttggaaaatgaactgtactttacatactagagtttttttccaaatgatcttagagaacaaaaacacaaactaagggcaatcaaatagccggtttctgtgctgtactgttgtatttagcaaatccatgttcttatgtatcaaaccatatttgttccaacctacaaatgatttcagtatcctaatatgttacatatttcaggttcatctttgggaattgaattcagctacaacagagttacaacaggaagatcccggattctgcagattagggctggaaaggctgctctgtgcatgaccaagagaaatagatctaggaagtcgcttgcccgtacacatggttttcgcagacggatgaggactactgccggaagaaaggtcctgaagcgcagacgcgccaaaggaagaagggttctctgcacaaagacgaactcccccactgggaagaaacgaatgttctgattgaatcgcattctaagtcgctctttgtcacaattgtaagtgtatttttttatcccacgttctcggttatactcaaccataacaattggtgcaaatccttcacccggtgtccggttaatgtgtgaagtacattatcaacacaaattcaagttagcctttttgcttgtgcagtatttagtagttgtttgctgtgggaatatgttctccttgatctgcattgccatggttttcctctgatctatcttgactgcattctgagcatagattttgccaaagggcctaaatgctaacttgagcagttgctcaaataaactcatcaatttttctattctgtagtagaacgtcccttttattttctgatacagtccagtgaattttaatattcagatcatctcatcatagtcactccatgctccactgtgtaacacaatttatccacctcctctgtgccaatctctttggtacacacttatttgtaaaacaacctgattgcccatccaatcctctgtcaccttataattttgctactatcaggcgaaaaaatggataatatccagaactcaacctggaataaatgaaaggcaacaagtagcaaagagaacatttacattctaacaaactgaatccctcctcttcttcactcgcatcggcaagccgccttccatcctcaaggtcaccgagaacacaagccctggccgtccctcgccgccgacgaacctgaagctgaacctctcgaacacgcacgccgcgatggacttcatctgtatgtatgccatctccttgccgaggcacatcctcggcccgccgtggaacaccgggtacttgaacgggctctccggccggaacacgccgtcctcgtcgagccaccgctccggcctgaactcctcgcagtccgcgccccataactcctccaagcgcgccatggcgtacgcgctgtaggtgacctgccatcctttgccgacgaacgtgccgtccggcaagacgtcgtcgttctggcagcagtgcgagtccatggccacgggcgggtacagccgcatcgcctccgtgatggccgcgtgcaggtagtgcatctcgcgcagctcgtcaaagctgaacgccgccgcgtccgtgctcccgctcgacgcgcgcaccgcgcggatctcgcgcgcgatcctgtcctccacgtccggctggccggacaccagccagaagaaccaggtcagcgccgacgacgtcgtgtcgcgcccggcgaggacgaagttggtgccacgtcgcggaggctctcgtcgctgtgcttgccggtcgcggcgaagcgcgacaggaagtcgtccttgcgcgccagccccgccgcgcccctctccctccgctcgcggacgatcctgtcggcgtagccatggatcgtggcgagcgcctcccgcatccgcctctccggctccaagtcgagcagcctcttggcgcgccatgcccactcgaccggcgacatgaaccgcgccatgaggatgttctgcgcgtcgttgaaggcgcgcaggaactcggtccgcgcgttcgtccccatcccctcctcggtgaggcacgccgggtcctcgtcgaaggcgacgcagcagacgttgtcgaacgcgaagcgctcgagcacgtcctgctcgtccagcgtccggccgtcgcgctccgcccgcgtgagcagcggcagcagcctatcgacgacctcggacctgacggtgtcgaccacgaagttcctcagcgagcgcttgttgaactcgtagctggcggccttccgctgccacagccactggtcgccgtcggagttgaagatgccgtggccgaggaagtcctccatgactgacaccacgtactcccccttggagtagttctggaagttggtcttgacgatgtgttcgacgttggccgggttgccggtgatggcgccggcgatgaggccgaagcccttgaagttgaaggacatggtgtgcgtggggcagcgcgccacgacgccggccgaccactcgaggaggcggtgctggttcctgacgaagtgtggcagtatgccgacgatcgggtaggccttgaggccgtcggcgcgaggctgcttcctggtgctgccatggcgcaggcagaggaaacagagcaaaggaaacagcaagaggaggagcaggggaacggatgaagtcaacgagagctctgtgcccatgtcgaattggtgattttggattggacgatggagatgccagcctcgtgaagtccgcagaggcgcagattatggagtgatgttgcttatttgattaagttagtcgatttgttgagtgcgagaattttcagaatatgccatcgaattcgcactactttcagaatatgccatccaattcatgctactttcagaatacgccatcggagcacgaatttcctttgttccgtgccactctgtctcttccgttcgtagcaccgtcgtcttctccgcccggcaccgccgtcgtcagtccgccaccgcccgcgccgacacccgtccgtcgccggcatcgtccatcctcgttggcgtccatcgtcgtcgtccacggcatggcgtgggcgcggagggaggcgagcgcgacgcgagtactagcagcggggcgagcgcggccgcgagtgctagcagcggctgcggcggcgggcgaagctgactgtctgcgtctgcgtctactaccgcccgggactggacctcgtgtgcgcgccttgtgaattttgaggcaccgttcgttccagggtgtttggggagattgagtctcgttttccgcgcgcacgcttttcaaactactaaacggtgcgttttttgcaaaaaatttctataggaaagttgctttaaaaaaccatattaatccatttttgaaatttaaaatagttaatacttaattaatcatgagctaatggctcacctcgttttgcgtatcttctcaatctcctcaatccccttcccctcaaacacaccctgagagtagagggcggccggtaaaaactccttgtatgttgttgctgctgcacgtacttggtccagatgatgagtgtgaattggcaaggacggaagggaacggaatgggtaggtagtagttggatacttggattgttcagaggaggacgtcggacttggcggggagtcgcttgtagaagttgaaggggacggatggtgagcgcggccgcgagtgttagcagcggctgcggcggcgggcgaagcggcggctgcggctgcgggcgaagcggctgcggctgcagaatggggcggcggcggggaaggggtgggggagaagccccttgtggatggtggggcgaggcggaatgcggcagctgtgtacaatgggggggcggcgtccgtggtggtggggaggaagatgaggaggacgaggacagggcaccctcgccggcatgctccagccggaggacgcgatgcgcgggcggtggaggacgacgatggcggtgacggcgaacggacaacgccgtggctgacacgggcgcgcgcggcgcgggcggtggacaacgacgatgccgacgactgacgccggcgcgggcggtggcggactccttccctccgcgcccaccgagccgtggacgacgatgacgacgacggacgccgacgaggatggacgatgccggtgatggacggacgccggcgcggctgacacgggcaccggcggcgaacggcgccgggcggagaagacgacggagctatggacggaagagacggagtggcacggaacgaaggaaattcgtgctccgatggcgtattctgaaagtagcacgaattgggtggcatatcctgaaagtagtgcgaattcgatggcatattctgaaaattctcaactgttgatgcttaatcaacggtccaacattgaactgggttactactttggcctcaataagttagacgaaaaatgcttcgtgttcttatccaaatatctcagtcacctcctccaccacacattccctcttctcaaagtctctctcttttcaacgcctctacacagggggttgcaagccaaggcgaggcatcgtcgctggtgtcgacaccggagcaaggcggcacgtgatagggaggaggtactcgacctcgctggcggccacatgacggcagcggggcaaggctgcgcgtggtagggaggaggcgatggacctcgtcggcagccacacgacagcggcggggcaaggcgacgcatgggagggaggaggcgatggacctcgtcagcggccacatggcggggtagacaacataggattgaggaggaggtgctggacctcgccagcgatcacacggcggcagagtgcagataacgcaggattggggaagaggcgctggacctcgccgacggccacacaacaacgatggtgatgtggcagaggtgctagatttggctgtcggtgaggactggacaatgcgactggtcttgggcgaggtcgccaaccttgtgccactattcttctcccacaagcatcaatttcttgattctagcagctagccgtagaagaagacaaagatgggttcattttattggagttttagtgatgttgcagcatattgttttatcttgttgcattttattgtattaaggtgtttaattttgtttggatttggtgttgcattttactgattcttagtgttgcaagcaacctatttcagatgttgcatttgattgaaacaattttgttcaagcaatgaaacatttttcctcgattgatgaaacatctgaaacattttcatcgaaacatttttcgtggagtggtgcaacatgtgaaacactttgtgataatatagtgcaacaccgtccgatcttttgtaatagatcggacgtctaatttgtagcagcctccaagttgagagtgcttctagatctaaatttctacacacttttgtggacttctatgtttatgaactgtttttctttcttttttttttgcaaacccggctagagatgccgaccaattttattaaggattaggagatagtttcgtatggtaaagcaacaaacatagttgtgcatatcatctactatcctttacaacacaccgaagaaaagaggagaagatgaacaatgttaaatgtggcaaagaataatggtcatgaaattagtttgagctaattcaaatcccatgagaagcaacggtctacttcttatctacttcctccacctcagaataggttaatctattacgaatgtgatatattcgtcagatttacagaactagaatatgtgacatcccgtaatagattaacttattctggtacggaaaaagtatagtttcaagggaaatcccccccccaaaaaaaagaagactctttgatcacgaagggccagacgatgaacattggatgcaatcagaaacgagtttgtcctcgtccttggttcccgcgccgctctaccacgtaagagctttgattgggataatattagaattttcccaacatgggcacgccgaaagtcatgtggacttcgggagctcatgtagtcatatgtaatgatgatgagagagggtgtcatgtggggaatgcactacgtccgcaggcgcaaggatcagcgacaacagcaaaacggcaaacagtagatacgcaggatttgttttcgtttgtttcagagtctgttaaagtttgttagtttgatctttatctctaagagtttgttagatggcatt

SEQ ID NO: 65076 - DNA, 7735 bp, Oryza sativa
catgcgcacgcggtttctatctcctcttccctcccggttctatctcctcctcctctcctttatctcttctcctcactcacccttctcttcctctccttctcctccccctcccccctcctccccctcctccccacttctctggcaggcggcggcggcctcgcgtggcggcggtggccgggcggcggctggcggtggaggccggcgcgccggcgaggaggccatggcggtggccagcggtggaggcgggcgtggccctgtatgattttttcttttttcctttttgattcgatctgtgtgattcgatgtgttgatttgatctgtgagaatgaactatattgttgtgaatgattttgagaatgaactatgtgttattgtgaatgatttgagatgattatgtttttgtggatgatttgagatcgatggtgagagatgatattttttaatgatttggagatattgggtgcgagatatgaaaaaaagaaaaaaaacctgttaccaactagaattaaaaataggcatctttagtcctggttgtataaccaggactataggggattacgaaccgggagtagaaagcctttctccagtatgttaactatttgtagtttaatttgctttttttcattgcgacatgcagaaagctgaattttaagtttgtcgagtgatatatcacatataaataaatcttcttagagcttttattaactatttaaaaatgacatgcaaacaactgtaagcatcctctgttcagaatagtttccctatgtatgtacatacattacagagcttatcagttcggctttatcgtgattcatgatttcaaagtgttaaacggaatattttatatattagtaaagttttttcttaaaacgttatataattttatttttgaagaaaaaaaaccatcatatagctacacgaagatatatatagttgaagaaactttgaagctatatatactatgcaaaatgaatcgatccatgcaaccatttggattttcaacgtagaaaacggagaaaaatataaacaaatgctatcgatcaatgttggacccgcagtctcgtatgaaatgaacgattggagaaattttacaacgtttttcccacataatctattgcacgaaaaagctaaggtaatctcctgcttcgactcgagacacaggagactagctagtcaaacgtttcgcagtgaaaaacaaccgctgggaaaggagtgatgctgaacattctttgtttgactagcttgacgcgactctagctagctagctgaacgatcagtacacacgcgttttgttcatctgtgatgcgatgcttaaattaaacaggtcgtctcttagctaccctccgttttaggttataagataatttgactttggttaaagttaaattattttaagtttgactaagtttttacacaaatatagtaatatttacattaccaaattagttttattaaattaataattaaatatatttttataataaatttatcttggatcaaaaatattactattttttttataaagttagttaaatttgaagcagtttgactttgaccaaaattaaaatatcttatacgctatctcgatcagtacgttgcagaccaagcatgcacaacgtttattatattttcgcctctttttcttacgtaacatccatgtcatcatctagccttagctttcatgaattaatgatgaattcatcagtgtttttcttcatccggctggccggtggtctcatcattaattcatgcatgcagcgtacccttagctttcccagaaattctcggtttaattcctcgatatatcgatctcaaccatgcgtgcttcagaagctgttttttagatgacagattcagctttgaaaggaaagcccaagaatgaaacatatatatagtctggccgaaagcgatcgagttgatctcatcaagacatcaaccatatatagggacatcacgtgttcatcaaattaatcttcagtcagttcttgaaagttgaatcttggactcaaaacttacctccaccgttttacaatgtaagactttctagcattgcctatattcatatagatgttaatgaatctaagagaccttttgcagcacttggaaggtacccaaggtacctctcctcaacttaaacatccaccgttgattctcaaagagtagattaggaattgaattaacataaacatgggcagtttagtaattgttctttagccatcgtaatcaaccgttctttattcttttgctatatctttctgcacacctggatgtaatttttcgatccatccagccgcacacatacccctatataatggatgactcaaatttcaaaactaggttttatacatccatccatctttattgtctttagaaagtaatccatacaaagagacggaggcgcatcaatcaatttttcgtttggaaatcttcagagtcacatgcaaatctcatgcggatatatggaaagacgcgtggatcaattacttagttctaatcatcaattatgtggtcttcaattagcatctagttacacgatctgcaaacattaatcaagtactcctagacgccgtagttagtttcttcattagttatacagattaggtgcaagccgtgtgcagtggcatcaacagactgaagacgttatcatctctctgcgctccggccgccggagcagcagaaaagtttcccgtttagttcttcctctctttatgaaatatagaaaccaaattacatatctaacctttttcaagtaatgcctggcccacatatttaagtaccttttcacatgtatgtggatcgttagattggaagccatgaacagatttgacgcactccaaacacagtagaaaatctctgaatatatatatatatatatatatgtctagattcattaacatttatataaatatgaaaaatgctagaaagtgtcacattattaaatggagggagtagtacttcttcatcagaaaccatgcataccaattcttccagtttgatccgtcaagaacgctgtcgatcaatcgtgcagctaggaaacttcaccctattttttctcttgatcgcgtttgaacggcgagataatctcgatcgagcttggactgggagctactagtatatattataagtacatctcatatgctcgatcaccacacctgcagcaattaataacctagcgcatatcaacaagcttagccaagctgaagcgaactgcaagatagctagctaattaaggaagattaagccggaactaattaatcaagattgatgaaggcgaccgcggtgatgatggtgctcgtgctgctcgtcacggcggcggcgtcgctgcatgccgccgacgccgccgctcggtggcgccgccgcgccgcctgctggccggagctgatgccggcggcgccgttgagtcgccgccgccgccgccgccgctggtgtctgcgagcaagacgtcatcgggggcttccgactgcacgcacaaccctactaagccctccactggtccatgcccgccgaacgccccgtgattaattaactaattgaccagctacacatatctattaattaattccttcgtggcgttgattgatacagtagtactacattatactccaaatatttactcatatatatatgtagtatatatattatggttcattaactatagttggttgtcgtaaatactattataggttcagttcgttaattaattagttgttcttgggttgtcgtcaataataccagtaggcaaacagtgccacacatatatacaagtgtcaccgtgtcgtagcttgctgatgcgaaccttagatattgctgtagtttgatttgttctgttgatttatgtacgtatacctcacaataaagacaaacaaattagtccattaatttgttcagtatttgttgggttctgtacttctgtctgtaaattaagagcatgtacaatagtaaactataagccaactataaccatatatcgagaagaaaagagaggagagagaagaaagtgtgctatagatttatagccggctgcaacacggactccaaaacgttgtgtgtgtatgagaggtgggaccgagtattaatggtgtaatatatttttatagttaactattgtatgaatgggttattatattaattatagttgttttggagccaacagttgactatattattaaacttgctctaaatgacgatgaatattttttctttcgccaccacgaattgaattccctgatgatttttgtttggtgtcgtgtactcgtgttccccgcataaatttgcacaatagatttgggaattattaaggatgcctatcctgaacaaacacccatatgcatatatactagaatcagtataaatacagtcgccatctctcagtctccctctcggcatgcatgtggacacaacccacggctttcttgtgtgtccttttcccaacattcaaatagaatctgttttcaagttttattgtatttttatttacattcctacatttttttggttagtcaattaatttgttttatatgacccaagtcaaagcaggttgcataagcaaccactacccagaaattggactattcctgatggcaggaaaaccatcactactggagaattgataattctccggatggatggtaaaaattacattagtttcggttcaaatagaaagcaggattaatttttaggttcaaaagccaacgaaacttttttatctttagtcccggttgataacatcaatcgggactaaagatcattttaggcccggttcaataactgtcaggccgtgtcaggccatatatttaatcgaatatctctctcacacatccttatctttatttctcgtccttatctaccgggcgcgcctctctcgcctcacctctctcgatctttctctcttgctcgctctctcaagaagctagcggcagcggcggcgccctggcggcgaaagctgtagtggcggtggctgcaccctcccctccgccagatccagctggaggggaggcggcacgatgggaggccgggcggcgtccgggctgcggaagtagcggcaatgggagtttcctgtcaggagacatttgtcctgatggccacggttaacccaagcaaccataagagataaggtccgagatgatatatatacagctatatacaatactcggtggactataatcctcaaatatcctctcatttttgcaggacgagatagaaaaagataaacatgcaaattgaaattcaacatatcctcaaatatcctctcattcataaaatattaagaaaaagataagatagattattatgttatatatcattctataaacatgcaaattgaaattcaacatatacatgtaggaaaaaaataaatttaactgtgaatagtacttgtgtacactactacataaatactcatctatgcaggatgagaacccctcatcagtaccggttcctcaaccaaaactacaacgttgacactgatgagtgggtggcaccaatgctggtcttggacttggcactcattgtttgttggttttgttatacgatgaatgaatgaattactccttggtcttgatgcaaaaagaaatagggcttagacttttggacggagggagtacttgttgaatggaaaatttgaatgagattattcatgaattaatgatgaaattcatcagtgttttttttttcatccggcttggccggtcgtcttatcatgcattcatgcatgcaaccccttagctttcccagaaaatctcggtttaattcctcgatatatctcaacgatgcgtactttagaagctgttttttagattaacagattaggctttgaaaggaaaacccaagaatggaattaaacatagtctttgccgaaagcgagtcgatctctcatcagtcatcatcaaccacagggacatcacatgttcatcagcttcatattcagtcatgctcttgaaagttgaatcttggactcttaaaaaccaagtatagttcttcagaaaccatgcataccaagtcttccagtttgatccgtcaagaacgctgtcgatcaatcgtgcaggaaacttcgccctaatttaattttctctcgttttgaacggccggcgagatcgatcgatcgagcttggactgggagctattataagtagctcttcatatccagatatacctgcagcaattaacctctagcaagctgatcagttaattaagctgaaacgagctgcaagctaatcaagctctaagagagtgcgacctgcgacgtcggcgattaattaagccggaattactgatgaagatgaagccggcggccgcggtgatgatgatggtggttgtgctgctcgtcgcggcggcgtcgctgcatgccgccggcgccgctgccgtggcgccgccgcgccgcctgcttggagctgatgcatgcgccgccaccgccggcggtgtccgagagcaagccgtcctccggctgcacatatggccctaacttgccacctggtatttgcccgccgaacacgccgtagctaattaaccagctatacacgtacgtacgtcgtcgacgtcgagcatcgcatcgcatacaagcaaaagatttgggctgattaattcattccttcctttgatttgtagctagcgttgattgatatatatatagatcatatgtgcatatatgttactacctgtcatgaatatattggttgtccaaaataaaagttttagttagttattagttagttgctgcatattgttgatgcacgcaacaacgcccaagcatagtacgtggtagtgctggcagtagcttgttgaccttacagactactgtagtattttaatttcttctgtagatttatgtatgccccaggagggtggtttcacgatataaataagagggaaaatgctgatttgtttagtcttcattaattgggttctgttgtgctgtaattaaatgatgattttttttctttcgccacgaattgaattccctggtgatgtttgtctaggtgccgtgtctacatgccccgttcccgtggcatgaatcttgcacaataaagtttggaataattgggatatatgtcaagttttaatcaactattcaaaatagattattaaatacaccgtaacactggatcatggaggagcgtccatatataatttgtgtcatagggatgtcggtttcggctgaatcttgttaataatatcgtgccctagtgtgttgtcgtgtttctgttcttgttatcgatgcgctatcatatataacagggctctagtggacctactctaaaaatacactctttagggggaaaatgtttaggttaaaattacactccgagggagagtagaatttatctaacagtatctctttaaaataatagaatttatgatattcgctttaaagaagctacaaccaattattacaaatgttgtagatcgagactgtcacctataaaatcacaacttaaaacaagagaactacatataactccaacaaaaaatagataagaaaaactttcatctagagttagtgaggaatcgcataaaacaattgtttcgcagaagattacaagttatgtagcatcttcctcaaatcaggaaatcgtatccccgaaattagcgtccgatcatttttccgattgaatttcgctcacatcaccatcgatgactgaaatcgaaccgaaacggaagataccgttggagagaaactcactaatcaatatgtcattcgcatgcagttgccactgtaatagccatcaaagtcgatcca

SEQ ID NO: 65077 - DNA, 2030 bp, Oryza sativa
tgcaagcgttgcatcagtgggtgcacgcgcgtggcaggggtctggcgtccgctcacctcctccctctcattttcatcttcccattctcaactgctctcctcttccctctctcccttgccgccgccgcctccaccaaatcccctacggtcaccaccactcgttcggcgtcttctccgatggtggactggcggccgacctcgagctccctcggccgaccccggtggagaagctgcagccgctattacatcccttgccatctccatcgccggcttcctcgccattgccggcgccgcctctcttttctgtcgccacaatcgccttctccgaccgccaggccaccagatccggcgaccatggtggcgttgagcagctaggagcagctgggagcgccggtgaagcaagtcaacgatgagattgaggggatttttttttgttttctcttttctattttcaattgagagaagagcggaggagcgcgcgtggcagatccgtatgagaggccagcgacggaggagcgtggtactggccggccggcggcagaggagccgggaacggctggcagcgatgaggcaagaactcctctcctcgacgacaatgaggaggacaaacgcttctatctttcttttctttttttttccagcgctttgcagtcaaatggtggggaaattttggtgactttttttttttgagaactcaacaaatttcgctttggtgcaaagaatgctggctgatttttaataccaatattattctttgtatgtgaaaaattgtttatacctattgtctagatttgaaatttttgtatgggatattatagaggtaacctcacccaattaaatgaagaggtaaccagactcaaatctatccaaccaaccaaacaaaatattttccaaaccgcatctctcatgcactcaaccaaacaaaatctcatctcagccgggctaaaccgatgcaaacaaccaaaacagttgcatgtgtatctcttcatctgggctagactcaaccaggatgaaagagatgagccaggctaggaaaatgcaagcaaccaaacacacccaattgttgctgtggtgtggtggatgactcaggctgggccgtggttgctctcatgagtcatagcaaatgggttgatggcgtctattcttgattgtgcttttgatgcgttcttcggtagcaatgtttgttctctagcaatagcccatggatcaatatggattaagcaaacccttgggccttccggtgctaattaaggagttttgtcatgtgtggttcacattatcaatgagattttgttttaggaccttgttacagtgcaatgagtctgcgttcaggatttgtggttggttgggatgacaaattggggaaaatgtgttacaccttagtaacagatctggtttaggatagccagataaacggtacatatgcctattgaagtgtaatttatggatgtattccctatatttccccccctattttgacacaaatccatagcttacaaaacaaccactgtatgaaacttctatcaggatcatgagcaagtttgcaaggggtcttattacctggaaagatcaacttgtatttactttgtaaaggtcgtgttactgaaatatgaatttgttcttgaatatgtttactctctaaaagcctaacatgtcatcgaaaatatggctaccaaatgcttgccatttcataattatccagaaatttcttatataaaagtgttgctttattcaaaagcacatcaacactgattttcatttgtcacccagctttggggattaggtaaatgaatcaactttagttgtgatattggggtccatgaaagattgggaaaaattaaatatattggacctttgccgagcaaggttccgattctccctgaactgtggtagtcttagtcatcttcttggatttgtgcaacacatggattgactggttatgctgtattgtaatgtaatgtcatggactcgatttgtcctaatcttttgctaattacactatatgtattatgcctttttttttcttttcag

SEQ ID NO: 65078 - DNA, 1256 bp, Oryza sativa
agacatcgttacgacttgtctgaaaaaatgccccagctagcggtggtgagtcgtttgcacgtcgtccatggcgcgcttcgtcaattggtctctgtgcaaaaaatgttatacgttgatcattcttggatgagatagtactactcaaaagatattcagactgaagatcagttatgctgcctcctgtcctgagtgagtaagagtgcgacacagataaataaagttaattgttcatttataccaacaaattaacagatgaatcagcgcatagctaattaactacatatatacatacattattctgcaacttgctagctctgaaacgatcaattattctacgcgtaaaatttatactattataatttataaacatcagcaattcatcggaagtgtacgtgtagacagtgtagtgatatgtatacatatcaatcacggcatttttggtggcgcgcagggacgtccagaaatatgggggtcgttgctgcagccagaaggccctgacgacgccttgctgacggacaccagcggaggcggctgctgacggcggccgccgccatcctctccgagacggcgcgccgccgcgaccgcgacgccggcgttcagagacgccgcgacgagcagcagaaccagcagcgccgccgcaccttttcctcctccctccatgtcgcaagttcagcctgaaattaagcctcggttcttcgttgctaactaataagcagctagtagctagattgaatgcttgatcaagttggtgtttctatggatgcaaatcaaactgtaggatatgtgggtatttataggtttcagatgagtatgatcgaccaagttgatgatatttttccgcgaaattaactgtgcaatctgacgcagaagacgtttttgacggattaaactggtgtcttattcaatttatcggtgaattttacgcgcattgtgcagatctgtgatgtcctgaaatcaaagttctgctggtttctgtactggactgaagattgatcattgaaaatgaacaaagctgcgacaaaattctttacgtcgcagctttgttcaagttcacctgggtaatggacacatgatcctcttctggaaagacaattggctgcaagaaggttgcgttcgatctattgccccttccatctacgtacgatcatgttccggcccacgtgcgctggcatcggacggtggcagaagcgctgctggatcgcagatggatcagagacatatgtggggcgttgggtatccaggccatcccggactac

SEQ ID NO: 65079 - DNA, 901 bp, Oryza sativa
actatcgatgataatatcttactatcgatgtttctctcctccgttactttttttttccgaagtacatattagcctcaaccaatattcctttccttgctaaatcatttttcctatgcaaggtggcattttttccaaagaaaagaaaatcattttactcccctaaagcacttaatacttaaactatttttttcttcattttatccctaaactattagaaatggttcactcttgtattttaagctgaaactttttaagctataaatgatatcattatcaaagttctaaaatgttttcatgagtatttgcttgaaatttaaaactttcatgtttaaattagtcacagtgttttcaacctacgtaaacaatgataatttttttctaaagaatattgagaggtaaactataacgcatcttcaattctaccaaattttaatacaaaatatgacttatatagagagaagagagaaataccattaagagtaacgaaagagcctgtaacctagtggttataagagcctcagtagcaccataggtcctgggttcgactcccaatgggagtgaattttccaggatttaacggctttgtgctttcagtggtaggcgacgtaaccgtcgacagtgaggcgcctgtggtgacttcgtcaatctccaggatggatttgctggcccaatcttcgaagatgctcatagggatagggtttgcgtgcgtgtgttaagttgaaccattccaatagtttgaggtataaaatgagccaaaaaattatttaggagattaattgctcaagtgaaatagtttgggactgttttcgtttccaaataagccaagctgatcattttggtatttatggagtataattagatcgacttctctttcttccgactccctctaatcacaaataaa

SEQ ID NO: 65080 - DNA, 695 bp, Oryza sativa
tggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcacaacgtgggttagcgttggacagcggatgttaatac

SEQ ID NO: 65081 - DNA, 11174 bp, Oryza sativa
gatccccctcttgttgttatctagctggtagtgaaagagttgataagtctgaggttgtaggagacaggctgaaggaagcacagtacataaacaagtcactttcagcattaggagatgtgattgcatctcttgcacagaaaaattcgcatgtcccttaccgaaacagcaagcttacccagcttttgcaagattctctaggtactatctgaagttaatatgctaacttttcactcaattactacatatattcatagggtaactattttattccaatgtcaggaggacaagcaaaaacgctgatgtttgttcacgtaagcccggaactagatgctgtcggtgagacaataagcacattgaaatttgctgaaagggttgcttcagttgagcttggtgcagcaaaagcaaacaaagaaggcagtgaggttagagagctcaaagaacaggtgttcacttaactcctgattgctcatttatataaactatctagatgtggtacttctgtttagatttatataatcatcgtttttctctgctcttgtttcagattgctaccctcaaggcggcattggctaaaaaggaaggagaaccagaaaacattcaaagcacacagtcaagccctgacatgtatagaattaaaagaggcaatgcaatacctgccttccctaaaaatagacagccaatggaagaagttggaaacttagaggtattaactgctctttcacacaagatcaactctttttcttggaaatcacaaaaatatttccttttcacattgaagtttttttgtgagtgctagttatgattccaatcaatgtcaaataggaaaataacctaccaaacattctaaatggagatgggctatttatgcatttgtacataagtttagagtcattttgtcaataatctgaacaactctaaaactgaccaaagggtagttcatggtcttattgagagtacttatgtttaccttcagtagatttatgcatttgtacatcaagttcagaatcattttgtgaatgatctggacaacactaaaactgacgaaagcgtagttcatggtcttgttgagagtacttatgttaccttcagtagattattattccttttaatcttttcacaagaaaggtaatgatgttcatttaatgaatattatatttctttatgtaaaaggtccggaacaatgccactccaatgcaaaagaaggccagctttcaattttctggtgtcctcagtgagaacaactcatccgacttggctgaaaattgcaatggcattcagaagaccgatagaatggctgtcggtaataatcaatttgagaatggaaattccattctagagctggagcctggcgcaactcagcttccaacatttttctaccaaagatatgatcccgacaagcaaaggcgtagggctgaaccagtagaaactgatgactcagatagctttgatgctgctactagctcgccttccgaccaagaaatgttgttgtccaccagtggcctcaaagctgatggtattgccagcagaggtgcctttattataaagaaacctcaaacaaagaatacgaaaattacagcaacgaagtaagtccaatttaaatcctgtattttccatgaaaattgtgtgcattggattgctttaacctgttgtgctgctttgaatttactcaggattccaaatcttgcaatgaagtcgccaatgtcagagaaaaggctgcaaaccccaatcaggaacagcaagcagctacctttcagcactacgggtggaagaagaactcgaaatggcaaaattaacactccaaaataatcgactagtgcgaaggtggatcccactatgccaaggtgagatcaataggaaactgaaagaaggatgtttctaaaaccctgtataaggatcagtggattgttcagtctgatggaaaaatggttttgagacatcaaagatagagataaacagataagacctccaacaggacagagaaattgtaaacccagaaggaatttttcaaatttgagatcagtacatagctcacacgcagaagttacggttgtattgtatgtacattagcctggaatagatgcccgccatgtgccattacaacaaagagaagttcaatgacaagtttgtacgcttcatcatgttaattgtcaaatttaggccaattacaatttttttaccattgcatcatagatgtgaactttcttaaaaggaaatttctctcaaggatcattaggtgcaaaaaaggaatacattacatggtctttttgtttacatggttctaaattcagagataacaaagaggtcagaatcctctgctgggaaatactaacactaaatgaagtacaagcaggctctactatgtacagattacatacacctaactttttgacaaaatcattagtttcagttgaccagatgtctctagaacttctgcatcaacaccaagatcgatctttaatctaaattttttacaacctgttttcaccaggctcatactattgggacaagccttggccttgctggggggcgatgcgaagcctttctcgaggctctggagagcctacccacagatgccagcttcagcgctgccctgatcttgacccacttgcgtggggacaatggcaccgcaactctttcgttgctagaaaactgagaaatgaaattctgtatgagctgatcacatgagctggagtcaaagctgtttgttcttgatggctggaatggagcggcaatttgctgtgaggtttggtcattgcttgataggttgagcaggttactgaaattctcgcctgcagatgccatccttagtaattagcatcaagatgaatgaatcagatgtagccaaaaaaaaatcagcatagagtaattactgttgcttggaggcactaagtgaggttgcatcaaagccacaacttcatctgtatggaggaaattatctggagaaaagcgctgtcaacacaaatacagaatggattagttctgttgaatgaagagcacaagtaatgtcaaatttttactcttcgatttctatctagacaaaatacatagatttttacataaaaaaaggttcttaccttgtatgattcttcaggtgaatgagatcgctcattatgtgcatactggccaattcgtgtggcagcatgatcagcctggatgctgctatgagcgtttggattaaaatatgttttttcggtattaggtatacacagaggagtgattcttggtctgggtatgaatgttccttgatttgaatgatgtgggataaaattgcccatgcccaactgttggctaaactgcacgttggaggtttgaccctgcacaaatcttgacatatccactgaagcctgctagaaaattgatgaaactatcttagactaacatgcatatgtattttattatgtactgtattttgtatatttcaaaatatcttccttacattagaggcttcttggaatgaagaaaagttctccgttgattcaaatggttgaccagccagggctgaattgtattgacctgtaaacaattggaatagatgaccaaaaatccccaaaaaagtaattatcgctagtgattgaaattctcagaacaagatattaccacaagttgggatctgctgtttaggaataaagtcagtcaacatagaagttcccccacaatggaacctatgaagcggtacaggatagttgttgaccatcttatggtcatactgaataccacttatattcgcataagccaattgcttcattgtttcaactgcactctgtgaacaaaaaacaccaaattattaggaaaatagtgagaaaatctcctgttgaaggaagtgaggaaacagtacctgctctatttcgtcgagctcatttatgggcttgtaagaatcaccaaacttcaccccaacaagctgatatattgcatcgaagaaaagtcccacgttgttgcccttcacttcatacaagcaaagatcgtcaccgacttcacatgtcatggcatggcttatgatggttttccaagctgcctgtgacatcttgctaaaagtctatagacaaatatcaaagatcttctgtcagtcactttttttagggaattcggtgagtctatttttttctcttttgaaaccaacggctcatctatattatcaggtccttgtgttatggaaacatcatctgaaatttaatatttaaggaaattcatagaacctctacctgaaaaagcttcttttcgtccgtaaaatatgattgtaagaacttctgtacagtatcaactccactgtttgtcaaggcctggtggtgagctccattgcggccgatcttttccaaacgccaaacttcgtcatccaacattggcgggtagtgcttttcaaatcctgcaaaaatagtaagttgcatattattagtctcagctataaggtccaaaagacatttctgaagaaacaaacaatctgaatcttagggacaatggcataccctccaccctacgctcctttacacgaaaaggttcagtgattccttcaagaaccctatcttcagaattgttggctagcctcaaacccagcctgaacttcttagtgctagtgaagctagagttatcagtgaaggttgcattctcaagtaatgcttcccctccattgagcttcagtgtcagatttccggtgagaagttgtgcgcttttctctcgcccgcatactatctgcttgctgaagtcttcaggggtccattgttcctcatttttagcattaaagttgccgtggaggactacaacttcaaccttagcagaagcaagatgaccgaacctgacgatgcgcatctgattgttttcgagtctttcgactatagccaccttaagacccggtccatccttggcttctaatttcatcagtgtgtaaacaggctttagttcattcaggaacacgagttgataccttggacgctgctgattcaatcctgctagcagtctgcagatgaaagaaccaaattaagtatgttagagcagaaagaaactaaacatcaaattttttttattacatgtgaaatttagtaatcataataaatgaaagctagtatatgtctcaagcctcaccttggaggcgctggtgtgctgacttgtctgaaaattgctttctctacttcttctgaaacctgaaaaaagcacaaatttcaggtcagcggacagggagcacttctaaattctaatatccaagttgaaatcaacaacaatgtccgcatgtctcttcttttattgggatgaacttatcaatctaacatatctttgctctgaatgttgcacaaaatcgataatatatctcaaaattggtagatgcatgtgtaaattgcaccaatttggggtaaaaaaaaacttgcaaaagaaggaaagggaaaagggtttttaaaattggggctatttgtgttattcttgaagccgctaagccttttagagcccgtccccccccagggcgaactttgggcaacaaggggggctaaaaataaagggacgggactttttttaaagaaatttaagaaaaattgaggggtttaaagtagagtatggaatgagaaatccattgaccactattactgaagccatgcttggccaaagataggggaaggaaacatggcccatgaactcctcccccatcatctccctgaacccgaacaccccctccatgctcctcttcctcctcaccccgagccccctgcaaccaaccaaagaacaaaaaaaacacaaattcatgagcaaccaaaccatctctgaacccaaccaagaacgcagggttgactcggccgttgactcacaggacaagcgcccgccaccgcctgcgagggcgggacagctcgccgccggcgccggcgccgtcgtcgtcgtcggaggaggaccaggagaggagactcgtggaaggagccatcggtggaggaaacaatggaggagaggcatggttgcggggtgatatagaggagaagagaatgggagggaaagctcctggaacgagctgggaatgttcgcttgagctcacattttgttactgtgttcgcgagcgagtgcacaagtggagtgtttttgagtaatccatgacgtgttttgagtaatctatgactctgttggctcgtaattgtcgattggttttgggtttgatcccttcttttgtggcaatgggtttttgcacttttttttctttttcagtttgagatgttaaaagtacactttagatagcataaacttttattttgcatatttgtgctcatttaaaagaagacagttgtggtggactccgcctactcttattacagtaagtttttacaaattaccccttgaactccttaatattaaaaggatccaatctaaatggatagccacataaaattagattaagatgaatatttcgtttagaaaaagatgggtaacacattaatacattttctttaatccatagcaaagcaccgtcatttagctagtatatatatatacacgcacagatactcattcactacgataggttagatactcattcactacgataggttgtttatgaatgttactctatccgtttttaaatatatatggtgttgacttttattgtggtagcatttgattattcacaatgtgaaaacatttagtgcatgataaaagtcgtattcaaagtacatttaacaataataaaatataagtgacaataaaatgaagaaattatacttttatgtttctcttaataaaacaaatggtcaaagccatatctaaaagcaaacggcatcatatatttaaaaacataagcaatatatatatatcatttttaagaataaaaactttatattattggcgtctaacagaccatatatcgctagtagaaatgcttctcgaaatctttagctcactaaataaaccagtgttgatgtctataatttctccctctataaaaaaaatgaaattctaagaacgaatctggataaacacatttgtacattcgtttttataagttgaatttttttcttttacggagggtgtactctttataataccaccacttaccagcaactacttcgcttaaaagcttgaggtgttttgcagaagaatggttcgaatttcaaaacttttgctcttgtccgttctattgatgcatgtccacttcatctaggctgcagtctacaaaaaaggaagaagaggcgaagctgcagcctgcagaaaatggagagaacgatttacgtcgactgacgactacgacagcggtgatgatctggccggccttgtgattgactttggattttggattactgtatgtgtcgtctcgtgggcttgatttgttcctcgtttagtcccctaatttgaagttgaagttgacaaatcgcgttcacagcgctcaaaccaaccatgcacgtacgcaagcaagtgttcatatgcaactgcacttatgtcgtcaaacttttagattatattgcacttttagattaactgcactgtgctatatggttttcttttttttagattatcttgtaattcctccgtttcacaatgtaagactttctagcattatccacatttatatagatgttaatgaatctatatatataataatgtctagattcattagcatctatatgaatgtaggcaatgttagaaagtcttacattatgaaacggagagagtagttgtatgagagacatgatgtatgttttggcgaaattttgataaatgttatccttttagaaaatttatttgaagggtaaaccgtgccagaaattattttaaaaataaaccatacctcagcaccatcgggattagcgatgaggtccaacggcatagtgctaacgatcatggcgctaagcgctgccaccttggcagggccgtatgcaaggttggataggatcatttcatattatgaaaagatatagcgcaagatataaatcacatttaaagtacctttaacaattattaaaaattcaagtaacaataaaataaataagtgatagttatattttttaatatggcaaagggtcaaagtcatatctgaaaattaataatatcgtatatttaaaagcagaagtagtgtatatctatcttaaaaaaaacttgatgctaatggtgcctcagaaagcacataaatatccgtcgtagaaatgcttctcaaaatctgtagcttctcaaataaaaccaatattgatgtccaaaactgcattttataataatctctacatgccaaccaaataattcacttaaaaaggttgagatgttttactctagactagttagaatttcgaaagttctgcacttgtccgttctattgatgcatatccacttcaccttaggatgcagagcataggaagaagaggcgaagctgcagcctgcagaaagtgcagagaacgatttatacgtcgactaccgacgacgacgacggtgactacgtccttgccggcttatgatttgactttggattttggattagtgtcttgtcgtcggcttgatttgttcctcgttttaattagtcccttaatttgaagttgaagttgataaaatcgaattcacagcgcgcatagcaataaccacgtttatactgaagaaagtgttcatatgtatgtgcaattctgtcgtcaaacttttaatcttttagatcatcttgtacttgtcttgaatagttagttgtatgagagaattgggagagatgatgtgttttggtgcgctctcgtactagcattttgatagtggtagaaacaattaattccatttttaggcctttttccaaattaagactttatatagcttcggatttgtctcctctcatgatccggacagtttcctatgagcaagttaggcttggattatcgtaatttcaagttctcaagtaccctaaatgagtgttccaatattagtgcaacactagttgaagtgtcacttcttcattttatagagcattttcatctcttttcttttcttttctttttatttcttttttttttttggaaaagctcttagctctgagatcaattactcatcatatgtaatatactcatggtgggaattttcccggaagaatctaagtgtaagtattattttatcggtgaagggggatccatcttattatatatctattcggagttttcatggaagattctgttaactgtaaactgtcatggaggtgagcagggcagttgatgagatctctgtcgcctgctgattggctgtgtttagatccaaagtttggatgcaaacttcagtacttttccatcacatcaacctgtcatacacacacaacttttcagtcacatcatctccaattccaaccaaaatctaaactttggatccaactaaacacagcctgagtgaggccagttgttcggcagaaacctctgaactttcctgaatggttcttcacttcacaagcatactagttgtagttcttataacagcttaaaagtcaacgtcatgtattctatgcctttgttggaaaaaaagttaattattagcgtatgattaagaaaattagtcattcaccaatgattaattaattattaattatttaaaattaaaaaataaattaatatagttttctaaaggaacttctctaaagaaaattttttttaaaagaaacatatcgtttagcagttcgagaaacatgtgcgcggaaaacaaggaagttttcttccctttctcggaacgaacacagtctgtgttcggcataagctggtcgagaggaaaggtaccccagtttttgcatacttcccgaatggtttaattgtgtgtttttaaaaaaaattatatatgaaagtttctttaaaaatcatattactctattttttaaatttaaaataattaatactcaattaatcgtatgctaatggttcaccttattttgtgtatcttctcaatcagcttctctcaaacatttgcttaagaaagtggggaatgacaactcgcagttgcctcaaatatgacaccgctctagtacatcaatgaactctcgaagttatatataaataacattttcaatatacgatgagttgtatgtgaatggattagaaaactggggtggttcaaagtgacacaaaagataaaagatatgtttacctagtccaaagtgaaaaatgttaggtaaaggatggttcaaacggaaaaattttctgtttataaatataaatgtgtgtgtttttatttggtgcagagtctaaaacgttgtacttcaatcgttaaaataaaagataaatgagtcgtaccgtgaagccattagctgtaaccctacgccaactagtcaaccctagtggtctttagggggaaaaaaaatcgaagatccataaaaaagttggatcttggcattttgcttcgtactcctactactgttgtttcaccgtgaagtatagttggccataacgcccgaggcccaacggcccggcccaaggcaggggattttggcctggcccaggcacggcacggcctgatcgttgtcgggcccatgccggcacggttcgggtgttgggctgtgcctggacctatgcctcggcacggtgggccggcccggcacggcacgaactttagcgaggtgaaatagacttattttcaaccatatagacgtatagacgtattatatggcacgactagagagtagggacgtaaaatagacttatttagttttttatatgtcacaacccaaagagtatggaggggaaatagacttatttcaaagaaaacatgatgggctgcatgtgccttcgggccggcccagcatggcccgacccttattgggccatgcctgggccacagtggagcacgtgggccgacgtggcatggcccggcgtattggtcgggttgtgccggcccaacaaatcttggcccgagcatgatcgggcctggaccatgccatgccgggcagcccatatggccaactataccgtgaagcatatgaggagagaaaaagtcatgtatataccggagtagtttggaaagtagagtgcaaacacttctccactattataaaaattgaagatgtttttgccaggaccttggtaagtcgtccgaatccgtatgtgcttccttgcatatatctctctatctcttcccaatagctttgtctgtcgcccggtatctgacctgtaggatgtatttagttcatgctaaaattgaaagttcggttgaaattggaacgatgtgacggaaaagttggaagtttgtgtgtgtaggaaagttttgatgtgattagaaaa

SEQ ID NO: 65082 - DNA, 2125 bp, Oryza sativa
atctagaagagttcgagttcaagaaggatgcgatatgacagttatctgttaattaggcatagtttgttagtttccttttatctttaggaaagtgtgtttagtgtccgataagaactttatcttttcctttttagtttctttcttgtccgacaaggactagtatctccttatgggtataaatatgtacacccggggtcattgtaatctatcaatcttcacgatcaatacaattcagcgcatcgccaccctttttaccttttctactttattttatcgtccggcgtaacttggcacccgacggagggctgcatcggtgttcgatctccggcgaaggggtaagtccaatgttccgtcggtctaggcagttgtatcgtctacgtcggcgtcgttcaaggctgcatcagtatattcgacctcttggattgctctggtttggatgatatatttgcctacctatttatcatatgtctctgttaatctagacttagcatatcaatttagctctatcggctgcttctggttttagggtttctgccggtatcggctaaatcgtgttgctagattagattagcttagacatctaccaccttaaaaatcagtcaacggcttgattgtctagatattatgtttcttttcatacttagtgctgcatcacttaagtttgatctactaagtcgtgcttaaaaccataatctctatcctgcttattgattgccaacaagggtttcatcgcggtttcagccggtgagttatctgaacgttgcattggctcataaggattgcacatacatgtaagttggatttagccgatgacaacaaaggtttcactgtttaatctaatcttgtggatttcatgacatcggacctccagccgatgtgtgctttaaccttcggatcgatgcttatttatcatatcattgctagccgattggtttatactggattatattgttattttattgcatcatcatcagccgattgcctttatatcattatctacattggacatatagccgattgcatagaccctatcgctatcggctggtatcggcatcggctattattggctaccaggctggaactactccatcggctgtctagccgattggctgttttgatctactacttgcatatcttgtcagttgcaggatcaaactgactggcacgcccgcatctcatcatatttggacctgcactggagctaagcagatctcccaggccggtgtgttcgattttttcgtcaacagcgggcaggcagcctgcggcggcggggggcacgcggcgggccaggcggcggccggcggcggccggcgcgggtaggcggcctgcggccggcggcagcgggcgcccggcggggccatcaacgcaggcggtagccggagtcctcccgttttcttgcctgcagctggagtcctcccgttttcttttttcttttttttttgtgatttgtgattcactggatgtataatttctagaatttgtgattcattgcatagatttgttatgtgttttattttgtgtgtaatttatttaaggatttgtgatgtatttgatttgtgtgtataagtaacttaggatttgtgaggtgaatgatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatctttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagcatggccgacaagtttatagctaggctcgatcgagcttggctcgatc

SEQ ID NO: 65083 - DNA, 13788 bp, Oryza sativa
tcttcatctgggctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcctcatttcgagtcgctatatacctcgttcgtttatgaaaattatattaggagtagtctttttaaggttagctgaacataaaattaataatttctatgcaatgtcgaagagtcctcgtttagtgggattgttcatattgttacaacctctagcatatggtcaatgatttgttgtcataagtttgctcgattgaatttagtactaagatgtttgaattttttcaataaaagtactttttcgagataaatctatttatattgttttatgttttcaaactaaaagttatcccgattattgataggccaagcaataaaaaataaccagatttatcatagagcacaaatatttgtgatcacagggtgtacgcacccttgtttcaaacagaaatgaatgtatacgtgcttcatacaccactatcgactccttgattgatctcgcctctaccatgtacaacatgttattagtcgttttagattgtttttcctagtcccgtttctctctggttgaaatcaataaggttaatatggtatgagtttttgatatagccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagctaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtataaaaagcatgaggcctactggcctacttaccgtaaaaagtcaaatgatacactttgtattcaaaacacatgttaccggtgtacacatgcatagaccaaacggaacacctcattttagtaaacctagtctgacgctttctatacagcaacgcggtacctcaaggtttacgccttcaggcggatcacgcacggtggagacggacgagcgcgagaaaggaacaaaccgaacaagtggacccacccacccgtgggcccatccacttcgtccaccacaccgcatcgcacaaaccacacaacaccggttccgaccaatcacatccgtccacgtaccccccaaacatcccccggccccacacaccgaatccccccgcacagcgcgtaagccgccaccgacgcgctggcactcccacgttcaagccctcctcaccaccctcacacctcacagacaggtgggaccaacaaaaaccagacccacctgtcagtgacgcggttcggacgaatcccccgtagccgtaacacgatctccaactttcctcgtgggctccacgtggcagtggggaaagcacgggtcccgatgatatcgcccacacaccacctctctctcttctctctctccccatctctctctctcctcctcgactcaccgtctctctctctcccctcccgtctccggcgatctctccggcggcgtctccggcgaccgggccaccgccgccgccgccaaggagcgctccccctcattccccagatcggtagctgtctcgtcgccgtccccgatcctcctcctcttcctttcccccagatccacaccccccccctcgcgtactcgctcttagcctccgcggcgggaggtggtggtggtgtgggcggggggtgagctcgtgagtcagatccggtgatctgtgcgctgttgcggttgccatggacgacttccagggcctcctggcccgcgactttgggctgcgcccgcaggggaaggcggcgcccatgtcggccgcccgcgccgccgcgtcctccggatccgcctggtccaactccagatccgcatcggcgtcctccgccgccgccgccaccgccccgcccgcgcccttgtacgatgacctcttcggggccgcggcgccctccgccccgccgcccaaggccgcgccctcgccctccctcgacgccatctttgactccttcaaggagccctccgccccggatgccccacccaagccgaagcactcgtccatgccggtgtttgacaagccggtctacgatgacgacatcttcgatggggttcccggggtgaagagcagctcctcggcgcggtttgacgatgtattcggtggcagccacgcgccgccgccacctgcgtacgatgatctgcttgggggatttgggagcaagccggaggtgaaggaggtgctgccggaggagaagaggaagcctgagccggccgcttcatcggctgggtttgatgatttgatcccagggtttggcgggaggatcccgatgcgtgccaggtgagcacacctttttgcatgggaatttcgggcattatgttgtctacatgtgcaatctaggagtaaatttagtagtagtttggatcaagcggaagctttgtcggtatgagccaactcggcaacgagagaaccatgtgataattcagttgagttggacaaattatggactcccatatctaatttatgttgcatttgcttagattttagcttgttaatgtgcacgtgcgattgtttgaattggtaacttataccagttgaggtaggaaattcattgatggcttatatcttcaaatctatttggtaattgaatttataggctattttccattaggtatgatctgtgttgaccattgaatatcaatggcatcttgtggataaacttatgggcatcttgtgaattttatgggctctacttcgattttactattagaaacgcctaggaacatatgctatgctttttataagcattccctactttcctaaagataccagtgcactttctcaggcaaacttgctttggcctctatattgcgttatgtggataatacagtgtatgctaggtttattatggtttatttaaattgcacatagttcatagagaatgttcagcatgcattaatgaccggatgtggtaggttcataggctgcacaactttgattgcaaattaccttaggttcaaatataacgctttatagtgatggaatatgtagtgagttatgcaagaagaatatctacgaggttctgaaattgctttgtttaaagaatgatttggatctttttaatctaaaatatgtcaatcatatacagatttgttaccataaattccctcatcctttttttttttgaatcatagggagactgttggaactaaagataagaatgtgtccatgtcaacgtctaagccagctagcatggcaagtgacccatttgatgttcttggtacaacttcaacctcaaagcatacatcttcagggatattcacggatcccttggatgaactgggcaggcctgcaaaatctcaagggaaaaaacatgataatactgctgttgacagtggcctattcgaggactcaagcacttttaatcaggtcccaaaatcagaacctctgtttacctcagagttgaatgatgacttgaaagataggaatggctccaccaaagatcgagattcaagtcctgtgcaaaatttttccagaaaaaatacaacccaaaaaccttctgtggagaacttcgaaaatatctttcctaagtcacagtctgctcgatattctgatgttcatgttgacattggtgcctctggttcagagaaatacagtgggaatggtatggatgaccagtctccaagatctgatgagtccgaagatgagatctggcttacagtttctgagattcccctcttcacacagccaactagtgccccaccaccttcaagaacaccaccacctcttgctgttaagcaaaaaccacatggatcacaagcaaaaagaaaagatgacaattatccacgccggtctaaccaaaaccacaatcatcacagaagctcgtcaaatcaagctggttcttcttcaatagatgaactggaagattttgccatgggcaagtctcaaagttctgcctatgacaatgcaaatccttttaatgaggaagaatttgagcatagttcatcagcagcagcatctgcagctgctatgaaggaagcaatggataaagctgaggcaaagttcaagcatgcgaaggttgtacgggaaagggaacgcgatgcaaaacatagaaatagagaacagcaggaacaagatgatgaagcaaggttcaacacccaggatcatgaagagagagataggcaggaaagactagaacgggagagagagatgagacaaagggaggaaaaggagagagagcaaagaagacttgaagaggagagggaacttgagaaacagagagaaagagagagggctgctaggcaagctgtggaaagggctacaaaggaagcacgggaaagagcagctgcagaagcacgtgcaaaagcagagagggaggcacgccagcgtgcagagcgggctgctgttcaaagagctcaaaaggaagcacgtgagagggctgctgtagacgctagggaacgagctgagagggcagctgctgaagcgaaggagagggctgctgctgaagccaaggagaaggttgcaactcaagccagggatagggctgcagcagaaagagctgcagtggagagagctcaacaagaagcaaggaggagagctgaaagagcagcagtagagagggctgcttctgaggctcgggaacgtcaagctgctgaggctcgagaaaggcaggctgctgctgctgctgctgcagcagctgcagcaaaagaaaaacagagtaaaccggacgatcttgagtccttctttggtatgggagctcgagccaatagtgcgccgaagcaaagggctccaacagcggtgattactctaccaaaacatgcatgctaaaattttgttcatggcaatttttgggttattgttttaccaactgtggacgtttcaggattcgatgttcaattctcaaactcaaaatagaggggcagcatcttctgcttcagcatctatgcggaaggcatcatcaacaacaaatattgcagatgacctatctgcaatatttggaggaggtacggatcaacccaaatgcagcagttctgaacatacaaggttttgcaatattattggctatcgctataactcatttggttgatttcttttcttttagctcccacatcatctgaagaatttcaagaaattgaaggagagagtgaagaaagaagacgtgctaggttcgaacggcatcaaaggacccgtgaacgagcggtaatgttgctaatgattttagtaactaaaatagatatttgtttgtaacttgctgttataatttggtactgtggacattcattttatgttcctgaattttatcatttacatgttatttttttctatttattaagagttgtgatgcatgaatttgagttgcagtgccatttattaacttcaccgtgtatgcaggcaaaagccctggctgaaaagaatgaacgggatatgcaggttcaaagggagcaggctgaaagacatgtaagtactttttatctttcaattgcccaattttacttcttttaaatacttgtcatactggttagtctccatttattttcatatacaagtttactgatgatgttgtggtgcattttatttgttgagtaaattacactcacggtacatggaacttgtgtggtgggtgcaaatagatacaaccacttgcaaattgctcactttgatacaataacttggctagttggtgtttaccgggccaaaatgatccacacaagtaaaattgctctaaattagcacacactaatgatatgacagcatacacgtatgactgtgatttggagatcttatttcgaatccaaataaaaagaggaattagatgtgcaaaagtttatttttcatgtccaggatagagtatttatttcatttattgggaaaatttgatcctctatataactcgtctaatgtttatttatctgttcaagaccaagacaatttttatctgtacatttaactcctaaaagaacactttaattttcatgttcatgttcagatactctttcatcgaaagtgtatttaatgattgggcatttttaattattttacttttttgttggtctaaatcttgaaaatatacgttgtcagtataaaattttgatgtgtaacaataattacacaccagtatgtaatgtatcatatttgatcaattttacttgtggatcggtttggcccaggtttgcacaaactggccaagttattgtactggaataagcaatttgcaagttattgtacctatttgcacccaccatacaagttagtgtaccatgaatgcactctctatcaatattttgctaatggctagttcctttgtttcgttatctgttaatccagagaatttcagaaacaatggactttgagattaagcgatgggctgctggaaaagaaggcaatttgcgtgcattgctatcaactttgcaatatgtaagtccttattcctgatgctgctaaaaattgaatcaattatccttgtcttctcaatttttctattcattctctcggtgttattcttgcaaagaaagttgcttgactcttttgcttgtcttctggaagccatacttttccctgatcagtttggtagtgcaatttttaacgtagagtgtgttcctttatcatggtcacatttcaacacatgatattttctatccaagggtagttccgaggtaattttgttaagcatgcaggttccagtaattgtattccctgctacagctttttgtaagctttgttttcacctgtggtgaccaaaaccatggtattgaggtgaataggtgatatcagatagttttggtttcttgctgatgtttgaatgtaacatagctgagtggctcaaagaccagattgctggatgggctgaatatcttttgtttttctaagtcttccagtaaaaacgtttatctggtgttattctcttggtttgccattacctgcatacagtagctccttcctcgcaagctataatacatactctgtatgtaagtaaatagaaaattgtgaaggactaataattactcctattcaacaaacattgcattttagggctagtttgaagagaattattattaattctgttctttctgacaggtactttggccagaatgtggatggcaacctgtatccctgactgacttgattactgctgctgcggttaaaaaggtatatagaaaggcaacattgtgcatacatcctgacaaggtgcagcaaaagggggcaaatctacagcagaaatatgttgccgagaaggtgtttgatctccttaaggtgtgtatgctgccaaaatatattcacaaaccataatagcagcatgctgcttcacactaacaattggtcaaccgtatgtttttatttcccttttagtttattgtggagaaattagggactgcctagctacagagcctaacaggacttattaatgtgtttttccaattttaggacattggcctctacatggaaactgactatttgtcaattatgaatatttaggatctttcactgtacattttgagatattattattcatgtgtggtccattgagccaaataaggcttcctctatgatttcacatggaaagtgccaaggtttgacagttttcatatgattgatggtacactagaataacccatattaatgcaaactttggtttgtgtccacctggaccaccacctggtgccaacgcaagtatatctggcatgccctgcctactatgcccacaaccaaattaatgcaaaccttagtaatggcctgatagtctgcctagaggaacccaaaagcaaatgcttgacatatacacgatacgataatttaatacatcagattgatcttgttgatatttagtactttggctagtatatcttacattagcttacttctttatacaatgttgcatatttaggatcttattatttatttttagcaagaaaaaagagcttgtactcaattgttttccctaaaattgtttaccaagtgccgggacttttaaagagttctattttctagtgtttcccattacatccttttggtataaactttaattaaacctcctctatgtttgcacaaaacaggaggcatggaacaaattcaactcagaggaactcttctaaacggcctgcgcaaatgaaacatattgctcaccaatcttcacctgcatgaggcaatcggggtgggacagcacctcatagaacaaccgagctggagcagtcggtcggcggacccatgaaacgatgaagtgaaagttccaccataattacaattgtattgttattaccaatattgtttgttttattatacaccctcatcttctcccttctgtatgtgttgattcaaatgacatttcacagccacatgtggtggccctgcggcagaccctcatccagtaggtgtatattagcgttctttttgctcggttgatccagggttgtgtagcagcggatttggggtggccagtgttgtggtttttggattaggcacagggtttatttaccatggagggcccaaattgcatggatcatgaatgttgccagtttgatgccatgggcttttcgtaagttcaattatcttgtttatagtgaacttctggaacacacattggggatgttcctctgattcctgtgtgattttgtataaagttgatctggaattttgatttcctcttgttctctgttaccgcttcgttatttgctcgttccttgaacgtataacgctagtatcacaaaatcctgtagagtttcctttaaagagtaaattttacggaacttcatgtattaaccaattgtgcataagtcatttgttttggcatgttgcttataatggtattatgctcctataacttcagaaaacagcagcagtaaccaaaatttcatctgagttctttaattcgatcatataaaagttatagtaatctaagttaattcttttttattttgctatagtgttaattcagattgattactagtagtgtggttttgtgaaatctaataccgatggtcactgtgcaatatgccaaaacccatatatcttgttccatttaaaaccataataaatagggttatgtgatatttaataaaacagatctgttaactcaaataaagattgaattgggaagtgttttaatagtttattaaaggttggattgggaagtgttttatagtgtagtggcttgatgaaatcatgggtctgccaccgtgttgcatcgatctcccaaattcttttctcgtttcactcgcatcctcatcatcttcatgttacttctacctacaagtatattgttttctcactattttatatcttttgctcgttaaaggacaatgatttgggtgtattcccaatttcccatcggatccagtaactcgtgtaatcaagcttaacctcatcccattttgcttcttttaactattttcttttttctaatgggtgtgttcagctgtcatttttcagcagcggctgcggctgcaactgttcaaaattgctgcagcttgcagcgactttgaactgcggccgcagcgactgtggcagccctagctgccgaacagggccaataatggaatagaataccatctcaacctttgctcaacgagttatagcccagtccagattcatagctagagatgattatattttaggacagagagagtaggcgagtagctattatgtttccaccattgtttatcaacttaaagtccggtcactggatggatttgaactatttccattgtttatcaacttaactatttccatacgtcagggtgtcctcctcgatcatatcttaaccacgtcttggtagcatgcttttctcgatcatctccatacatccgttaaggccatgatatcctccacattcatagcaacattacgagtgtgtttggttggtagcctagatgccacacctgtaacaagtctgaacaacatacaaatttgtttggttacttatctggagagttgcctgactcaggccacaaaaaatgaacaccacaaatgaatgccacacctccattcttttttcatcaacgtgactataatactaacatttgtcaccatccgactcaaataagtgtactttttatctatactattttaaaatatagtagtgatggactggtggtagcagtgagtctgctactatcacctctatcgctaacatattaggcctccttatcggtgaaactcacgtgctcactggattcaaacgtaaaaaaaaaagtatgtctaagcaaaataatgtcaatatttttttaaggtccggtaagtacgtactcccttcagtttcattttaattgacgttttggacaatgatacggtctacaaaatatatctttgaccttatttttctattataatatatataataaataattgcatatttacttttattgtagtgctttgaaagacaaatctatatatgttgttctagttcttttaaattaaatatttttaaagttattaattgtcaaagttataaaagttcgatctcaacctcatctaaaatgccaattaatatgaaaccggagggagtagggaattaatccatatagttaaaaggattagaaagagccagtttgcagaatcttcaaaaagataagtgtgcacaacgtgactttgttttttgccattgcaacatacaggcagtcttgtcccaaaatgaaactatttttttcactcttcacccaaaatgaagctattttttcactcttcccctcctctcaacaaatcataaccattctccatttaattatctcgtctactgtctgttctcagctaatcacaaccttactttaattatttctaccgattttttaaatacccatgctcactaaaaaaacctacattttgaatagaggtaatacaaagtactctctctgtttcgtattacatgtcgttttgacatttttagttaaactttttaaagtttgtccaagtttatagaaaaacatagtagcatttttaacacaaaacaaacatatatctactattataaaaatcaaagatgttttttgtcgaaattttgatacgtcatccgtttttgagttgttatatatcgtccgtatccaatttgatgtgagtatagaataactattatacatcctatcctagcccaacccctcccctccaagcccaacctaactggcccacactatcccgccgtcctatcgtgcgtttaataaaatatattcaatgctagatttaataaaaactaattcggtgttttagatattactaaatttttctttaaatttggtcaaatttaacaaagtttaactaggaaaaaaatgtcaaagtgacctataatataaaactgagagagtagaaatatagcattgcacacgtcttccgtacaaagatatactaaagtggtgtttggatccagggacttaactttagtctctgtatttagagtattaaatatagactacttacaaatctaattacataaacgaaagctaatttgcgagacaaattttttaagcctaatcaatccataattaaagaatgtttactgtagcattacataggctaattatggattaattaggctcaatagattcgtctcgtgaattagtctaagattatggatgagttttattaatagtctacgtttaatatttataattagtgcccaaacatccgatgtgatagggacttaaaagttttaatcccatctaaatagggtctaaggccctgtttaattccagggatgaaaagttttgggatgtcacgttggatataaagacacacatttgaagtattaaacgtagactaataacaaaacaaattacagattccgcctgcaaattatgagacaaatttattaaggctaattaatccgtcattaacaaatatttactgtagcactacattatcaaatcatggagcaattaggcttaaaagattcgtctcgcaatttacacgcaatctgtataattagttttgttctttgtctatatttaatactctatatctatgttcaaacattcgatgtgatagggtaaaaaaattttgcgtgggacctaaacatggcctaaggaaaaagccattatccagttcctcttagaccctctagacttctggacccacattccagtttccaacgttaaacccacccaggacccagcacaccgcaccaacctctctcctccccccccccccaactaccaaaatttcaaattcccgcactccctcctcccccctcgccgccggccatggacgccgccgacgagatggacatcgacgccgccgccgacgagacgggatccccgccctccgcctcgggatccctctccaccttcctctccgag

SEQ ID NO: 65084 - DNA, 38072 bp, Oryza sativa
tccctcgcctccctcaccttcctctcctcggcggcgtccccctcctcctccatcttcccccgcctcgccgccgcgggcctcccggcctcctccctctccgccccgctcgccgcctccctctcctccgcgcaccacccgctccccgccgccgtcgcctacctccgcctcctcctcgccccggcctcccctctcctctccctcttctcgccgctccccttcctctccctcctcctcgccctccgcaagtcggcgtcgtcgtccgccgcgtcgcacgatgcggcggcggcggccaaccctagctccggctccggctccggctccggctccggcaaggggaaccaccggaaccggaagcggaagagccaccagcagcgtcagtcgccggcggcggccccgtcgctcctccccagggcgctcgcgctcctcgccgacgccgcggggaggctgccgctcggggagcacccggacgcgcggaggtcgctcgtcgacaccgccgcggagctcgccgccttcgatgtcctcgtcgccgtcctcggatctggctactacgccgaggcgatgcccgatttggtgcgcgcgctggcccccgtggcgctctcagggtccagatcggcggcgcgggcgtccgcggtggaattcttggcgaggaaggttgtgccgttgggtgtggagggaggggaggatggggtgaggaaggcggtgggttacctaccgaggtatctggcggcgaaggcgccggagaagtcggaggctagggcgatggcggtggaggccatagtcgaggtggtgcgagcaatggggcaattggagatggagggatttgctgggtatgtggtggctatggcgaaggggaaggcgaaagggcggctgcttgctgtggatttgatcttggcgatgctgccattgctgctgccatcggaaggggatgattgtggtctacaggagggttcttgggggctgaagtttgtccgggtgcttgtggagaggtgctcggatacggtgggaggggtcagggctcgggccttgacgaacgcagcccaggcgctcgacgttttgtctgaaagaggcatggaggttgaccggttgcaggaggtgatgaggatagggaacataggccttggcgagttgctgaggctgcggtgcgctgatgataaggctgctgtgaggaaggctgcgcttgtgctcattactaagtcaatcagattgatcgggaggcctgttgacgagtcgctactcagtgctatgggggctgcgtgctctgatccgctagtcagcatacgcaaggcagctcttgcagccatctcagaggtgttcaggaacttcccggatgagagggtaacaaaagagtggcttcaggctgtgccaccactggttattgatagtgagacaagtatccaagaggaatgtgagaatttgtttcttgaattggtcctgaacagggtctgtcaagctgccaatttgaatctaaatgatgattccaatgatatggaggaagtgtttcctaaagggacactggatttgctgaaaagtatctgtgatggagaggttgcaccatgcataaaaaagatatgtgcaagccttgggaagaagaaaaagctgaaaccactgcttgcaagttcattgcagaatatcataacaatatcagagtccttgtggttgagaggttgtaaaccaattgagatgtggactgcaccagccggggcatggtggcttctttctgaggtctcatcatttgcacctaaatcagttaactggaaattcctctcacaccactggaaactccttgataatgttggccaagataaaggcaaagttcgtcctaaaggggaaccaaattctgcattatgggctgtggatcgtgtttcactcttgcaaactatttcaaatgtttccatggagctgcctgtggaacctgcagcagaacttgcacacagcttgctcacacggattgaaaattttgacatgaaccttagtgaggtaatcatttaatgtatcaattgcaaaatttagtctagtacaatagatttattacatagcaacaaatcatgtactctgtttgtggtcaggactaggctgcaatttagttgtaaaaaccactaaatcattaatcatcttgatttgtaaatccactatggcactacgctgaaatctaccatgccacattgcattccaccctagtcatgttactctattggaaatgggactagggagtatttatttttatgaagaatttgatctagccagtgcttttaatggtgtctttaatttgaatgaaggtgaacatgtcagtgatctataaggtaaagactgggtatatatacccataactataataatccacaatattttgaattagttttctgaatgaggtatccttctagcttatctgaaggttcacatcatagtcccaactcccaaaattgctctgtggaaacctacttgttatgacaagattatcccgtatctgtatgctcagattatttgttacctaccttgtttttacctgccctttttttttttctctccatagttctgcaatggtgttacttatccacttgtattatttttattcatggcattgctacctttaccttctttgttagatgaataccatttttgtgtaccacatcgctcttgatataagtaattcattgtgatatgttcaccataatgtcttattttcatacacatacaggttgatgctcatgtaaaatccctgaaaacgttatgcaaacgaaaagcaaaaacagctaaggagggcgaaacactgatcctgaagtgggtgcagcaacttatatgtaaagctgttaacattcttgatgaatacataaaggagacatcagaagctgctaagggtcctaaattttttacacctttgagtggaaaactcaagggaagaaaagatgcatctgcacaaaagtcaatgtcacatgcagttattgctgtattcaccattggatcgctgatcctagcttgccccactgctaatgtgcaaggcgtcattccttcgctgcacacaatcataacatctggaaactctcagccaagaccaaaaaatcttgctggtgggactgtttctttcaaagagctagctccatctttatatatacagtcctgggatacaatggctaaaatatgccttgtggatgacaaacttgcgaaaagatatattccactttttgttcaggtgcgtagccttgcatggttgcacttccatgtctactcttaatagaaacactcaatgctacttctttgactcaggaacttgagaggagtgatttggctaccctccggaataacatcatgattgcactggcagacttttatgtccgttataccgcaatggttgactggtgagcttacatctccattggttgacttttatatctgttatgtccttccaaaatcctgttactgtgtttctttcaagtggatttgcatttgcttgcttacacagtcacataatataaagcatagatatcactagtgtgtgcatactttgtaaaattagcacatactgtcaatattcacaaaatttgggtttatctttgttacagcttcagttgcaaaagatgtaaaactgctttactgtttgattaagatcttatcagttaaactgcacgtgggaaacagggaaaacattaaaatagttcaacttctaactgacctcccctttttattcactctgcagttatatgtcaaaaataacaaaatcgttgcgtgatccctgtgaggtagtgaggaggcaaacatttatcctactctcaaagttgctgcaggtgctaataattttcttaatatcacttccacatgtttggatcatggtttattgaaacttttcttttatttagagggactatgtaaagtggagaggtgtgctcttccttcggttcctgccatctttagttgatgagtcagagaagataaggcatttggcagacttcctttttgggaacatcttgaaaggtttaccctgcgttctgttttatcttttacttgattttttttatttgaaatttgaaaaaaattgtggccacacgttttcttttttcttgggaaagtcaagcactcaagttctttttctgaaggatttaccccctttctgtgttatctgtctaatgttgacataaattttgcagctaaagcgccactccttgcatataatagtttcatagaagctatctatgtcctaaacaattgcttgggtaatggtgcgcaaaccgaatctcagggaaggttggacggaggaccaaccctttttgcaatacggtaaaatatgtagaaattcctcatgcgtttttgagaaaaaaaaagatatccactttgcaaaaagctgtgcttcatcctctcctgagttctatcatggttatttttttctttttgctgcagaggcactgacgaaaggtcgaggtcgaaaagaatgcacatatatgtatctctgctgaagcaaatggcaccagagcaccttttagctacgtctgccaagttatgtgccgagatcttggcagctgcttgtgatggcttgctcaatgtcgatgatgccgctggaagggctgtacttcaggtacataccataccaatattgatattttggacaagtttcacgctaatgtgaagtaaattgttcatgcacatgcagccaaggaactgagattaactttcatgcttacagtttacacgtttaggtcccctttgattcaaaggaaattcataggaattttaaaggattccattcctaaaggaatttttcctatatagccctttgaatcaaaggaatgaatcctatgaaatcctatgaaattcctatggaatgtctaaagacatggaagttttggaggaaatctagcatgaggttctacctcatgaaaattttcttacgagtcttcatctctcctctaattcctacgtttttcctgcggtccaatcaaacggtcattcctgtgtttttcctgtgttttgcaatcctttgttttacacttgtactcgtatcaaaatcctacgttttttctgtttctacgttttctcaatcgtatcaaaatgtttgctcagcaatttcctccatttagcctttgcttctttcctttgtgaccatttagctacattttcacaggatgctctacaaatactggcatgcaaggagatgcgcatccaccccaacatttgcacggacaattccgagatggatgaggaatgcggcgatggcgggtcgtccaatgccactctccaggcggcgaaagggagagccgtcacccaggtggcgaagaagaacctgatccagatcgccatcccgatcttcatcgagctgaagcgccttctcgagagcaagaacagcccgctcaccggctgcctgatggagtgcctgcggaccctgctcaaggactacaagaacgagttcgacgagatactggtggcggacaagcagctgcagaaggagctcctctacgacatgcagaagctcgacgtcgccggcaagggcaaggccaaggccgcagctgctgcggaggctgggccaagcggagcctcgccggcggtgaacggtggcggcaagagggcggcggacggctcggcgagggccacggcgaggtcggtgctcaaggaggtgaaccggaacacgccgacgccgccgctgaactcgatgagcgtgcccaaggtgaggtccatgctgggcgtcggctcgcgccggcccgctgtgctggagtcggtccggcggcttgagccgtttgggtccgacgatgagaattagcgtgccatatggcagaagctttaggttggcctgatggtcagtattaggctgtgtttatgatgctaactttgaccggtttaggagaaaattacaagctcagtttctcgctgacggttttgtacatggagtatatatttaacgcattttagtgatgttcagagagatgaaacaattttactgtcgcattttctccttagtttggatgtgacatgaaagtatatatgctttacaccgaagattgcgatgtctcttgactgaatactctaacttcttatagtggaattcaggttcgcaagcaggaaatgtataaaaatcatggctacagatgggcgaacttgttaaaaaaaaaaaacaaactcaaaccacaccaggatacatacaaattgatatgtgagcaattttgacatttcatctgatggtgtgctaatgagcgaattagattatcaatatgactttctcaaaaaaaaaatcaatatggcattttagcaaagccaaccaacttcatggtatttataggatgccatcaaactatgtggcaaaggagcgataatagcgaagggttccaagtatttttctatatttgtttcgaaaaatagtggaaaatggtttagtggaagctgttgattatttgaaacgggaaatgtgcagtaaaaagggaacttctaaaataatcaaatcctagaaacttctcttatgcttttttagctagagagtagtaaaacattctcattctttacttgtaggcttatcagttggagccagaatttaaatttagaaatacaattttagagttaatttagaattattttattgtagtttatttgtagcgttggcttttaaaccacaaatagtaaagatataaaagttttaaccctaaattattttttgtttgcttggttcatatttatacggcttatagccatagcttaactaatcacagcaaattaccattaacttaagagatcgaggcagaatcccaacctaaccaacttacggcatcagggaccgaagttgcccaaaacctgacacagcttggctctaatttcacacatatctaagccaaacaattcagcaaccctatttgaattgagctatgtctacgcctaaatagagattttgtacgctagatatgattaggactgtgaaatataacgggttgtcaaaattttgtaccgacgtataggaatcgacttctacttttacttaaaccagaaccaattctcttcttgagaaacaagaaccgattctgatgagtccatataattgacgaccccccctcccccaattcgatctcttccatataaatcaaatcaatttgatttatataattcgattgatttgatttgaaagagagagaaattaagcggctactagcgcatcacacatggcgaagaagaagaaggtgttcatattcaggaaggcggcggacgtcgccatggccgtgtccgccgcctacgcgccgttcgccgccgcggtgtcctaccatgccgccgccgccgcgccggcggcgctggccttcgcgctcggccacggcgcgctcctcttcatgctccccttctccgtctacgcgctcgcgttcctccgcgcgccgcgcggcctccaccagacgccctacccgatgctcgcgtgcgccgtcgccgcccccgccgcgctcctcgccgccgtcctggccgtgcccgtgctcgccgccgacgacgtcgcgctcgcctgggccgcgaacgcctccgccgccgcggcgctgtggtggtgcctcacgaacggcggctacacggcggtggcgttctcgagggtggaccagtacgccagcttcatggacgcggtggagcggacgccggagatcgcgttccccctcgtgttcgacgtccccgccaccgccaaggccgccaggcgcgacgccgtccgcttcgccgccgccctgtccgccacatgcgcggtcgccggcggcgcggcggtcggcgtcctcggcggcctctcctcggccgccgccgccattgccgccgccctgtgcatcttcgcgctgccgatgtgcctcctgtacgtgccggagaatcacatggacccctaccccaccatcgacggcgtgctccagcgcaacccggcggcagcgtggtgcacgcttctggcgccggtggcgctcgtgctgtgcggcctcgtcagggcctcggccgccacgaacgccggagacgttggcacgttcgccacggtcatcgccggcgcgttctgggccatggacgccggcgccgccgtgctgctggggcgggtgatcgcgggggagatcaccatggcgagggagacaggcaagcattcgatctaccggtcgagctcgtcggagatcatgtcggcgttgctcatggtttgggtgcggtatttcgtgtacctccatgttttccacctgattggctgcggtggacacctcacatggttcaactcatctcactagcttagcctactaaagttcgaagtcccaaatatggacttcgtctcaaaaatatactccatccgtttcataatgtaagtcattttagtatttttcacatttatattgatattaatgaatctagatatatatatctatttagattcattaccatcgatataaatatgagaaatgttagagcaatcatatctgggagtaccgtcttacagtacagtattagactcagtttattgttgatatagcagaggatccacatcccctattcttttttttagataatgacatcccctattcttctgaagcagaggatcaaatccttcaatctaaacagttactatttttatttttatttttatagagactagaaaaaatacctgtacgttgtaacgggtgaaggctatgttaatcttattattgctatactgtttagttaatgtgaaatttactgtggaaattcgcttagagatatattttttaagaaactagcaaaaatgtccgtgcgttgcaacgggtgaaaaaattctaacgataatttatttttttcatacataaccatgtcaatgataatgtttgtatagattgtttatagctaagacaatcaaaaagttggaacatcttcaatgtaatggcccaacctcaacgatgacaaccttaccgatgcctgctttacctaaaataattggattatccacgtgacagcatatatataatctaaaatactctttcaatcttattcttgcaaccaataataggattaatcagatactacattacctcgcatggtcaagtctacacaaaatagagtcactatgcactcttctctaaataacaattaaaaatatgtttatttttcagtattatttctatatcatatgttatcagaaatattagctatacttaacaaaaatagtctaataattgcatatagagacgaaacaaaagcatggtaggagatgaaaaaaaattgatgatcctatccgacctaagagtccatcaatttagtgttttttttgagcgtccatcaatttagtgttttttctgatatttttttcagagcagcttgtttttttatatacagtgtttttttcatgcgaggtttttccaaaccattttttttagaaatggcatgttttttctaacagttttttcttcgcatgttttttttattttttagggatgacggaaacattttttagcgcttttttctgacatttttttctcacgcttttttaaccatttttattttctcgtgtatttttttatttttagttgtacgttgaaaacttttatttataattgtacgatgaaaacttctctttttagttgtactatgaaaacttctcttttcaaatagttagattagattagattagagatagagaagagatatatgcggactactaaaacgaatagaaatcgaactttttttaccgcgctttttcccgctccttttactttttttctcattcttttttattttttacgaactattttttcgccactttcttagggaatcagatggagcttttttagatgtgaattttttaagtaggggcggacgaatgaaatgttttgaattttttaagtagcagtgatagagaagcatacaaagcttatatacatgcgtataaaaaaatatacagtttacaaagtttgtatacgtgtatataaagtttgtatacatatatagtattaggaaataaaaaaccaaaaaaagaaagaaaaaaaagaaacgaaaaaaagaaggaaaacagaaaaaccatacgtgggaataggattatataggaataggattttcccccctttttaaggggaattagatctactgtttttttccggcttgcaaatcggacatgttttttttttcgccacttttttccgccttgcataggaatcggacatttttttttgttgtttttccctttttaaggggaactgaatctacgatttttttattttattcgctattttttctcaaacttttgggaattggacttctttttttttttgctattttttatttagatggacgaaggaaatgttttgtattttttaagtagtagagaataatgagatgctattaggagtccaatgtttttttaaaagaaatttcttatacaactccttttttattttaaaaaatgaacgaacttagaaaccgactcaaatacaaatatgtatttctaaaagcgaacaaacttaaaaattgactcatacacgaatggcgtaccaataaaaacatctttaatttttataatagtagggaatagatagaaagaaaatacttgtgcgatgctacggaacaaaaaataaaatagcaattaacattaaatagagaatttagttttgattatggaagcccttttgaaacctacatctattttctatacaccacctccaaacatgagctaaggctagtgtgggtggtatgcattatgcaatatctaaaacatatttttgttttcgcatgtgagaaatgagaatcactattagtattatgttctctctccgccaatctaataaaaaatatccatgcatgttttgattggtgagggcatggaatatttaaatcatcgctagagattgcagaggtttggttttgtttgcagtttgtaagaaactactctctccgtcccataatataagggattttgagtttttgattacaacgtttgaccactcgtcttattcaaatttttttttaaatgtaaaaaacgaaaagttgtgtttaaagtactgtagataataaagtaagtcacaaataaaataaacaataattttaaatttttttaaataagacgagtggtcaaacgttaaagcaaaaacttaaaatccggacggagggagtatcgagatgcagtttagctgctcaggttgaagccttggcttgcctggagggtgtccaattggctgccaattgggtacagatgccaataattttagaatccgacaacgccaaagtcgtagcaggactgaattcaacacaagactcaagagcagactggggagttataattgctgaagcaaaagcggtgatgcgatgtttggtgcaggtgcaagtgcacaagatagataaagagagattcaaataacatggctcatatgttagctcaaatggttatgagatcaggagttgaagcggagtggaggttatgcgctccgccagaaattcttgcatcgcttaaccaggaatgtaaatcctatgttctgccattaataaaatctctctttacgctaaaaaaaaaaataaaggctgagtttagttctaaactttttctttaaacttctaattttttcatcacctcaaaactttcctacacacaaactttcaacttttccatcacatcgttctaatttcaaccaaacttctaattttagcgtgaactaaacacacctaaagataggttgtcagggttacgggttaggcataccctttacccttcgataaatgttacatatcgatatgacatacccacgcgcatgcggatatttcctgtatattctaagggaacctttcatggaatctacagacgggaagaatcctactcgggcagaattgggtcgttgacgtatcgtatagggtctgatatctccgagttctacgtggagacctccagatctgcgatataaaagggaccccccggggagggtttaagggattgaatctcagagccaacacaacctacacagcctacgaggagccaagtcatcgagagctagtcgaaacaactcgactacaatcttgccggatccgacaagttcccttgttccctttgtaacctgtgttttctaccatataatcccacatcaactggattagggttattacctatcaagggacctgaaccagtataattcttgtcttttgtttgcttgatgtcgtactacgtagatccttgtaccaacgtactccaataccctctatatccggtctacgggtatcacccgtcgacagtggcgcgccaggtagggagccttggtactcaaggttctactactacgtcatccagcttcgtcgacaacaacgtcagcaccagcctcagccaagtactccctgcttcaacaatgctggtatggactcaagtcggcgaaatcgtcttcccggtttacaccacgacgctgatctcaaccggtcctccaaggactggagacgagaacgcagtggctacaaaccaaggcgattccatgtcgaaaaatcctcccgttgagacggagaacggaacatcgacgacatccaagctcgggaaggattttgatacggccaaaccttgtccttccgacatgaaccatgagccgacaaagatgacttccgaagccacaaggtcttggtgtcctatccacaaaaccaagaaacacactctgcaagattgctgggttttcctcaacgtccgtgctgaaattcgcgcctacaaagaacgtggaattcggcgtacttctccaactcgggaggtctattgtcctattcacaagacaaagaatcacgacctctcgagctgcaaagtctttctcggcgccatgaaagctccgtctcctaagttatatgtccccatcagggataacggcaaggaacaaggagcgactccaacttcagatcgattcgttggggtaatcgatcctcacgaaccatcggtcttacatctcctcgaggactatgggtcatcgacaacgagcgcgccgcgggaggtattggctatcgatgacgttggcacgtcagtgcacgccaacgcagaagcggggaatcaatcgactactccagcccagcacatcagggccgttcaagcgatactgagggaaactccttacgatcccgttctgaacgatgacctcgatcgttggacagaacgactacgggaatcggtgactaacctcagcaatacgtttgaagaagccgctaccgcagcacacaaggagcagccaccaactggcgatgccaatggtgaagatccggaacggagggaatcacctcaacgagctacccctccacctcgcggcactagcgatcttcgagatcaaatcaacggccgccgagaagcacgacgcacacgagacaacgtgaatcgctctcggcgtcatgtctcttcacagcgccatgataacggaaatcgaggagaccgctcaaacgaggaccgggaccacgacaaccaccacgatcacaatgatcgcgaacgatgggtgccagacaatactggtcatggctgccgccgtaacgacgacgacgatggagatcggtgccgagacaacagcggaagacgacgacaggattcccgagatccaggccgtcatcctcgtaatcgtacgccggaaccaagcgacccatcgtcatcgtcatcatccgcgtcctcctcatcgtcagacagacatccacgaaggacacacgaccgccgacaacccaccgcccccaacgctgggtgtagggctttcggtcgttccctacgtgatgtccgatggcctgagagattccgacccggagcaatagaaaagtatgatgggagcaccgacccagaggagttccttcaagtctactccacagtactctatgctgccggagcagacgacaacgcgttagcgaactatttaccaaccgcgttgaagggttctgcacgttcatggctgatgcatcttcctccctactcaatctcttcgtgggcagacctgtggcaacaattcatcgccaatttccaaggaacatacaagcgccacgcgatcgaagacgacctacacgtgttgacacagaactcgggtgaatcattgagggaatatgttcgacgcttcaacgagtgcagaaacacaattcctgaaatcaccgacgcttctgtaattcacgccttcaaatccggtgtcagagatcgctacactacccaagagttggcgataagacgcatcacaaccactcggagatgattcgagatcattgagcgatgcgcccacgctgatgatgcgctaagacgcaagaacgataagccgaagaccgggggagagaagaaaccagccacggacacatctgagtcaagcaagaagaaaaatcgcaaaaatgggaaaaggaaagctcaagcggaagtcctcgcagcagaatacgcgaaccctcccaaaagcccagacccacaaagcagcgacacaaagaaatcatggtgccccatacacaagacggacaaacattctctggaagattgccttgttttcaaaaagtcgctcgagaagcacatggcatttgaaaaaggcaagcgagtacgcattgtcgagaagaacgaagagacggctcctcacgaatcggattcagcatattcagactctgacctgcacgtctcacacatcttcggcggttccacaacgtactcctccaagcgagaatacaagaaagtggaacgtgaagtctgctcgacatggcagggggctgcacccaagatgaagtggtctaagcagaagatagagttctcggaagaagaccaccccaagaccgccgttatcccaggacgatatccgatcgtgatcgaacccactattcggaacatcaaggtagcgcgagttctcattgacggtggcagctcaatcaatcttcttttcgccagcactttggacgcgatgggaattccgcaaagcgagttgacaccaactgatcaacccttccatggaattactccccaatcatcgtccagacctttgggcaagattacgttgcccgtgactttcggccaagccaacaacttccgaacagaacagatcacctttgatgttgctgaattcgatacagcttacaacgccatcatcgggagaactgcacttgcgaagttcatggccgcatctcactacgcatattaagtgcttaagatgccgagaccgaagggaacattcactattcaggggaacgcaaagctggcggtgcaatgcgacaagcggagcctcgacatggtcgagcaaacgcctagcccacccgccacgactgagccacccaggaaaatgaccaagacaaacaagacgccgaaaccagacggcgccatcaagatcgttccactctccagtgccaaccccgacaagaccgtcaagatcggggcgacactaaacgagaaataggaactcgcgctcatcaccttcctccgcgacaatgccgacgtgttcgcttggcagccgtccgacatgccgggggtccccagggaggtgattgagcacaaactcatggtgcaacccgatgccaagccagtaaagcaaagactgcggagatttgcaccagaccgaaaacaagccatacgagaagagctcgacaaacttctcaaagctggtttcatcagagaagtacttcatccagagtggctagccaatccagtcatggtgcggaaggccaacggaaaatggagaatgtgcgttgacttcaccgacctcaacaaggcgtgccccaaggatcactttccactccctcgaatagaccaactggtggattcaacagtcggttgcgagctattgagcttcctcgacgcttactctggctaccaccaaatcagcatggcaaaagaggacgaagagaagacagcattcatcacgccgttcggggtattttgctttgttaagatgccgttcggactgataaccgctgggaatactttccagcgcacggtccaaggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcagacctcgagaagatcaaggcaatcgagaacatgaagtcgcctacaagactcaaggaggtacaaaagctaaccggatgcatggcaacactaagcagattcgttgctaggatgggaaaacgaggacaacctttcttcgctctgttgaagaaacaagacaaatttgtatggacacaggaagccgaagaggcattcattgcactcaagcgctacctatcaaacccccctgtacttgttgctccccaacctaatgaagaattattcctctatattgccgccacgccatattccgttagcactgtcattgttgtcgagagagagagagaaagtacatcgaccagtttattacgtcagcgaagctctccacgacgcaaagacaagatacccatagatccaaaagctgctttacgcagtcatcatgacatcaaggaagctacgccactactttcaagcccacagagtcacagttgtctcctctttccctcttggcgaagttgtgacaaacaaagacgttgtcggccgcattgcgaaatgggtagtcgagctgagccagtttgatgtccactttgtgccacgaacagccatcaagtcccaggtactcgccgacttcattgccgattggactatgccagataacaaatcagacaaccaaggcgacaatgaaacatggacaatggcgttcaatggcgcactcaacagccaaggagcacgggcaggatttatcttgacgtctccctccggagatcaattcaagcacgcaatccacctcaacttcagggcgaccaataacactgcagaatacgaaggactactcgccgggatacgagctgcagctacacttgaggccaagcgactaatcgtcaaaggggactccgagctagtcacgaaccaggtgcacaaagattataaatgctctaactccgagttatccaagtatctcgcagaagtcaggaagctagagaaaaggttcgatgggatcgaggtccgacatgtctaccgcaaggacaacgtcgagccagatgacctagcacgacgtgtttccagacgagaatcgctcgagcccggcacttttctcgacatcctgatgaagccatcggtgaaagaggttagcggcgaagtcagcccgaacacccccgacattagctcggaggtcaccgaggcagaacgcgccattgccgacatcgaaaccacagacgactggcgcatcccactaatcaaattcatcagcagtgaggagttgcccgaggacgatccagaggccgagaaaataacccgtaaagcaaagatctactgtatggtcgacaatgatctatataagaaagtgccaaacggggtacttctcaaatgcgtctcgaccgacgacggcagacacctcctcctcgacatacatgaaggcatatgtgggtcacacgccgccggtcggacattggtcggcaaagcttttcgacaaggctttttctggccaaccgcccttaaagattcatgcgacatggtccagcgatgtgaagcctgtcaattccacagtaaacacacaaagctacccgcgcaagcgctccagactattcctctgacttggccattctcgtgctgggggctagatatacttgggccattcccacgaggacagggcggctacagattcctattcgtggcgatcgacaaattcaccaaatggatcgaagcaatacccacgggggaaatcaaggccgacaacgcaatcaaattcatcaaagggatattttgcagatacggactaccacaccacatcataactgataacggctcccagttcatcagcgccgatttccaggactactgcatcgggctgggggtcaaaatatgcttcgcctcggtctctcaccctcaaagcaacggacaagtcgagaggggaaacgacatagtactacaagggatgaaaacccgcgtctacaacaggctcatgtcacacgacaaaaagtgggttgaagaactcccatcagtactgtgagccgtacgcaccacaccgacaacgtctaataaggaaacacccttcttcctcgtgtacggctctgaggccatgctcccaggcgagctacaacatcagagtacacgagtacagaagtactccgacgagaaccaggaggagcagcgagatatcgatgtaaatcttctcgaggagcatcgtgaacgagttgccgtccgagcagccagctatcaacagatcctccgccgttatcacgagaagcgcatccgtgcacgcatactttcgatcggcgactatgtcctccgacgagttcaaagccaagcagggcgaaacaaactctcacctaaatgggaaggaccttacacgatcacacaagtcttgcggccaggcgcattcaaaatcgcagacggcgacggtcgcgaattagcaaattcttggaacattgaccaactacgtaaattctatgtatgagtcaataccatccatacctgtaagcacccttacagtatcaataaagcctatttctaggcccatatcacaattaaagtgtttcgcccgatgatccctcactctgatgacacctagcgttgaaacctgtccttatgtccctttacgccgtctcgacaaggcctccgaggaacctaagggatcttcggctggggacacccagagccgataaggccttgtcagatcctgtagagacgaaagaccatgtaagatctggtcgtgtaagagttctcgccgtgcgtattaaccaagccgtgaaatcggaaatcaactttccaacttcatggctgggggctaggatcagagcttattcaaccaaggcagttcaaaggtccaagagccttatcctccgagaaaattcctccgacgacaaggctgggggctagggagagtgtacgactcaaacggctgactaaagtcgttaactgagaacgcactcttacacatgacatctagagtaagagacatttgtcaaagatagatttctttattcacaaaatacttcttacaattttttcaaaaatctttcgctacattacatcttttcctaagatatttgtcacagggtacgagtactaccaagaaggccaacgccagtccatagactggaagatcttctcggctgtaacattctgaaaattcgaccaacaaaatcaaagactccaaaaattcagatcttcaaaaaaaaaaactttttaaataaattgcatcatgccaattttattcgaagattttattggattttgatttcggatttcatcgatcacaaatgggaggaaattaactaggaataaaccctaaaaatcaagtgggctaaataaataattaaaatataaattaaaataaagattcggtgggtttggaaataaataaaatgttatcgcaaccatattaacaataattaaattttaatacgatggaatgagaattaactttaattaaaaattcaaatgaattatataaacaaaatatgagtgatattaaattaggtgaatcttcaattagaataatataaatatggggtaaaacttcatttatacaaaaaattaagaatttcggaatgaaattcatatgagaaacactctaaaatcggtttattggaaaagtgcattgttcattgcccgccacgtgttcgacctggtccccaacctttcccctcccctgccacgcgcgccgctccgcctcccctctgccgcgtcgctcgccgtcgcatcaccgtcgtcgtcgcgtcgagccccgtgccgagccgcgcccgtcccgctgccgcgccgctccccgtcgcgtcgccgtcccgcgtcgcgtcgccgtcccatcgccgcctgccacctcgccccgcgcgcccacgcaccccgtcccgcccgtcgcgtcgcagtcccctcccgcgccgagccgctccggagccccgcgccgcgccgcccgctcgtcgccatcgccgagcgccgtcgcccgtcgcgtcgccgtcccgtcgccgctcgtccgtcgccgtcgcgtctcgcgtcccgccgcgcgccgagccccgcgccgccccgagccccgcgcgccgccccgagcccagcgccgccatcccgtcaccacagccgcgtcgccgcccctccccctcctctctttcccctcttcttcttcccctcttcccctcttccctcttccctcctcctccttcccccttatctctctcccttcccctataaaagcctcactattcccccccttctccccgtctccaccacccactcctccacgccgtcgcgccgccatcgtagtgccgccgcgccgccatcgtagtgccgccgcaccgccgccgtcgtgctgccgcgccgaccgtttccgtgcccgcaccgctgttctcgcgccaccgtgagccgccgtcgctgccgccgtcatcgccgctgccgccgccggtgagtcgccctccgtttccctcgagtccgccgtcgccaccgctcgggtgggaaagagagagagccgagagaaagagagggagagccgagaaagagaaggagaggaagggaggaggaagccaggagagaaaagaaaagaaagggagagaaagaaaaagaaaagaaaagagaggagaggaaaaagggaaagaaaaagagaaagaaaaaaaaattaagagggaaatttaaaatatttacaaatattagaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtaattaataattaaacaaatgtatgaattctcgtaaattattgtggattatttctgggaaatctctataaataatcgatcaacggtagcgattcggatttaattactagggtgttagccgtgtattatatttaatcatagactaaattgagtcgtataatattataagataattttaggattccgtccgacatttagctcgcgataagaaatttctaacctaatatatggatataatgctagggtagattaaattaaaaacatacgacaacaaaatattgtaaccgcaaaataatttaaaccaaaattggggtttgccatagttcgcggatagtaaaattaataaaaaggaattgactttcgcatttgacttccatttggatttacttggatttttatttgaattctaaccgaattcaaatcaattttcgcacgtaactatagagaccgagggagccgcggatccaggtgaaggccaagacccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatcatgcatactcatatttatcaaatgctatatgcttgggcaattacctttgggaaggtaattgagatgcggcatgtggagacatgagcaccacattgccatgatgttgatgacatgatttgtgaaaggagaaataaaattaaacaaatgttttcgactggggcggctggaggacttgggtggtgtccggtaaaggctagtgccgtccctggtcagttaaggactgagccatgaagttaaacatgaaacgacctcagtacagccgtacttctcgaatgggtatagacctagcggagtagatagccgagcggaggcagtatccctgcatagtggtttcacttaggtgtgtggacgaacaagcagtctgctggcggatacccgatacggatggccaaatggcggatacccgatacggatggctagagactgacttggcaagactacaagactacaaggagatacccaaaaggggacagcgtggattgggttcaactacagaatgcgatgttaggcttgcgtgagttttccccctcgggagcgccagaactcctctcactgctagaaaccgtgtacgcctagagtgcatgagggcctaagttcatggagcggatactgccaaagtgaggttattgaaaggctttgccgtggcaagtctcattcgttgggacgtaggctcatgtgttgggcaagttgcggagtacgggtaaagtgtacatccactgcagtgtgagtaaaccaaatctattcgaatagccgtgctcacggttattgagcaccgggacatgtattacacttggctagactctaaattcttaacttgtgtgggatgggatattgcatgatgaattttatgctgttggagccacttcctgagaggcgggaaggtggacgtcctcagaaaaccatgacgaatcaatggcgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgcctactatcaggagggagatgaagacgatggcgtccagtaggtcttagtatggtcgttgcctgtggcaatggcatgccgctgcctgaattctgctgccttatctatttctgcttttggatgtattccggacctctcggtccgatgatttaagactatgcctgcgggcctatgatgtaataattcgtattagatactcgtgtatgtgcacttgatattccagctatgaattcgtgtgtaccaaactacttgatccagggaaatggtactgtttacacgattgattcctgttataaaaacgggggtccacatcggccaacggcgacattgaccttgccagatggtctatctccgccggagtcctccgagaacgagcaaaaccctcacggagatattcgaggtccaggcgcgggcgatgatttcgtaggcaagccaacacgtgccctccggcgtatcggctcgatcgacgacactcctgcttcaaggcctcgtcgatacgcttgccgattccatcgagttgggcacaggccccattaagccacgagatgtacccggccgccgactcctcgggatctccgcggactactcgaagctccttgcatactctggccatggatgtgcagcaactcttcaagtacgagttaaaccacacctcacgacctcggagcgtttccacagcctgctctttcttcacggccagcatggttctctcgagctccgccacttcaaacttcgtcttccagtattggatatgacgatcttggctagcaagggcaccctcgagatctactaaacgtaataaccactaagtcaagctatacatctctttcgggaacatggctaacctagtcaggagggcattaaggggtgaagggactactaacctgaggaagtcgtcgccatcccctctatatcaaggggttgatccacatggtcaggcgagacgtgtggttcaaactcgagtaccggaattattgccagtgactcaggctgcccgcgctgctggacatcctcgtcatcagcatctctagaaaggacaaaagttcccgaggtcagcataccaaagtaagctgggatagtaatcgcacgcacgaaggcggtcagagttcaagttttacacattatctaggaaatacaagaagtcctactcttcaaaaagggggagaacagactcccctagatcaccgacttcttccatcacctccttacgcgtgtcgctggccgccctctggtccaagatctcgcgcagatcgagttcaggacgcgacagccttacacacgcgaggacatgacacgccccggtgtagatcctgttcgacgtctcctccgcaatcctggccgcatgcttggaggggatttcccccatcgccgtcaccagttccgcgagagaggaggtcagcgaaaactcatcgggattcaccgggatcgtggacttgacgccgcactccccggcgagctggtgaaggccagtgtaggtgaccctcaatgagccccggatctcggataggttgttcccgagttccgacattcggtcctcgagccccttccgttgtcactcgttgtcggccaccaactcgcgtactagtctgtcagcacgcgcgttcgccgtcgccgcttccgacctcgcctccgcaatctcgcggccgatgccgcgagcaccagcttcaaggaggcgccccatctcgacttggagctcctcccaggtgaggactgcaactggcagatcacgacctgccgcggggtcgctgactgggccactaggcgtcgcctcccggctcccggctgcgggcacgacatccgtcgaggccacgacgggcgacacactggaagctcatccggacttggctcgcgcagcctttgcccgcgcctccctacaggacgaccacgagtcagacaacaatcgaataagaagcgcggggattcaagaattcatctacttacttctcgctaatcgtcacaatgcgttgtcgtcgtggaggtgggggagacgcgtccgaggcttgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagatgcctccttgacgaccttcactttcagagatgtcgccacctgatggtccgcgagcggtccaatgatgtcagtcaaaggaagggcctacgcttaatcaagtcataaagtgatttcgaaaggagaatgcgggatgcttatcgaatatacttacgttgatggcttcatcacgttccgccgcccccttttcataaaggggcacagggatgtcactcgccgtggtcgggccactgatcatcacctggccgacgcggcgctccacgatttcgctgctcagacctgttaatcgagaaccaaccttcgataaatcaagaggaacgcgaacacaagcatgtcaagataaatgcgagaaagataccccgaggagaaacccgggtcgcgtcctctggcccggaatagtcataagctggatgggcccgagcctgaagcggctggatccgcctaccaacgaagtctgcaacaacttcatatcccgacaaaccctgtgctcggagatcgtcgatgatgtcgataaacgactgaagagagggggtcaaggggggctttgcggtccaagacggaatcttgtccggttgatcttcaggaaccacgaagacagggttcgagttcttgatctcaagataaaaccacctattccgccacttgctgcgagaagaagggcactggaagggaatgtaacgcgacttcaggccatcccgaagtcggaacccgacgcaaccagataccctgttggattccatccaacgcagttcgtagtaaaagcgaaaaagatcaagaaaaggctctaccccgatgtaggcctcacaaagatgcacaaagatgctaaagaaggcgatggaattggggttcaaatggagaagagaaagaccatagaaattcaaaaccaggagaagaaattcggaagatggagggagaaaaccgcagagaacacaatcttcgatcgcaaccatgcgacccaagatgagctgaggattagtacctcctgcttccctctccatggttccacggccaggaagagcgccatcctcctggagtttcttcaacgttgcactggtggaagccgatttgccgaggtccattgctgatcgaaggtcgccggaaaacgagcctaggttgttgaactagggtttcttgtggtggcggagaaggcaaatagtgcttgcaggtggtgtgtgtttaacaggtttggtggacttcaaaatggactctcaaaattcctttaaataggcgcactaccgacggtgcaaattccagggaatagagagagatgcccgccagaaatttctgggtccgttacgcgcggcggttttctggacttcagtataaaattcgctcgtgaccgttgggcttcaaatggcgtgctcgactatggtctatctccgcggtcctcacaccgggaatgacaacagtctcgacacccgaagtcgtaaatggttgcacgagttcattttaagcagaagtcggggggctactgtcagggttacgggttaggcataccctttacccttcgatatacgttacatatcgatatggcataccacgcgcatgcggatatttcctgtatattctaagaaaacctttcatgaaatctacagacgagaagaatcctactcgggcagaattgggtcgttgacgtatcgtatagggtctgatatctccgagttctacgtggagacctccagatctgcgatataaaagggaccccccggggagggtttaagggatcaaatctcagagccaacacaacctatacagcctacgaagccagagcctacgaggagccaagtcatcgagagctagtcgaaacaactcgactataatctcgccggatccgacaagttcccttgttccctttgtaacctgtattttctaccatataatcccacatcaactggattagggttattacctatcaaggggtctgaaccagtataattcttattttttgtttgcttgatgtcgtactacgtagatgcttgtaccaacgtaccctaataccctctatatccggtctacgggtatcacccgtcgacataggtcgtcaaagaaaaagtgtgattattacttgttcgtcagcatctgaaccaacttcatacatgtacagtccaaatcactccatgggctgctggcaatctaaattaacgtgatccaaagccattaacagtattgcaggttgcagcctatacagggcacctacaaacgtacgtgtaagcgggcagccactggcggcaggcgggatgtcggcttcggctccttggaaaggaaggcactccctccgtacctacgccgtttatctttttaaacatatttttaaacatatttgactattcattttattcaaaaaaattaagtaattattaatttttttcctatcatttgattcattgttaaatatacttttatgtatatataaagttttacatattttacaaaagtttttaataagacgaacggtcaaatatgtttaaaaaagtcaacgacgttaaatatttagggacggaaggagtattatagatcggagatggacggccgagtttacttccaaactttttcttcaaacttgcaacttttctaatcacatcaaaactttcctacacacacaaacttccaacttttccgtcacatcgttccaatttcaaccgaactttcaattttagcatgaactaaatacatcctacaggtcagataccgggcgacagacaaagctattgggaagagatagagagatatatgcaaggaagcacatacggattcggacgacttaccaaggtcctggcaaaaacatcttcaatttttataatagtggagaagtgtttgcactctactttccaaactactccggtatatacatgactttttctctcctcatatgcttcacggtatagttggccatatgggctgcccggcatggcatggtccaggcccgatcatgctcgggccaagatttgttgggccggcacaacccgaccaatacgccgggccatgccacgtcggcccacgtgctccactgtggcccaggcatggcccaataagggtcgggccatgctgggccggcccgaaggcacatgcagcccatcatgttttctttgaaataagtctatttcccctccatactctttgggttgtgacatataaaaaactaaataagtctattttacgtccctactctctagtcgtgccatataatacgtctatacgtctatatggttgaaaataagtctatttcacctcgctaaagttcgtgccgtgccgggccggcccaccgtgccgaggcataggtccaggcacagcccaacacccgaaccgtgccggcatgggcccgacaacgatcaggccgtgccgtgcctgggccaggccaaaatcccctgccttgggccgggccgttgggcctcgggcgttatggccaactatacttcacggtgaaacaacagtagtaggagtacgaagcaaaatgccaagatccaacttttttatggatcttcgattttttttccccctaaagaccactagggttgactagttggcgtagggttacagctaatggcttcacggtacgactcatttatcttttattttaacgattgaagtacaacgttttagactctgcaccaaataaaaacacacacatttatatttataaacagaaaatttttccgtttgaaccatcctttacctaacatttttcactttggactaggtaaacatatcttttatcttttgtgtcactttgaaccaccccagttttctaatccattcacatacaactcatcgtatattgaaaatgttatttatatataacttcgagagttcattgatgtactagagcggtgtcatatttgaggcaactgcgagttgtcattccccactttcttaagcaaatgtttgagagaagctgattgagaagatacacaaaataaggtgaaccattagcatacgattaattgagtattaattattttaaatttaaaaaatagagtaatatgatttttaaagaaactttcatatataattttttttaaaaacacacaattaaaccattcgggaagtatgcaaaaactggggtacctttcctctcgaccagcttatgccgaacacagactgtgttcgttccgagaaagggaagaaaacttccttgttttccgcgcacatgtttctcgaactgctaaacgatatgtttcttttaaaaaaaattttctttagagaagttcctttagaaaactatattaatttattttttaattttaaataattaataattaattaatcattggtgaatgactaattttcttaatcatacgctaataattaactttttttccaacaaaggcatagaatacatgacgttgacttttaagctgttataagaactacaactagtatgcttgtgaagtgaagaaccattcaggaaagttcagaggtttctgccgaacaactggcctcactcaggctgtgtttagttggatccaaagtttagattttggttggaattggagatgatgtgactgaaaagttgtgtgtgtatgacaggttgatgtgatggaaaagtactgaagtttgcatccaaactttggatctaaacacagccaatcagcaggcgacagagatctcatcaactgccctgctcacctccatgacagtttacagttaacagaatcttccatgaaaactccgaatagatatataataagatggatcccccttcaccgataaaataatacttacacttagattcttccgggaaaattcccaccatgagtatattacatatgatgagtaattgatctcagagctaagagcttttccaaaaaaaaaaaagaaataaaaagaaaagaaaagaaaagagatgaaaatgctctataaaatgaagaagtgacacttcaactagtgttgcactaatattggaacactcatttagggtacttgagaacttgaaattacgataatccaagcctaacttgctcataggaaactgtccggatcatgagaggagacaaatccgaagctatataaagtcttaatttggaaaaaggcctaaaaatggaattaattgtttctaccactatcaaaatgctagtacgagagcgcaccaaaacacatcatctctcccaattctctcatacaactaactattcaagacaagtacaagatgatctaaaagattaaaagtttgacgacagaattgcacatacatatgaacactttcttcagtataaacgtggttattgctatgcgcgctgtgaattcgattttatcaacttcaacttcaaattaagggactaattaaaacgaggaacaaatcaagccgacgacaagacactaatccaaaatccaaagtcaaatcataagccggcaaggacgtagtcaccgtcgtcgtcgtcggtagtcgacgtataaatcgttctctgcactttctgcaggctgcagcttcgcctcttcttcctatgctctgcatcctaaggtgaagtggatatgcatcaatagaacggacaagtgcagaactttcgaaattctaactagtctagagtaaaacatctcaacctttttaagtgaattatttggttggcatgtagagattattataaaatgcagttttggacatcaatattggttttatttgagaagctacagattttgagaagcatttctacgacggatatttatgtgctttcttaggcaccattagcatcaagtttttttttaagatagatatacactacttctgcttttaaatatacgatattattaattttcagatatgactttgaccctttgccatattaaaaaatataactatcacttatttattttattgttacttgaatttttaataattgttaaaggtactttaaatgtgatttatatcttgcgctatatcttttcataatatgaaatgatcctatccaaccttgcatacggccctgccaaggtggcagcgcttagcgccatgatcgttagcactatgccgttggacctcatcgctaatcccgatggtgctgaggtatggtttatttttaaaataatttctggcacggtttacccttcaaataaattttctaaaaggataacatttatcaaaatttcgccaaaacatacatcatgtctctcatacaactactctctccgtttcataatgtaagactttctaacattgcctacattcatatagatgctaatgaatctagacattattatatatatagattcattaacatctatataaatgtggataatgctagaaagtcttacattgtgaaacggaggaattacaagataatctaaaaaaaagaaaaccatatagcacagtgcagttaatctaaaagtgcaatataatctaaaagtttgacgacataagtgcagttgcatatgaacacttgcttgcgtacgtgcatggttggtttgagcgctgtgaacgcgatttgtcaacttcaacttcaaattaggggactaaacgaggaacaaatcaagcccacgagacgacacatacagtaatccaaaatccaaagtcaatcacaaggccggccagatcatcaccgctgtcgtagtcgtcagtcgacgtaaatcgttctctccattttctgcaggctgcagcttcgcctcttcttccttttttgtagactgcagcctagatgaagtggacatgcatcaatagaacggacaagagcaaaagttttgaaattcgaaccattcttctgcaaaacacctcaagcttttaagcgaagtagttgctggtaagtggtggtattataaagagtacaccctccgtaaaagaaaaaaattcaacttataaaaacgaatgtacaaatgtgtttatccagattcgttcttagaatttcattttttttatagagggagaaattatagacatcaacactggtttatttagtgagctaaagatttcgagaagcatttctactagcgatatatggtctgttagacgccaataatataaagtttttattcttaaaaatgatatatatatattgcttatgtttttaaatatatgatgccgtttgcttttagatatggctttgaccatttgttttattaagagaaacataaaagtataatttcttcattttattgtcacttatattttattattgttaaatgtactttgaatacgacttttatcatgcactaaatgttttcacattgtgaataatcaaatgctaccacaataaaagtcaacaccatatatatttaaaaacggatagagtaacattcataaacaacctatcgtagtgaatgagtatctaacctatcgtagtgaatgagtatctgtgcgtgtatatatatatactagctaaatgacggtgctttgctatggattaaagaaaatgtattaatgtgttacccatctttttctaaacgaaatattcatcttaatctaattttatgtggctatccatttagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgtgcactcgctcgcgaacacagtaacaaaatgtgagctcaagcgaacattcccagctcgttccaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttctttctgctctaacatacttaatttggttctttcatctgcagactgctagcaggattgaatcagcagcgtccaaggtatcaactcgtgttcctgaatgaactaaagcctgtttacacactgatgaaattagaagccaaggatggaccgggtcttaaggtggctatagtcgaaagactcgaaaacaatcagatgcgcatcgtcaggttcggtcatcttgcttctgctaaggttgaagttgtagtcctccacggcaactttaatgctaaaaatgaggaacaatggacccctgaagacttcagcaagcagatagtatgcgggcgagagaaaagcgcacaacttctcaccggaaatctgacactgaagctcaatggaggggaagcattacttgagaatgcaaccttcactgataactctagcttcactagcactaagaagttcaggctgggtttgaggctagccaacaattctgaagatagggttcttgaaggaatcactgaaccttttcgtgtaaaggagcgtagggtggagggtatgccattgtccctaagattcagattgtttgtttcttcagaaatgtcttttggaccttatagctgagactaataatatgcaacttactatttttgcaggatttgaaaagcactacccgccaatgttggatgacgaagtttggcgtttggaaaagatcggccgcaatggagctcaccaccaggccttgacaaacagtggagttgatactgtacagaagttcttacaatcatattttacggacgaaaagaagctttttcaggtagaggttctatgaatttccttaaatattaaatttcagatgatgtttccataacacaaggacctgataatatagatgagccgttggtttcaaaagagaaaaaaatagactcaccgaattccctaaaaaaagtgactgacagaagatctttgatatttgtctatagacttttagcaagatgtcacaggcagcttggaaaaccatcataagccatgccatgacatgtgaagtcggtgacgatctttgcttgtatgaagtgaagggcaacaacgtgggacttttcttcgatgcaatatatcagcttgttggggtgaagtttggtgattcttacaagcccataaatgagctcgacgaaatagagcaggtactgtttcctcacttccttcaacaggagattttctcactattttcctaataatttggtgttttttgttcacagagtgcagttgaaacaatgaagcaattggcttatgcgaatataagtggtattcagtatgaccataagatggtcaacaactatcctgtaccgcttcataggttccattgtgggggaacttctatgttgactgactttattcctaaacagcagatcccaacttgtggtaatatcttgttctgagaatttcaatcactagcgataattacttttttggggatttttggtcatctattccaattgtttacaggtcaatacaattcagccctggctggtcaaccatttgaatcaacggagaacttttcttcattccaagaagcctctaatgtaaggaagatattttgaaatatacaaaatacagtacataataaaatacatatgcatgttagtctaagatagtttcatcaattttctagcaggcttcagtggatatgtcaagatttgtgcagggtcaaacctccaacgtgcagtttagccaacagttgggcatgggcaattttatcccacatcattcaaatcaaggaacattcatacccagaccaagaatcactcctctgtgtatacctaataccgaaaaaacatattttaatccaaacgctcatagcagcatccaggctgatcatgctgccacacgaattggccagtatgcacataatgagcgatctcattcacctgaagaatcatacaaggtaagaacctttttttatgtaaaaatctatgtattttgtctagatagaaatcgaagagtaaaaatttgacattacttgtgctcttcattcaacagaactaatccattctgtatttgtgttgacagcgcttttctccagataatttcctccatacagatgaagttgtggctttgatgcaacctcacttagtgcctccaagcaacagtaattactctatgctgatttttttttggctacatctgattcattcatcttgatgctaattactaaggatggcatctgcaggcgagaatttcagtaacctgctcaacctatcaagcaatgaccaaacctcacagcaaattgccgctccattccagccatcaagaacaaacagctttgactccagctcatgtgatcagctcatacagaatttcatttctcagttttctagcaacgaaagagttgcggtgccattgtccccacgcaagtgggtcaagatcagggcagcgctgaagctggcatctgtgggtaggctctccagagcctcgagaaaggcttcgcatcgccccccagcaaggccaaggcttgtcccaatagtatgagcctggtgaaaacaggttgtaaaaaatttagattaaagatcgatcttggtgttgatgcagaagttctagagacatctggtcaactgaaactaatgattttgtcaaaaagttaggtgtatgtaatctgtacatagtagagcctgcttgtacttcatttagtgttagtatttcccagcagaggattctgacctctttgttatctctgaatttagaaccatgtaaacaaaaagaccatgtaatgtattccttttttgcacctaatgatccttgagagaaatttccttttaagaaagttcacatctatgatgcaatggtaaaaaaattgtaattggcctaaatttgacaatttaacatgatgaagcgtacaaacttgtcattgaacttctctttgttgtaatggcacatggcgggcatctattccaggctaatgtacatacaatacaaccgtaacttctgcgtgtgagctatgtactgatctcaaatttgaaaaattccttctgggtttacaatttctctgtcctgttggaggtcttatctgtttatctctatctttgatgtctcaaaaccaatttttccatcagactgaacaatccactgatccttatacagggttttagaaacatccttctttcagtttcctattgatctcaccttggcatagtgggatccaccttcgcactagtcgattattttggagtgttaattttgccatttcgagttcttcttccacccgtagtgctgaaaggtagctgcttgctgttcctgattggggtttgcagccttttctctgacattggcgacttcattgcaagatttggaatcctgagtaaattcaaagcagcacaacaggttaaagcaatccaatgcacacaattttcatggaaaatacaggatttaaattggacttacttcgttgctgtaattttcgtattctttgtttgaggtttctttataataaaggcacctctgctggcaataccatcagctttgaggccactggtggacaacaacatttcttggtcggaaggcgagctagtagcagcatcaaagctatctgagtcatcagtttctactggttcagccctacgcctttgcttgtcgggatcatatctttggtagaaaaatgttggaagctgagttgcgccaggctccagctctagaatggaatttccattctcaaattgattattaccgacagccattctatcggtcttctgaatgccattgcaattttcagccaagtcggatgagttgttctcactgaggacaccagaaaattgaaagctggccttcttttgcattggagtggcattgttccggaccttttacataaagaaatataatattcattaaatgaacatcattacctttcttgtgaaaagattaaaaggaataataatctactgaaggtaacataagtactctcaacaagaccatgaactacgctttcgtcagttttagtgttgtccagatcattcacaaaatgattctgaacttgatgtacaaatgcataaatctactgaaggtaaacataagtactctcaataagaccatgaactaccctttggtcagttttagagttgttcagattattgacaaaatgactctaaacttatgtacaaatgcataaatagcccatctccatttagaatgtttggtaggttattttcctatttgacattgattggaatcataactagcactcacaaaaaaacttcaatgtgaaaaggaaatatttttgtgatttccaagaaaaagagttgatcttgtgtgaaagagcagttaatacctctaagtttccaacttcttccattggctgtctatttttagggaaggcaggtattgcattgcctcttttaattctatacatgtcagggcttgactgtgtgctttgaatgttttctggttctccttcctttttagccaatgccgccttgagggtagcaatctgaaacaagagcagagaaaaacgatgattatataaatctaaacagaagtaccacatctagatagtttatataaatgagcaatcaggagttaagtgaacacctgttctttgagctctctaacctcactgccttctttgtttgcttttgctgcaccaagctcaactgaagc

SEQ ID NO: 65085 - DNA, 1837 bp, Oryza sativa
ctataatctttagtcccggttcttaaccctaaccgggtttaaaaagaatttcgaaatagcgggaaaagatatttactcccggttgttgagaacaaccgggagtaaagatccatgggtatatatatgcccggtgcgccctcgtcttcttcaccaacacttaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgcatctcccttcatgcatctcgatctctccgatctcgatctctctccgtcgccttcgacgccgccgccttcgacgccgcgcaacgccgccgccgcatgccaacgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgacaacgatcgaacgaacgtgaacgagctagggaacgtgaacgagcgaacgaacgaggacgaacgttaacgtgaaatgcaatatatatatatatatacatgtatatatatatacatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgctcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaatcagcaggggcacgtggaaagggatgtggaggggaacc

SEQ ID NO: 65086 - DNA, 679 bp, Oryza sativa
ttcatttttttgagatattatagttatatgctccttctgttttgacttctttcttaatcaaacttttttaattttgattaaatttatagtaaaattaattcagtgttatagatgttgctaaatttttctacaaactttgataaacgtaaagatgtttgaaaaaaatcaaaacgacttataatatgaaacggaagaaaattatattatcataatctgggtaataatatgaaatataatgtttgtgagaattttggggttctcggagaagctactagataatccctcaaacggggccatatgtccgaccgtgcccatcagcgattaattatattgccgaatcatatcattcattcgtttctcaatcattgggattatgggcgcctaattaacgccgtcatggcaacagtgcgacgcgtgtcacagcaacagtttagaagctactacgtcgtcgcacactgattaattgagaaatttggcgttaattgtggtggagataagtcataattgacggtgatcgaaattaaatgtctctctgttcatctgacaagtactaccacggcagtaagagaaggtgttctctataaaacatgtacaactcagcaatagactagattaatagtaaaccacctcaatagtacgcctacatgggtatctatagctctctaatgcattgcatcgt

SEQ ID NO: 65087 - DNA, 751 bp, Oryza sativa
gcttccctggtcgttgtagaagcaacagcagcaaaccacccaccagcagcagcagctgcaacaaaagttggagcccaacgcacagcagccaaagaatcagcaggccacgcattagcaggagcagcagcaggaaacgcagcagcagggaaagtagcagcagctcaccaagaacagatcaaattggcagcgaaggacgacgagggctgcggcaaccggcgacggctgcaccggcagcggtggcgcagaggcggctggggcgcaggagtggtggcggctggggcgcaggacccttttttttttttctgttggttatatagagagaggttaaagaaaatcgaacagcccacattaattcgatcaccggaaataccttgggactccgattaccacaaacttagtctattttgcactattcagcgagctctatgcatccacggtccctgatcgcctattcaaacaacggtttaaaagttgaacttttgcgcgtttgttttaatatatcccgaaatacactaattcgaaactcggggtattacaaagaacatttcaaaaatcaaggaatccaacttaatgtacaaaatttaaacttatggaataaaagtgaaacgtcaacggagaaaccaagaaaatgttcgtgacaagcaatcttcgatttccgtaaaatcaataagatgcaaccaaatggagacgtctagcccgcaaccaacatatttttttcgataaacaaggagacaaatctctacaacttagt

SEQ ID NO: 65088 - DNA, 3553 bp, Oryza sativa
caatgctgcatctgaatcaataacatgctctatccctggaatgtctggcatggatggccgaccaccaactgcaatgagtatgttttttgcagtataaagctttccatcaacactgacagtatgtggatcaacaacctgcataatatgaacaggtagtatatcaacactgtcattgctgcattgatcctttcaacaaaactgtatatgcaaacttaacccaatttacaaatttgtcccaacctttccacggccttcaattatagtgaccccagaattctttagcatgtttgtctgaacccccaccaagcgctgcaactctaaattcttgttggtcatcagagtgctccagtcatgctttggctcagtgccatacctccacccaaagccatgactctcttcaaactcatgagagtatttggatgcatacaccagcagtttctttgggacacagccacgaagcacacatctgaagtatggaaaaactgaacatcttacttgcacatttttgcaattggatatgaaatggaagaaagatgctatccgcacattatagatactaagcatttcactctgcagacgctataagcaaattacagatatagaaggaagctggaaacgcgtaaggctaactggttgataacaaccagccatcgtgacagagctctctaacttttttgttacttgcgtatatggagagccattcatgtaagtatgtaaccctaatagtaaatctcatatcatcatctctacacatatattgaacaacattatagtgaataccacaaaagcctctgaaattaagcatgagctccaggaatggtgaataagaatctgttcttatagtcatagagtagactcctagtggtcgttgatcataacagagcactggatcgtgcgtgaaattgttcaatcctctcctcactactaaatcataatcctaaacaaacaatcagaagcaaaccatgcacaccatccgaattccaaacaaacattaccactgaacaatgtgtgcgacttgaactaggaagaagggtggcgaagttcactcacgttccgccgacgccgccgaggctgtcggacgcgacggtggcgaagggcatctcgcagacggcggcgcgggcgccgtagagggaggcggcgacgcgcgacgcccgcatcccgccgctcccggcgccgatggtgaagaggtcgtagtcgtagtcgcacccacccccatcgccgcccgcagcggccccgttatccccggcggaggcggaggcggagaacgggcggcgcgggccgaggcggaggagcgggccccggccccgggtggcggcagccgcagccgcgagggggtggcggcggaggtggaggaagcccccgccgccgcggcgggggaaggagaggacgcgggatatggtctggaccgcggcggcggcggaggaggaggaggaggggagggtcgccgccgtcgccatggctgctgctccgaggcttccgcggcggcgcgggggcgcgtgacgagacgagacgagacgaggcggaaatcaaatgcgttgcttcgaggcggggcgcgtggtgtggccgtgtgtggggctagccaggagacaaaaggcgaggctttgttgcttcggtgaggcatgacgtggcatcggcgggtataggtcataggtggcgctggcgcatagccgcggagccgcctgagccttgggccctcgaggtgccataagatacgctttgtaagttttaaagcgtatttttgtaactccctccgtaccaaattagatgtcattttgactctgtaaattaggtgtcgttttaactttttgctttcaattttcgatcattcgttttatttaaaaaattagtgtaaatataaagaaagtcatacttaaaatattattgataataaagtaagtcacaaataaaataaataataattatataatcttctaaacaagataattggtaataaaaactcaaaaataagtattttgggacggcggtaatgggccggatggcctgcaaacgtctactgtgtaccatcattagcttagtttagctttgtgctaggtgtgtactatgtagcctagaacggcccattcctaatagacgtggacagatggggtatcatcatttggtgacccatttcagtactccaacatgcgggaagagagggataggtggaaccgtggatgttcacttaggccattcacggtgcataactgtatacatgtaccattcaatcctaacattccacgtcatggattccataccacatctgctactcccgtaacaaagtgaagtccggagagccaaagttagccacgagttcctcgtcagatttgttagagtgttggggagggaggggaatagcttgggctatgcatccgggggaggaaccgggggaaagaggggagacaggagtggcaccgtcgtggggctcgtcgccgcccccggctccgcaggtcgccggcactaccgttgttccccgctcttccccgatgccaccatcaccaccacaggggaaagaggggagagaggagcagcgctagagaggggagaggccaccgacggagagagaggtagcgccgccacagctgcccgctaccctccagctccactcgactcgacgcctgagatggctgccgcgcttttcctcgtccttactcgatccaccgccaccagagaggagagggtaaggcaaggggggagggaagaagccgccgccggagatgggagaagccggcatggcgagaggagaggggcagcctcaaccgaggaggggtggatctagtcgcccctctctggcaccgtcgcgccgccaacgccgccgctgcttcgggggaggagaggaagggtggatctagccgccccgccgccgttgtcgccctagtgccggtgccgccccagtgccacctcgcccgccgttttctgcgcgatggggaaaggaggaagctgtgcaatggggaaaggaggaaaggagagagaaagggagataaaaagtgaaaaaaagatactagtggaacccactataggtaacttgcattgtaaagtagtatgtggctaatgcggttcttcatctaggtggcatgtgaagttcgccaaaatcacagggcgcactgctactgcccttactaggatgccacatgtggaccccacatgttttgttttactaggatgtcacgtcagtcaagacaaccatctatactaccataggatcttatttaacctggttgtaaaagatgaaggtttaatattttcagtattacgatttgaggatgtaattcaaactcgatgtcaatataagatgtaaagtgaacttattcctctatgcttggccttaaccccacccaaagaagaaagactgttacccaatttgaatttcttggtgcaaccaaggacatcatttttttttcaattttggtatatatatgttgacaaatattctggagaaaatttgtcaaattttgggacatcaatttttttcgattttgctatatatatgttgacaaatattctagagaaaaattgtcaaattttgagacattagatttactctaagattcgggta

SEQ ID NO: 65089 - DNA, 1401 bp, Oryza sativa
acaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgttcccttctctgtcacgaaaggggagcgaggggatcgacgacgggcgaaatcagcggcctttgcaccgatctcggcgtcggcggcggaagaactctgacgcaggctttaactgcgcgcatcagatggtgtcgccatggggagtagtaaacgggagcagtaagacagtagcagtaggaggagaagaagacgacgactttgagaaaattttataatctttttttgttgctcttgccgttggcgaatggaagatgaaactctaatcaaccaaaccgctgatgtaaaaaaattccacaatccgtctcatcagttcataccgaaattcatcaaaagaatcgataagggaaaaaaacagcagagaaaaaacaggggaacacgaacacgaacaagatagccactctagcagccatcagccgccatgggcggcgaaggaaaacaaccaacaccgagaaaaccaaaaccaaaccaagaaaacgacgagacgaggaagaagaagatgaaaaaggagaaggatcaagaactgacctgagttcacttctctctctttctctccctccccggatagcaccggcaattcacttcacttcaccgcgtcgagcgaaaaaaaaaagtttccgggagaatcgccgggagcagcgggaggccaggccggcgaggagaggaggagtgggatcgcgtccgcggcgagcccgagaaccaaaaaaattctcgaaatatattaaaaaggatttcccgggcggagggtggagactttaataagcggcatgaagaggcagctcagtgcaataaattttcatggggcgtttttacagaaaggggcatgtgatttccccatatttgcagatgcatccctctaggtagcaacaaacaatgcccctttggatggagttttgtgggactattttcatcctagtgccttcgtttacaattctgagggctgttcagattgatgttatttttaattattttatttttgggtaaagttatcaaaaaaaatctacatttagtttattgctaaatttggtaa

SEQ ID NO: 65090 - DNA, 20408 bp, Oryza sativa
catgtaaaagtaaattcaatgaagcctaaaagtaatttacatatattatagaagtaacttataaaaaaagaaagtaactttaatgaatgtcttttttttaattggatgtgactacacagctagtggtagctagtttgtactccatttagtatctcctttcaacttgaaaaatacaatagtatcttcttttctcattctacatgaaaaacaaaagtgaaaggaaaaaaacaatcgatgattaaacagatttatagagagttacttttgaaccatgcaaaagttacttccaattaacattgaaggtacttttaaaaattgttaaacttatgtgtgttgatctgtgctgattaaatttaatttcttgataaagtcatatttttatctctacaacgaatttacttctaatgtcgtgacaaaattacttccgttttgttttaagttacttttataatagatgtaaattacttttagactctattaaatttacttttatatgtctaagaagtaatttagtcaactctaaaagtaacttatatatatatatatatatatataaaaatagcttacatatataataaaagtaatttacatataaatatttttcattgtaatataatcatgtaagatcttgttttgaagatttaattgtaacgaacacaatgatgtaatcgaattgtagatcggataagtaatttgagagaaaactttgtttgaagaggaaaaggacgtacatgtatattgaaaaaatgtatgcatgtagtaccacgtagtagctggagttctccacatttctccgtgttcaggcgtcatctccaaatagattttacgattttcttaataagtcgtatgtgaaaataatggttgctttttacagacgttacggtccgtctgtaatctaaaagaagtctcgtcgtttatgtagtagtgtcactatataagggcatgtttagggagcttctagctgctgcagcttctctcaaaattagaaacttcccaaacaatttagttttttatatagattctgagaaactatagttgtaaaatccaaaaaataaaacaagaacccaaagctgaaaaacctagcttttttaaattatcagaaattaactactaaccagctgcttaaacctataggatcgaactgcaagaactaaaccaaccaggggggtgaatggttgtagtacccaaaaaccaaaacttttagcggaattaaaagttaccctcatatcgatgtcgatcggtttgaccggagttgatctaccggtctgaccacgccgatgccgtcggtctgaccacgccgatgtcgtcgatctaaccggagtagatcgttcggtctaaccacctgaagatgccgcagtcgcctgatcctgctgctagtctaactgccgctgtcccaccggtctgaccgatgcgttgccgccggtatcccgccgattgaatcgctgaacctgagcaaacacaaatcgaagaactctcaaagtagatgacaactttattacttctctctgtgtttacaaagtgcaacaacaacactcctcacgaaaatctcgactaaactcgaaaccctaactattatctcaactcaatgttctctaaagcgataccaggagaccacactctccctctctatatatacccgaggtaggcagcctaaagccacgaaccaaacttgtacaagaagacctaatcccctagaaaaccttcacgtacaagaaactaactttacaaactccaattgtaccaaatttggactctttccaaatataactccgcatctgtacgcacacaacacctccatcgtatgccatatggaatcatcaccaatcacgtgcattgatctttagcctaagcatctcgcatgatatatgaccgtccagacgtcaccttatccccaagttgactcccgatccatcaccggcaacactctcccgagacatcaagatcacctacacatgaatcaaataagaaaccatattatgagcacaagctatctccaatttgactcattgctagcaaacaacagaatttcatatgcatagtatctatctagaagtcataaatataattaatccacagatattcaatgaaacaacctaaaaccgaaaccaacacagagtcggccggtcagaccgcgggctggccagtctgaccactcgaagcacgccggtctgaccgacaaccaatgcccggtctgaccggaccgacaatcagtagtccctattcatcaccaaaaccacttcgctaataatctttaaatagcgaaaccaataatctcatatgtcaattgcgtgagcgaccatagcagtgcagtgattctcttctccatctctttccccaaagtgcgtgagcgaccactttggctctgtccggcggttcgtggataggctagtgtagtgtcagtaccttcatttgacttatttttgttctcttccctaaagaatcaaatcagggacacatgtccacatgtaattaatggttctgtcaaaggcacgcaagcatgcatgcattgccagccgacttcgatcgatccacattgttttctttctgcaagctcgcatctttggatgcccatgcactgacctttccactggtattttgacatgtgtgatactgtggttacagttttttaaacaatcaatatcttcggaatgatattttcttagcatgtttacagactgataatgctaaacaaatttgaagtccgccaaaagttcaaaataccttctgaactattgcaaccctcgaaattttctcacttaactacaaaacccaaacatttaattcaacacttaaaattttgacaccgaatgaataatcccaaacactattgtgagtggtttcgaatcaagcaatccaattgaaaaaaaaaaacatgagacccaccaatcatcgctaaaaatcctctgcaatcgactgcaccgtgcttttgtcactaacatatggacacgatgtgtcgtcggacccacatgtcagtgacaaaggcacagtgcaattgactgcagaggatcctgatctaccgatcattccccaggcaatccctctccctcctctaccactttgtggaggcagttatgggcttgcgacagagactgaggcgacaacctactgtggatctgttgtatggctgtgctccttcttgaagcgcggctagccccgatcatgtctccccactacctactccttgacgtgccgaacatgagcgtggatctagggcaacactgaatatggcagtgactgcaacatggatctaggatgataccaccaacctccttcatcccgcaacattggtcactcctccgtggtgtcagaggagtcgttgggagacgaggagagggttggcatggcaagaggtccaaatctactccgtcgctcttttcctttccctatgtctcccctctcccatgaaggatgatgagcgacttatttagcctatgcaaagcacgaaggataagagaaacgtgtagcaaagcgagtgtagtacttgtagcgaatatggcaactaacgggctcacagatgacacaagtgataggggaagctcgaagttggttgcatgcgctcgtggcccttctctcccgcattctgcacatgacgagcatatctggtgggacaataggtagtggagttattaaggaggaagatgatggagctcaaggagcaagtggtggagtcaaagcttgaggagaggtggcatggggagaaggcgcggtggaggtaggtcttagcggagcagagctcgatactaggtgagctagagacgacggtagtgagctctctcaccatggtgcaaattcggaaagactgacggagagcaaggtgaagaagaggaaacactgataggtgggccctcaccggttggttgctgattagcttagactatcatgtgtgcatcatgtcagactaaaaccgttcaaattgagttatgcgtaattcatccgatgttaagagttgacagatatagaattttgagtattggagttgatggggaaaatcgaactactgtaaaagtttaataacgggtataattgacttttttctttttaaatcttggtaaataaccgttgttagatggactgaacggtaacttataatgaccaagcatatcaggatcgatccaacaacggaacacccagatctagttcatttttatgatcaccaaatactacaatcctatgttatgttcttgcatggcaccataactagttgtgtttatctttccattttagaaagaagctggctatctgaacccattttagaacgtaatctctctccagcaaaatccaatgacctcctcctcttcctcagaacaaggacacaccacaaccacgtacccaacaaaacacaaaccaaacaaacttgtattagccacgctttgttgctaatcatagccagtttagcttgttcatcgttggattcgttcgtttttccgcatgagaaatatataaaactgatgcgccgtcatcgttgtcgcatccatccatccatccatcgatcggaggagtcgcctcgcgccgccgcaccggccgtcgacgtcgtgacccgcgctagctagctcgcgcgggcggcaatgtcgtcggacgacgacgacgatgggtcggggcgcaccaagctgatcatcgccgccgtggtcatgctgctcgccatcgtgctcggcacggtggcctacgtggtggtggaccgcgccggcgacgacgacggcctgagcaagcgcggcatgaagtcgacgatgcgcagcgtggacctcttctgcgcgcccacggactaccgcgtggcgtgcaaggacaccctggagcgcgtcctggcgcggtcgtcggacccggccgaccacccgcacgccgccgccgccgcggcgatcacggcggtggagcgggagctggcgcgcgggttcgaccggtcgtcggtgctggaggcggtgcgggcgagcaacgacagccgggtcgccgaggccctccgcgactgccggacgctgctcggcgactgccgtggcgacgtgagccgggcgctcaccagcatcgcgtggcgcggcgtggacgccgtgtcgcaggacctccaggcgtggctcagcgcggtgatcacgttccagggctcctgcgtcgacatgttcccgcagggccccatcaaggaccaggtgagggaggccatggagaaggcccgcgagatctccagcaacgccatcgccatcatccagcagggcgccggcttcgccgccatgctcgacctccacgccagcgagagccacgccgccgaaggcgaggagctcgacgtcgaccacgacatccagcaccacgtggaccgccacctcgaggatcagtcgttaccaccagtcccgccgtggttgtccgacgaggaccggaggatgctcaccagcggcgaggagttcgtcgccgggctgaccccgaacgtgacggtggccaaggacggcagcggcgacttcaccaacatctcggcggcgctggacgccctgccggaggcgtacgccgggaagtacatcatctacgtgaaggaaggcgtgtacgacgagacggtgaacgtcaccagccggatggccaacatcaccatgtacggcgacggctccaagaaatccatcgtcaccggcagcaagaacatcgccgacggcgtcaggatgtggaagacagccaccttcggtacagtacgccaccgccattgacgactcacatccattcatgcattgatcgacatggacatggacattgacatggacggatggatgcagcggtggacggcgaccggttcacggcgatgaggctggggatacggaacacggcgggggaggagaagcagcaggcgctggcgctgcgggtgaaggcggacaagagcatcttcttcaactgccggatcgagggcaaccaggacacgctgttcgcgcaggcctaccgccagttctaccggagctgcgtcatctccggcaccgtcgacttcatcttcggcgacgcggccgccatgttccagcgctgcatcatcctcgtcaagccgccgctcccggggaagcccgccgtggtgaccgcgcacgggcggcgcgaccggcagcagaccacggggttcgtgctgcaccacagccaggtggtcgccgacgaggacttcgccggcgccggcggcgggagcagcaacacgtcgtcgtcgtcgggggcggcgccgaggctggcgtacctggggcggccgtggaaggagcacgcgaggacgatcgtgatggagtcggtgatcggagggttcgtgcacgcgcaggggtacatgccgtgggaggggaaggacaacctgggcgaggcgttctacggggagtacggcaacagcgggcaaggcgccaactcgacggggaggatggagatgcgggggttccacgtgctggacagggagaaggccatgcagttcacggtgggccgcttcctgcacggcgccgactggatcccggagaccggcacgcccgtcacgataggcctcttcggtggctagctcgctcatccatgcgtacgtgtgtatgttgatgcgtgctaggtggggggttgtggggttaaattcgtatgtacaaaatggttacatgtggagcaagcagaagagagagatgcatttttttttctttgagaaacatagtactatcgcaggagctcaccacgcgcggcactcaccctatctttatgagcacctctgaaaaactagcggcactcaccctatccttatgagcacctctgaaaaactaggtatacacctcaaaaagactggaccgacatatcttgagatgcacctcaaaaagattaggactgacatatcttgaaattgatgaaatcatcacagacgcatcgttgtcgagggatacacgtcgtctatcactaaaaaaataattagccgtaaatacgagtactcttgtcaagtttaggacttaaatccaggtatgttagttccaacacaaaaacctaaacagttaagctatgctcacttcgtgaagagagatacgcatttgatccaacgtgctcgtagtctgacgtcattacaaaatatacaaatataacattagtgctagtgctaattacaaaactagtgcgcgacagaacaacattacaaataaataaatatagagacgaaatatttgacaaagtgcttattgtttcgttttgcatgtcaccaatttgctcagccaaaatgctactagtaggtccaacggagaagcctcagaccggcggcagtcggtactcggcagggcaagagggctcgctggagtggaagaaacggccctgtaaactactatagtactagtgtgctgggcttctctcctggcgtggacgggcctcaggtcgatttgatggtcaaccaaccagaggacgaggaagtgaaaagtacaccgaaggtcccttaacttgttagcgagataaaaaacgtcctcgaaccgcaaaatatgcggggtcccttaactatacaaaaccggtcaccctcgacggttttgacgccggatttatcctacgtggcggctgagtcagcgtggaacccacgtgggtcccacatgtcaggatgccacgtcatctctctttcccccttctctcctttcctctctttctttcactttgctccttgtctggtggagcgatgacgggcgatgcggcgacgacgatggagaggcgggagaggagaagaggtccggcggccggcggccggcgaccggcaggggagaagaacagcggcgaggcgggagcaggctgggaagaagaatgacgacggccaggggagagtgggaggcgcatggggagtggcggcgctcggccggcaggggagatgccgcctcctgctcccgcatcgccgcgccgccatgtcctcctcccacgggacgccaccgcggatggagagtggcggcgctcggcctcgtcggcggcggcgcacccctccctcgatgaggcagcggcagcaacggacatggcggagaggtggcttgggcgcgggaggaaggcggcacggcggcgctggtggtgggaggacaggcggatgagcgccgccacgacgcgacagatgtggtcaccgccctccaccgccgcgatgcgccccagggaattcgccatcgccgacctcctcgtgtcctcgtgcagctcgccgcacgccgacgtggagggacgtgacggcgaagcagtgctccggcgagcaggccacctcgacactgccgccgccgactccccgctgctcggcctcgcccgtcggccggcggcgccagcctgcccaaagccagccgccgccatgccccgccatcgccatggctcgcctcctcctcctcctctcccactctagccgccaccacccccagccgcatcgtctcctctcgctcctccgcttctcctctaacgccagctccggctctagcccaacgccgccgcccatcaagcccttgtcctacacggggagagggggagcggatcgagatggacgccacgcgggccaggaggagcttcttcgggatgcaggtagagggacgcgatggcgaagcagcgctccggcgagcatgccaccttgacaccgccaccgccgactccccgccgctcggcctcgccccgtcggccggcagcgccgacctgcccaaagccgcagagagaagattgagagagagatagagaggaggaagggagagaagaggggaaagggagaggagggtgaggtgtacacgttgacatatggggcccacgtgggtcccacgctgactcagccgccgatgatcgtggtaaaagtgccacgtaggataaaaccgggatcaaaactgccgagaaatcttgggtgaccagttttacatagttaagagaccccgtatatctggttttgcggtttgaggacgattttgtaactcgatgacaaattgagggaccttcggtgtactttttccggacgaggaaccgtcctccgggctgccggagacagctcgcaggaacagccatagcccgctggaccatgttcaaggttcaagcacatactgctgcgttcgtttcagccacttcccaaccctctccctcgttttccgcacacacgtttttcaaattgctaaacgatactttttaaaaaaaaattctatacgaaagttactaaaacaattaaactaatacatttttttaaaaaaaaatagcaaatacttaattaatcatgcgctaatataatgccacgtttttcgtgcagaaaaaatgggttcccaaccgacttagagcaaggctaataatatagccgacctattggctataaggttatttgtagccttctatcagcctacccatataatagttagctcttcacaattaatatatagtccacttgtctctctcccagagtttattggttcttgcgttcaagccggctgtaagtttacaacccgcttctcctctctctcttctcttctctcctccacctcagcatttagccggcttatagcctactactatacttgctcttaaaggaacaaagctggaagtagatcaatactctctctctccctctcttatctagtcatctctatgagcatcagattgacgataaacaacgtgaaatctgtatcaagtctagcacttaaattcggctaagtcggtcagtgtcatcacgaggaattttaaccagtatagctaggtttcatcacttatttcacaagattcaccatgtttcttactccgtagagttcctacgaaatgtaatcctaacgactcgtgtcgctgccacttggaaagaaaaaaaaaagcgagtaaatttcacccatgcaaggatatttcgataagattattggtatatctgtctgaggcatgactgtgtaaaaatacatacgtatttgataatattgttggttatgaaattgcaaacttataaagctgaagttatgcctctaagacattaattgtacacatttgaaagtagcttttttagaaagaaaaaaaaaatccatttcactccctcataactattttgccccagcgtttaatatactacaatttacttattttatgccctaaactattttaaagcggttcacttcagctcctaacacgtagttctattttctgtttcttgctacataagtcatattttgttctaaaatttggtaggattggtatatgagttacaacttaccactaaacaatattttaaaaatttaatcattgcttggctttgaagcacttaagtttgattaaaacatcgagattttgaattaagctcaagcaaacaatcatcataaaatctgaaaatattttaaaacattgataatggtgtcatatatagttgtaaaaagtttcagcttaaaatactacctgcattttctaatatatgatgttgttatatatgatgttgttgatattttttacatcatgtttgattattcgtcttatttaaaaaatttaaataaatacttttttgtttgatttagcactaagggagctttaagcattacttctatttttaatacttgcacggttttttttaataaggcaaataatcaaatgttgtaataaaatttaacggtgtcatatattaaaaaaaataaaaatagagcgagcactaacataaaaaataaaagattaagataaatgtataaaatggtcagtggagcggttttaatagtttatcgagaaaatgtagggggaaaaaatccttaggcttaagtgatccgataaaaatagtaaaggacggatctcgtcgagagattctggtacgtcctgggctcctggcttttgtccaatggtcttctgtagcgacgattgggcacgacggacctcaccgtcagtcacccggtgaggcgtcgagcgaaagggaatgggcccaaagatagttcagcctgcgtacgtcttcctggcccatctctgctctgcggaacacaacgtaggcccgcggtcgccgtctgccgggctcacacaaccatctgtccaactcaactgctccactacgttttagaaaaggaaaaagtacatcgaaggtccctcaacttgtcatcgagttacaaaatcgtcctcgaaccatatatatgacatccctcaacttataaaaccgttccctttaggtcctctagtggttttgactccggttttatctgacgtggcggctgagtcagcatgggacccacgcaggtcccatatgtcagccccggcttcctcttccctctcctcttcctctcttccacgggcggtggcggcaaagagcagctgggcacaacaggccgatgcggcgggcgcgggtggcgcggggcatggcggcggggatgtgggcgacgggtggagctccgtgaggaggttcttcgccgcggcgacagagcggtggtgggcgacctcgtcggcgccatgacgcgctctacgcgccataccacctcaccggccattccccgccgcccgcatccagcacgcgaggtagggcttcctgcctccgggccggccgccgcgaggagccctgccctagctctccaagctcgccgctgtgttagtgacaatgcactggatcgaacacctcgcgtgcaaactgtgcacgtccggcacggcaacagacagagaaacaaagaaattcagagcgggattcagaacagagaaaagcagagtttcagagtagcgaaagtgagagaggaattgttgggcaattttctggtttctttcattgaaatgaactgtaaacttacaaaacggaaactgtagctactctcctaaatatactcaacagaaaaaaaacgaatcctatgtccaaaaatcgtgccatcccacgatccggttcttcaggactctggaacacacatgcacaccgcgcactccacgcaactctcgcaacctgcattgcgtctgttatttctgtttatttgatccgaagaaaatggcgtcctcctggcatctcgctccgctccatgtgcccatcacgacggagccaaacttctgaagcaagccaggactaacgtcaacaatctcccccttaggcctggcgttctccaagatcacgaactctaagcagaaaccttgccgtcactagctttgccgccggcaacccttttgtcagcgcatctgcacgctgttcttctgaacgaacaaattcgaccaaaatctgtcttctttcgatgcactcacgaatgaattgataccgagtatctatatgcttgctcctcccacgaaaaacaggattcttcatcaaagcaatagctgatttgttgtcaacaaacaactttaccaattttgcctcctcaccgagtagctctcccagcaatgcccttagccaaagtgcatgacaggcagctgcagtggctgccatgaattctgcttcacaagaagaaagagttactgtcttctgcttctgcgagctccatgccaccaaactgttgttgatatagaacgccatacctcctgtactccgacgatcatcaacatctccggctagatcgctgtcagtgtaccccgtgattgtgatctcaccaattcctgcggtatacacaaggccacagtcgattgtccccttcaaatacctgagaatttgcttcactgccttcaagtgcgtcatggtgggatgctccatgaatctgctcgccactccaacagcatatgacaggtccggtcttgtatgcagcaaataccgaaggcaaccgatcacacgccgatattcaatagcatcaacagggtgtccatctgcatccttttgaagctgtgtctttggatcaacaggaactgaggtcgaattgcagtccaacatcctgaactatgacagaaccttctttgcataggcagtttgtttaagtgtgattccattcacaccttgtccaacctcaattcccagataataactcaagagccctagatcattcatctcgaactcccccatcatttgtttcttgaatgcttctaccctggcaggattctcccctgtcacaattaaatcatcgacgtaaacgccaacaatcatagcttctgctcctctgcctcgagtgtatacggcttgttcttgcttgcaccgcataaacccaagttccttcagactcttgtccaagcaaatgttccaggcccgtggcgcctgcctcaagccatatagtgccttgctcaatttcagcacaaggtgctcttgtcccttcttaatgaacccctccagttgggcaacatacacctcttcttctagctccccgttgagaaaagctgacttgacatcaaggtgatgcacccgccaacctcggtccgctgcgacagcaagtatggtacgcaccgtatccaacctcgccaccggggcgaacacttcttcaaagtctacaccgtgcctctgcacatagccctttgcgaccagccatgccttgtgcttgattacttccccggtagtgtttttctttaactcgaacacccacttgagtccgattgctttgtggcccaccggcaatgtgcacagcgaccacgttgagttcttctcgatggcctccagctccttctgcattgcgtcgacccacgccggctcccctgcggcctcgcggtacgatgacggctcctccgtctctgcgagcaatgcttcaccatcctcttcatccaccaagtctacgcgtggcgcctctagcatgatgtccgccagactcctgtaccgcagcgggccgtcgtcgctgccggccgtgctcagtgacgcctccacctcggcagagtgtgttgatgttgagccaggcgtgggcgtgctgggcaatgtgggtgagaacctcaccgggcttgccggagaagttcctcgctattccgccacttctggctcattgccggctcgcctccctgccagcagcgcccggtacaacggtaccgtggtagactgttctgccagcgccggctgctgctcgccaacaggttcctctaccacaaactcggtggaattctcctctcctgcagcagcactccactgccaaggtgtgttttcatcaaatacaacgtcgcgacttacatggattccgcggcgtcatggatcaaacagccggtgagccttgctcccttcctcgacgccaaggtacacgaactgctcactccgatcatccaatttcttcagatttggagttgtcaccttggtgtgcgcagtacacccgaacacttgcaagtgtcctaagtgtggcttcttccccgtccatgcctcgaacggagtgtgttcacccatcgacttggttggcagccggttgagcaggaacacggcgtgccgcaccgcctccccccacatcctgccgggaacagacattcccttcaggagggagcgcgccatcgccatcaccgatctgttgcggtgttcaacaacgccgttctgctgcggtgagtacggcgccgtcagatgtcgctcgatgccggcctcatcgcacacccgcgcgaactcgccggacaagaactcgccactgtggtctgtccggagtgttttgatggagtgatcggccgtgttctcggccagcggcttgaattttgcgaacatctccagtgcttgatccttcgtcttgataacaaacacccacatccaacgcgaaaaatcatcaacaatcaacagaaaataacgattaacggcaaacgtcgacggtgtgattgggccacataggtccatgtgcagtagctcgagtggcgcttctgctcgataattcgccatcgcagggaatggctgcctgatctgcttcgccatgaggcaagcctggcaaagctggttgggatgatgtacttgaggaactcccgctgccatctccttgtccaccaagagtttcagcgtctggaagtttacatgtccgagccgcgcgtgccacagccacgccggatcgccgagactggtcagcaagcacacaggggacgctagttgcaactcaatccggtacaaacgattcgaggttctcctcacctttatcaccaggcgccagggatttttgtcgaacacctcaaggtcatcattatccatcacaactcggtggccagtttcagtgagttgccctaagctcaccatgttgcagcagaggctggggatgtagtagacgtcatcaagcagccactggtcaccattcttgcatgcgaaaaggattaaacccttccccataatctgtactgatgaggcgtcgccgaatctgaccacccctgtaacggtctcgtccagctcccggaacttccgtcgatccccagtcatatggttgctagcaccattatccaagtaccatagatcaccagcagctgctcccttctctgccagcatcaggcgaggccatacacgctcctcgtgcacgaccagcccacagtccatgccctgccccggcgcgttctgcaccgccttcgtcaccgcgaggagcagagctggaccggcatcgtccgtctgcacaagatgggcttcggctttctttttcttcggatgtgggcactgcgttgagtagtggccgaactcttcgtagttgaaacatttgatgtggctcttgtcgcggccaccgccgccggagccgccaccgctgctctgcgttccgccgcgtccgcgacccctgccacgactgcgcctggcctggccgcggttcgccccctcaccagagggcttgttcttttgtggcgacgaggtttctcccctgcctttcttgaagcgcgcttcccactcggccttagtaaggagcacctgaccgtcggcggtcactccgctagccgccgctttcttcttgcgcacccgctcatcgtacgccttgaggcggcccactgcctcctcgaacggcatgtcatcgacgttgtagaattgctcgatccctacgacgaggctgacgaacttctccgggacggtgtcgaacagcttcttcaccatggcggcgtcgttcaacgtcgcgccgagagcagagtgccggacccccatcatggtgatccggccagcgtactggtcaagcgactccccggcctccatcaccatgctggcgaattctcctttcagagtctgcaggcgcgcgtcgcgcaccttgtctgccccgacgaacctcgtcttgagacagtcccaaacctcctttgccgtccgcttctttgccacctgcatcaagagatcttccggcagtgactggagaagatgggatttcaccttcttgtccttcctcgggtcgacagccgctccggctgccggctcgatcgcctcccatacgccttgatcttccatcattgcctgcacccgtatcacccaactagtgtagttggttgatgtgagttgagggtaaaggaacgcgcttcccgagctccccctcgctggatccgccatcgccggaaccaacgccatagtgtcagatccgcccccccccccaacctgagaagctatgataccacttgttagtgacaatgcactggatcaaacacctcgcgtgcaaactgtgcgcgtccggcacggcaacagacaaagaaacaaagaaattcagagcgggattcagaacagagaaaagcagagtttcagagtagcgaaagtgagagaggaattgttgggcaattttctggtttctttcattgaactgatctgtaaacttacaaaacggaaactggagctactctcctaaatatactcaacagaaaaaaaacgaatcctatgcccaaaaatcgcgtcatcccacgatccggttcttcaggactctggaacacacacacaccgcgcactccacgcaactctcgcaacctgcattgcgtctgttatttctgtttatttgatccgaagaaaatggcgtcctcctggcatctcgctccgctccatgcgcccatcacgacggagccaaacttctgaagcaagccaggactaacgtcaacacgctgcttcagatgtagaaatctacaggcgcttcattctgcagtatgatatcctctcccggcgcgaagtactcggtattcatctctaaaaccttcacttaaattacaccacagaagatatcaactactcatgaacatccaacaagaattgaaaagaaacaaaaatcacatgatcacattgagatcaaatatgatcatgtgattaaaaccacgtacacacgccaagaaaccatcatgtgatgtgacttgtgagtactagagtatactgaaccaagctagaacaccaaagaattgctgctgatcaacaaatagcaagggatcaatcaaagaaagtgactactgacgaatttcctggtgcggctggtgccgtggacgacagggttggtcatgttgccgatgatgtaggcggtgaggccgaggttgaagagcatgtaggcggtggtgtagaccatctcgccggtgttctcggcgtgcatgtcgccgtagccgacggtggaaagggtggtgatgaaccagtacatggaggcgacgtagaactgcgaacatcgactaggccgcctcctgcgagcgatgagacggcccaaagtggcgacgaagaggatctacctacgcgctcaccgctggcttccttgtctcctctttctccacgcactctcgccgccggtcgccgtccttcccactccctccactcttccccttccccttccccacttccgcctccccccacctcgccggcggcgacgacgatgaccgcatcgatgcgagcacctctttccgcgtcgcccgtcgccgggtgcctctctcgcctcaccccaccggtcgcctcgccctgcggacctcctccccacctggccacccgccggccgggggttggtccacacagagaggagaggtgagagagataggaagagagagaagaggggaaagtgagaggaagggaaataacgttgttagcctgacatgtggggcccgcatggatcccacgctgactcagctgccacgtcagataaaactggtgtcaaaaccacggaaagaccaaaagtgaatggtttttgtaagttaagggatggcatatatctggttttgtggttgggggatgattttgcaactcgatgacaagttgaggaacctttagtgaaaaaggaaaaagtaacagaggagaggagtagtagcaggggcggacgcagaaaaaaaaatgactgggggcatgcatctataactcatagaacaatttgaaagccgagtgagactcacctcattgcaacttataaaaactctgagatattacattatcttaaatagtaatatatagatatgtcttccaaaatcctaaataatgttattttccaaaatcctaaataatgttattgcctgtaaaaacaacataagttattagttaacacaaaccaataaaaatattactgaaagtaatatatatatatatatatatatatatatatataaggaataaggtttagaacatacatggcatcctgtgtatccttttcacgacctatacatgattgaaccatctcttcttattcccaatcaacctataccgatattgaaaatcaccacgtggctgatatggtccccaaactaaatactttctcatcttcatgttgattgggatgataatttaccattctcttccttttactaggatcccgaggaagttgtccaaatcaattggttgcggcactgcagaattctcttggtattggtctagatgcatttgcactagaacttcctcttgtggtgttcatagctgttggatatctaataaaaaacttgtccattatctttcatataaaatcatgagaaggttgattagatagagcacatgaagagggagacctaggactagggatccatccactatatctattcacagggaagaggagtacttaccatgggaggcagagaggacagaccgagcaacagctgcagcaccgctgaggtgctgattatgaagagtgatcgcgaggaagggaggaagcagcgataggagcgaagatgaaccgatgcgggggaagcgtgatggatgggcggagtccgcagagaagaggagcggacgttcgacgacccctcgactcatgcgcgcgtgcgatggaaggaacgaaaacaagggggtgtggggtccttttttccaattggagtggggtccataggttatactactatgaatatagcgaggagcgtaaattttgactggggtccagggcccccatcgtgtgtacgctaaatccgcccctgagtagtagtagattacagttgaaacatcagctaatgctgtctcagctggcatttggcaggcgatcctcatcttctcccatatactcttttcagttccacagtctggatttcttacattctagcttatttattaaaaaaaaacttcttttacaaatatacctcctttgagaaaagcctaggggttttctgtttagctccacgaggtggtgggctaggcgacctaggttcaaagcctcactcttctaattatttgatattaggttattccctaatattcatgttttaatatacctcctgaaaaacttgtccaacaaaatttctcgggcagtaaccatggcattttcagggtgtgttcgaaccaaggtgttggaagcctctcctttcctgcatgaaaaaatgatgtaattatctagcgcataattaattaaatattagctaaaaataaattattattattttataaaataactttgctatagaatacttcatgtatctacttttgatagtcatatttcatcttggcacacagaccaaggataagtgattctacttatcacccatttaaacgtgctactagtcattcctcgtaaacaagcgattcattgatatttgcatttctcgatgctcatgtagacaatcttgtgtggaagaatgaagagtcacgcattaaatccaagaaaggcattaagatgataagttgttgtattgaaatatgcctatcaaaaataaattttttagatttggaaatatgactatcaaaagtagatggagggagtttttttttttttggaaaaaacacatcgtttactagtttgcactagtatagaaatgcacctatgtgtcgggtgggaaccaaccataagtaccgaatttcctgaccagtatcaagcaggcagcccctttgagtctcctcaaagatgtcggtttaggaaccgatacctttaaggttacttggataaaaaaaaaaagccagctccgagcacatccaccttgtgtcgcccccaaaatcaaccaagctttgccctccgaaatcaatcacaacgaactcccaacagtcaacatcaccatcacagatcctagtcatcgtcacaaaaccatactccctccgtcccattttaagtgcagccatggttttctctgcccaattttgattgtccgtcttatttgaaatttttttaaaaaaaattaaaaaataagtcccgagtaaagtactatttatgttttatcatctcataacaacaaaaatactaattataaaaaaaatttaaataagacggacgatcaaagttgagcgcggaaactcatggttgcacttaaaataggacggagggagtagattacaagtcacggtatcgacaccatggaacaataacaacaacaacaacaacaacaacaacaacaacaacaccatcttaaaaaaagatgaaagaagaacaacaacatcatca

SEQ ID NO: 65091 - DNA, 838 bp, Oryza sativa
aaaatttgacaggatatattttaaaattttggaaagggagagaccggatagtcagatagattttaaaattttgctcgtgttgccaaccgccaaacgcagctgcagaactaacttaagcccagcccccaactgcccaatagtgtggccgtgtgggctataacgcccattcgccgctcggagaaaaacaagaacatcaatcagggcaagttttataaaaaaggtgaatgttgcatctaatcttgaccacatcatcaactaataaatgtagaggtaacatgtacaatatatcacatctatactaattctaatacactagccccaatatttgtttgcccaatctactcttcctctctctccttttgtcttgaattttgtgtagtggttacctcttgcataagaggtggctcattttctctctcatctcatctctccacctatagatggccatgtgggccgcccggcacggcaaggcccagcccagccgtgcctgggccgaggattgtcaggccggcacggcccgaccgacgcaccgggccgtgccgtgccagcccacgtgccgcactcgcggcccaggcatggcccaacacgtctcgggccgtgccgggccggcccaaaggcatgatgggccatcgtgcgtttcctcagaataagtctaattttcctccctcctattgggttatgagtatatatatatatatatatatatatatatatatatatatatatatatatatatatatgtaccatatactaaaatgctattaaataccgtctaataaagtaatttaaatgttacatagaatatattctagagcacttatgtagaagatcgtttggc

SEQ ID NO: 65092 - DNA, 683 bp, Oryza sativa
aacactatgctcgttggcgaattggcattgagtacgcttagaaatcagatggactgctgatctgctatgctcaaagcacaatcgaatagatagttcatatggctactcaagtacaggattttcctacaactcaggtcccataccatctcctgcgaccttattagtagcttcagcaacttgcttcaccaggtttgcaccaacattcttagcgctgtgctcaaactcaatgcttttttgcaacagttactccatttgtgactttgggtctttgagagacctatgggatctctcaataatcacattgcgcccctacaacgcaacacacaagaacacccattcagtcgataaatcaagtggggtaccatatcacatctgtaattgagcaatagatatgatttcaatgttgaaattgagcatccttttacttctgaaatgtgccagtataatgattagatagctcttgtggaatgtacatgattagattggggggcattgggaaggcaagcaacagctccatcaatttcctactcctaactcttcaagatttaaacaaaatcaggtcaataacaacccttcattgtaaataaaactgaggggttctgtaatatcaatggactcgtgcgcttaagtattggtaacagttcaataagactaaaattgctagccacaaaaggggggcagga

SEQ ID NO: 65093 - DNA, 1749 bp, Oryza sativa
tttgcgttcctgtagtagtgtttgaaagcgcatgcgtgaaatacaatagagtagaagtttggaagagggagtaaagaacacactattttttttttgaaacctaaggcggaactttgttccactttcatatttagaagaagagaattgacccaatttataaggaaaaccgggtccgaaaaccatataattgcacgattaattacaggaaaaccggctgaaaaccaccggtacacaactaacaactacggcggagcccaaacgcaggatgtcgccgccaagctaaacacaaaagcgactaaacagctcccatatcacataagaggtgttattgttgccgagctagccgcccaagcgacccagcagcgccgacttcacaaccacagtgacactgaagccacgaaagtcaccaaagcgaaaagcagctccggcatccaacaatggacatcagcctgaccatcgaggagccacttccttcacacggccagcaccagaactccactattgggatcaaattaaaaacgggagataaaacaaatttagcaccccctccgttccataatactacctccttgcacaaatgtatgaccttggttagctcataaaaaaaatacggagggagtattatattgcattctggcaacgtatgcgtagattacagtttatacagtggtactatctagtacatgggctctgcgaatcaaagataccgttaataagcacgtcgcacgaaaagttgaggacaatgtagctttttctctgcgaaaatggtggcagatgatcatagataggataggatatgatatgatcccaaacaaacaggcatcgatcaagcattcgcgagcgaaatggcgatgattgcgagggaattctgttatcgccgtgtcaaccgctgccatcattccatctccctcgcgccgacgcccatcatttctcacacccctctccctcccctcctgccaaacctttcgatccaacaccaacatgctgcatgccatcatcttgccgccggcacagtcgccattgcctctctccctcttttattatccccatcaccagctgtagctgtaacagcacaacaccctttcttcacatctactacgtagtatgtaatcaccatgcttattgctccctccgcttcagattatattaagctgtgtttgagagagagggaattgagaagatggggaagatacgcaaaacgaggtgaaccattagcgcatgattaattgagtattaactattttaaattttaaaaatggactaatatgattttttaaagcaactttcatatagaaattttttgcacaaaatacaccgtttagtagtttgggaagcgtgcgcgcggaaaacgagtgacaatctccccaatctcctttgaaagaacgcagcctaagtcatgttgatttcgatcaaatttaaattgttccaagtttaatcaactttgtagaaaaaaagtaatattttcaatacaggataaatatattataaaaatatattcaattatagattcaataattggtgttataaatattactatatttatctacaaacttaatcaaacttagagtaatttaactttgaccaaagtcaaaatgacttataatctgaaactaagtgagtacacatttagttgagatgtatatgccggttaagttactaacgtcttatagtatgtgttgctacatccgtccttaaatatagtaacacacgtactaagtatcaaatgtgacgtatttttgtacggttaaa

SEQ ID NO: 65094 - DNA, 1374 bp, Oryza sativa
aggaaaatgtaactgcattcggctatagtgcatggcatgatatatgcacgttatacacattatgtgtaccttttcaacaagacaataatcctcttacatggggagttgggaggcaaacaaaaaatatggggaacaggcaaaggttgagaatttttgtagctcaatgtttttgtaccatattcatccccatgcaaatcaatttcaaacaacaaaataaatgatggaaccattcaaacataattcatatgagagaattacagaataaaggataatgtctgtcactaattaaaaagcaaggaggtggaatgaaaccttgtaggagcgaagaagtgtgtattcataatatctcatcttttttacatcttttgaaacctctaccgtaagctctttttctgtcaactgcctaatgcggtaactgcagcaaacagagaatgaggcatgagaaagacaccttaatatgtaatcaaaatacaaaatgaaaatcaaccatcacatacctaggaataatgtccctgaacacagcaagcaaggacatcagactaagtttaacaaccttctggtctttgtcattgcatatgtttaacatatcatttagagatctaatatgtgattcaggatcttcaagcatagacatccctatttcagccagctgggccttctttttctcaaataattcctcagctgaaagttcctccttcacctcctcctgtcaatcggagcaagtacaagacatatgtgaaaaaaaaagcattaactaacaaatagcaacatggtgattttaagatcttgaagggttgaaattgtgggcccatcatttgttttaatattgacccaacattttacaaacatgcttttttctccatggttattcttgcactgcattctataggctgtatgattaatagtttaatacccagaactcatatacatactgtgatgttcacagttccgtaccatctgacctagcgttttctcgaaaaatcttagcgtttcatgtcaacaacgaataagccagagagcactaaactaatacaggtatgacagtcaaattatatatgtggatgtatgttgatcaacaatgatgcataggatacttccatactgacaaagttgcaatcaagcaaggccaaatcatatattttttgtgctaccgttatgaagaaggcatatatatagtacatagcatatggtttttccaacaaccaaagcaaggaggtcgagacagcttgtcttcctaacaggcattaaaattatgtatcataagcaaaaggcttgttgaaaaatgaatctctgtgatgcaaaaaaagaacaaggtaataccagcacttttgattgtaattttccatttgaagcttgagtattctatagtgtcac

SEQ ID NO: 65095 - DNA, 548 bp, Oryza sativa
ggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcagatggaggcggcggcggcggagtccctgccggagaggccgtcggaggaggagttctgcgtggcgctgcgcaacgggctcgtcctctgcaacgtcctcaaccacgtcaacccgggcgccgtccccaaggtgcgttgcttaagagttcaagacccaaacaaaaaatcgatcggattggaagtcatttttttttttgaa
